United States Patent 10,273,493 (OPTIMAL MAIZE LOCI) - sequence listing, part 3

SEQ ID NO: 3264 - DNA, 1551 bp, Zea mays
  misc_feature (1)..(100): optimal_loci_51178_G1, chr1:297570680..297572230, Cluster 19
ggtgacctagtggggcttgcagtagtagcccattagaggcatgcaccaacactagatcaagcggcgccccttcaggcgccctacccagtacctttggacaacacaagacaaaaaataatagtgcaaaagatttgaaaaattacagtttatattagtcctaaaaattgcctcaatggttctacatggggccagtcagaacacaagtaatcttgtagcatgcataatctacaacaaaataatcaattcaacagtcaccactcatcagtcattcaatcctatttgtagttgtcttagtattgttactcccacacctgcagatgtaggtccttcgacgaccacacataacagctaactaaattgctcacaaatgaatataaattgtagttacaaatgtagttagcaggtccttgttctttgttcataataaagcctttccaaatttccaattatatttttaaagcatcttgttatgaacttgtgaatgtaaactgtaatcactcgatgtgcaattgcatctaatttaacttggttgcagttggcaagtcattgttttctgttagtttgtgtaagtttattcagctaataattagtacctcttttgatcgaagtatttctagaatctagctatagtcagtaactccattttcacctgctatgatggtttcaattgtatctttgtttcaaggacataatacttgcctcaataagatcatctacaacaacatatccatttgcctcttccaaactcatctgcatctgcatggttcaactatttttttaagataggtgacctatatcttttagaatatcagtgatgcacatataggttattttacatgatattcgactctatttgccaacctaatatgttggagtaaaaattttggaggtgctagaaaaacaagtagtagttgttgcaatagaaaataataaacatattctcattctgaacatacataaaagattaatcatgcagtatccatttagaacaaactgttaatttatctgattgaaataagcaaccttaacgtattcatattgtagtgtaacattcatggctcaccaattaggaatgctaagctctgtcgcatagccagctatcttgctcccgttgtccatgttgagataattattcatgcttcacgtagaggaaacacaaagaaggttacacaaatgggaggatcagaagactacaaagccgcttcttgccggggttggcaatggcgattaatttactggatgaatggacagattagagtttttttaaggataacagattttcatcctcccttaagaatttgtttgatataaacataacaagatctgcaaacaatctcattatgataaacttagaaggtaaacatacactccaacataatagcagcagcaaaaacttccactttaactgataagttagtgatcttgatttacttacttgaaaccatgggacctgtcaaatgaaatgcttattagaccagactaagagagctgaactattgtacatcaacaaccttcttcatctcaacatcgtagatcctgatcttggggtca

SEQ ID NO: 3265 - DNA, 3705 bp, Zea mays
  misc_feature (1)..(100): optimal_loci_51473_G1, chr1:299452067..299455771, Cluster 19
catataaagtaatgtttcatgtagccaattggttcctaatggttgtatcttccttgtttaataataatttagctagctttccatgcttattgtttgcatgttcaccacttatgtgagaaactttgcatttttgttgaaaatgaaatttgcatgctttagtaagtacacaaataaaacgcctacctttccccttggcagtagcaggtcagtggagataggggacttccgtgagaagaggtgtgagccgtctgagggactccacaaaaagtagctgtttcacataactccacataaagtattagtttcacataattaatcatttgtacatgtttgtagtttccttgtttaataataataatttagatagtttttatcgacgtttgtagcttatttgtttaataataatttagctagctttccttgttttccttttccatgtctatgtgagaaactatgcatttttcttgaaaatggattttacatgctttgctaaatacacaaagaaaatacctacctttcctcttggtagtagtgggtcgatgaagataggggacattaaagagaagggttgtgtgggccatcaaaataactccacataaagtagcagtttcatatagttagttagttgtcgatttttgtagctagcttctttgtttaacaataatttagcaatctttccttgtacgtttacgatttgcatgttcaccacgaatgtgagaaactctttatttaatgatttttgcgtgcttcgctaaatgtacaaagaaaacacataccttgctacttggaagtagtgggtcggcggagataggggactttagagagaaaaggatgtgtaagccatcgaagggactccatatacagtagagggttcacatagtcaattagttgtcgatatctatagcttcctgattcaataataatttagcttgcttttgtctatgcttgtagctttcttgtttaacaacattttagcaagctttccttgcttaccatttacatgttcatagcttatgtgagaaactctatgttttttgttggaaatgaattatgtgtgttttgctaagtacacaaagaaaacacctaccttgcctcttggtagcaacaggttggtggagatagaggacttcagagaaataatgattgagccatcgaagggactccacataaagtagccatctcacatagtcaatcaattgttgatgtttgtacttccatgtttaataaaaatttagctagccattcttacttatcgtttgcatgttcaccattcatgcggaaattctgcatttttgttgaaaattaaattttgtgtgctttgctaaatacacaaaaaatacctacattgcctcttggtaatagcatgtcgatggagattggagacttcataaacaaaggatgtgtgatccaacaaaaggattccatataatgtagctatttcacatagtcaatcaggtagtgatgtttggagcttccttatttaataataatttagcttgtttttgcaatgcttgtagctttcgtgtttaataatagtttaggtagcttttcttgcttaacatttgtacattcatcacttatgtgagaaaccctgtatttttttgttgaaaaatgaattttgcaagctttgctaattatacaaagaaaacccataccttgcctcttggtagtagtaggccgatggagatagggatgtgtgagccatcgaaagtactccacataaagtaacagtttcacatagccaatctattaccaatgtttataacttccttatttaataataatttcgctagattttgtcgatgcatgtagcttccttgtttaataacaatttagctaggtttccttacatactgattgcatgctcactgcttatgagaaaaattgcatattttttgttgcaaaactcattgtttaatagcaatttagctagctttccttacttaccatttgcatgttcactgctaatgtgagaaactttacatatttttgttggaaaatgaatttcacgtgcttttctaaatacacaaagaaaaccactaccttgcttcttggtagtattgtgtcgatgtagataggggacttcaagagaaaggatgtgtgagccattgaagggactccacgtaaagtatcgatttcacattgtcaatcagttgtcaatgtttataactttttacttaataataatttagctagtttttaccgatgtttgtagcttcattgtttaacaataatttagctagctttccttgtttattgtttgcacgttcacctcttatatgagaaactttgcataccttttgttgaaaaacgatctttgagtgttttgctaaatacataaagaaaatccctaccttgccttttgatattagcgggtcggtggagatagagcacttcaaagagagaggatgcgtgagccatcgaagggacttcacataaagtagcggttcacgtagccaatcaattgtcgatgtttatagcttccttatttaataataatttagctagcttttgttgatttttataactttcttgttaataacaatttagctaactttccttgcttgtcatttgcacgtgaacttacgtgaaaaactctgcatttttgttgagaggtgattttttgcatgttttgctaaatacagaaaaaaaaccttaccttgcctctttgtagtagttggtcggtggagatagggaacctaataaagaaaggatgtgtgagctatggaagggacaccatgtaatgtaacaatttcatatattcgatcgattgtcatgtttatagccttttatatttaataataatttagctagattttgtcgatgtttgtagctttcttgtttaacaataatctagctagcttttttgcttattgtttgcatgttcaccacttatttgagaaactctgcattttttgttgaaaaatgaattttgggtgctttataaaatacataaagaaaatctgtaccttgcctcttggtagtagcgggtcgatgaagataagggacttcaaagagaaaaaatgtgtgagccatggaagggactccatataaaatagcagtttcaagtagtcaatgtttatagttttcttatttaataataatttagctgacttttgtcgatgcttacagatttcttgtttaataataatttagctagctttatttgctcaccgtttgcacgttcattgcctatatgaaaaactatgcatatttttgttggaaaatattttttgcgtgctttgttaaatacacagagaaaaacactagcctcttggtcgtagcgggtcagtggagatagaaggcttcagagcaaaaggagatgtgagccaccgaaagtactccacgtaaagtagtcgtttcatgtagccattctattaacgatgtttatatcttctttatttaataataatttagctagctttagtcgatgtttgtatctttcttgtttacaattatgtgataaactgcattttttaaaaataaattttgtgtgctttgctaaatacacaatgaaaacccatgccttgcctctaggtaatagcgggtctgcggagatagggggcttcacatagaaagtatgtgtgaaccatcgaagcgactccatgtaatatagtggtttcgcatagtcaatctattgccatatttatagtttatgtatttaataatagtttaaatcgtctctatcagcttacccatctttcg

SEQ ID NO: 3266 - DNA, 2123 bp, Zea mays
  misc_feature (1)..(100): optimal_loci_51655_G1, chr1:300261494..300263616, Cluster 19
agtctcctctcgtcaatcgaggcattacgtccgaggatttataatcgtggttggtttccagcaaattatcctcgaaagaggcatcaggtatcgagttgcagataaagttatctgatattaagccatatcaaatacagtttaaaatatcggacccgatttttgttgggttcgatccgcgagtttctcgccacgatctaatttttcaaatataaatataaatataaataacgggtaaaaaatcatcagactccagaatattcactaaatcaaactctgtccaaatattattgtcagtctcatttttgttcgatcctttattacatcttttagaccctgactttataacatcaaaaaaatctgtatttttctttgtaaaagaagaaagcaaaagtgggaaaatctttgaaaaatctattcagcctcatccaaactaccgctcttcctctggtggatattttcttcacgccgtccaacttttctcggcatccatctcccctatatctctaactcccacaatgtgagttctctttgataaatatcctaggttcacctctcccaccagtaagccccatcggctagatttttttatttgccaaaccatctcctatccgtgcatgtactcaagaagctcactcacgtcagctgatccttatcatcctgcgagcgtgcatgggaggcctcactctgtacgttattctaccatggccgtcgattcatgtcgttcttgtgcacaccttcctctcccatggccgtccgtcaatccgcgtcgcgccggccgttcgctgccaacgtatggccgctggtcgtgctcctcccctcgacgtcggattgcaccccatgcccggcttcgatcggatgtagcgcgtcgtcctctgtcatctagcatcgtgcctcggccgtgtacttgccttgttgcgggtcaccatgcattgtcgtcttctaaccacatagtcaccctccctcgccaagtctcgacgccattgtttcccatcgtcgtgctcggcaatacacctgaactcgagtttcgtcgtcgttcgtgtcggtcttggtaagcaaagtagctattcatgttatttaaattgatgaatggattgattgtatgtgttaatcgtgatgtgtgatgaagtttaggcttagggtactattcataagaaaaatattagtagacatatatgtgatgtcttggcgagttgttggcatataaaataggctagtaatttatttgactagctagtcgacaagttctatcggtattgttgtgtcaatttagtataattgagaaagtaatgctttgctagtagttattatgttttgtgtttagtggacgtgtatatctaatcatattaaattaattcgatgattttatgtttataattaggcagtaggcaccctgcaattgcgtacttaaattcagacttgaggcacttatcttgcaagaagtgttttagtgaaggtaaaggttaagtatgcttgaataagttctaggtttgtgtaatagggcacattaatggtacaattaggttactagctctgtcttgttagtttaccagcacttagctatgaggctttcatctcttgatgaaatatattggtagccatgtttgtgatgtgtggtcaaattaataatatgaggaatgggtctagtgttcctaccggctagccgacatattcaactagaattaattgtgccaattgtaatgatacattaatgttttgcttagtggcgtcgtgttctatgttagttaattggttaaatgtcataaatggagatttatcgctcaggtagtcaagttaaccatcttgaaaaaatatttatcattgtcctaattagtttgaagcaaatattattgtaggtccggttcaagtgaattttgagaactgcgtagtgagcattgcaccttggtgttttgagtttttaggttttaaattgtgatcttgtgaaactctatatcgcttgttaatgctctacttgttagaacaattagtgtggcgctttatttagttgatatgcttttcataatattttagaatagtaattttaaagctaattgtaaaactactatttgttattctaagtcctaggtatcctagattgattaacttaagtattgttagtcttcggt

SEQ ID NO: 3267 - DNA, 1721 bp, Zea mays
  misc_feature (1)..(100): optimal_loci_54863_G1, chr2:16646805..16648525, Cluster 19
tatggtttattttatccttaaatatttgacattgtctctttctaatgcacatttactttttcccaatacatttttaactatattgtttgaggaacattttggcccttttctctctgccttggtctatgcgagaaactctaaacaggcatgtaatatggaaaaaatgggacagagggagtattacatatttgtttatggcttgatttgagagttttttcttgaccttgaaaatccattgaatgtgcatacctacgtgactacagtgtactattattaggatagtatttgaagtactttgtccagcgaccttcattaaattatagtacactatttgtctattcgttgacagaatagaagtccttaagaaaattatcaagagtattatagatattcactcatgttttgtagtttatccaagtctatcgtgcctacatataaagaaaaaaattataattaaatccagaaataaaaacaaatgtgtgatggtcattataagtatttaaccccttttaagacattaaaacatggtcagagaaaatacatacgagaattttctactctcacgtcccaaattataagttattttaatctttttagagagtcaaagcagatcaaatttgacctaatctatataatgaataataacatttaggatactaaataagtattagattcttcattacttatatattttttatagtatatttatttgatgtcataaaattttataaccgatttgtatagttttggtcaaatttcagatgctttatttgactcttaaaaagttagaatgttcttataatttgtaacgtgagacatagatattggcatcaaaaccaaggccgttctttttgagctgttccggaggaattttgctgggaatccgaccgaggtaatattatatctttggcaaagtcaatgcttatcttttcagatgtatggatcaaattatgtgcccccaaaaagaaccgcttttcaggcatgggggagttggggaataatttccaccaaagagaagaagagaaagatgggagagaatatttggcactgtagtaggcaagtggccttttgtctctgtagacgctgttaccttaacagtagacggacaattgctgctaagattgagaaatctgttagccttgcccgggaatcgcagaaacgagacaagcgtgtccccgaacgtggatgcagagataagagatgcgacaaagccgatgccctggaccattttatcatgcgatctgacaaatggacggttgtaaaaatcggaatcaaataccgtcaaaagtctattgttacgcgtgcgtctggcctaagcaaggatacctaccgcagtagcaaaaaaatttacgacgaaaaactaccacattgatggctacgagacaggaaccaacacaacagctagcagcactctcgtgtttattttgtttcactaaaaaaatcctaccttacgtttaaacaactttctctttttctacccaactgaaagctccaatgagaaaggaaaagccacgggtaccagtcaagcgaaagatgatatgaagtgtttatagaacatcgtccttagacgacagcttaaaaaagagtaatgattgtgacacaacaaaaaactctaattaagctcaataatatatactgcagggaaggggactccgaccctgcacctcccggcgtgcagggctgcaagccgatgaatcagttagtgtcagcggactagactg

SEQ ID NO: 3268 - DNA, 1445 bp, Zea mays
  misc_feature (1)..(100): optimal_loci_55164_G1, chr2:18142933..18144377, Cluster 19
aggctcgctcacagcagaccccggctgtctgccgtgctcactgctcaatgccttttcagcacatcttatatgctattttaacaaataacaatgacgcaaaaggagggaaaataaaatgcaattagtttaagctagtggctttgttccccttcctcgagggacggcgtcttttcacgttttggcgttttgctgttgcgctcagacgtcatttttttttggcagctctcggtacaggacacggttttctttccaggggaaggactaatcgtgactccgagtttagggcggtgagccggtgatgtcagacttgatgagtgatggtcgatagactgactcccctgctccacctctcccaagacaagaacacaattatagatttcatcaaaatttaagtaaatttagcccattctcattgtgagaaattttataagagtttcgttcttattaaatgatataccacatgagcaaacaagatatgtcaagcaatttaatgaagagacatataagagagtttcataaaagatgagagagaggatgaaactctgtgtacactatttattagaaaaatattttcgcgacatcctttaaaacagtgtaaggaaactcccaccgtgaatggaaaatgctgccaataattatgtctccaaacaaatatgctatacaaatatttctttctataataaatcaaatgtcatataatttatcatgaatatcgtttttccataaaaaatcaggcgtactcatattttttttcaagatgctgataaaaggtagtacctgcgcgtatacgtacatatatgagtgcgattcaggaaaaaagaatgaaactaatctgacttagcaccttagaactctagaaggctagtccttgaaggccttgcatgaaacatttgtgtatctctacggatactatacgtactagtcctccagccctcttaagaaaaaaataaatctcatttctcgataaggcaattaatgtcaaatttaaccaaatacataaaaaatgtttgatgtataaataaaagcctgtttaacatatatagacttgagagtatttttttagggcgagcccaaaaaagtgacctacgactacgaccagtcgaccatcccattggtgagttcggctagctggagcacaggctgtctgatgttttttacttgaaaatttaattttaaaaatactccgggtcaggtttagaacgagaaaaagttttaggcaactgccaactaggcatctgtgaacaggggcggagccaagggggcggcaggagccatggcccctcccaaggctgcaacacatacaagaatatatatatatatatatatatatatactctaaattttgtgcagcataattaatcaaatgtgtaatatagtggttagtaatacatgatccataactatgttgtagtatgccaaccaaagtctaaaaaagacaaagaata

SEQ ID NO: 3269 - DNA, 2238 bp, Zea mays
  misc_feature (1)..(100): optimal_loci_5545_G1, chr1:28399561..28401798, Cluster 19
aggatgttagatccatcagagctaatattagcagctaacaaaataataattatcttataagatccatacaaaatctactcttacaaacgagagtaccatccacatatttacactgctagacaatagacatgacaagtggatagcagttgcaaccaaaaggtatattataatgctaattgttctcatttcatagacattagagatgatttagggaaaatgtcatctccggttgcatatgttcttttatatttctttaaccaaatataaaagattgcattgtcaaatataataataattgatctaaactcttagcttaccccacgaagtcgtgacatagaccagtacattgactagcatgaaaggaaaaaataggtatccatcgctatcctaaggcaagggtcctcaagctatcagcttcacttgtttctctaattgtagagaaatagaattgctagcgatagtcaagccatttttgttgcgtcaaaaaaaacataagcgaacttaaaatatggaataaatgtggccactcaaatttggactaaaataaaatagatgtttctaggcaagaaacaaatgaaaaataaaataacatagcatcgatggaccaaagtccaaaggcttattgcaatcaagtgttattatgtgcacctatttgataggatattgcactatgcaatttgatcaattttaactttctagttttgagtaacaaggaagttgtttttttggaagagggggaccctcctgtttcattacgaaataggaatagaacaaagccatggcgattacatccatgcaacacactaaggtttaatagacctcaacgccccagacataagagcacaacagcatcacccttatttacatagactgaacatgtccaaaacgatagtctacaccacacatgcggccacatttatgaaccaaaggaacatcaaagtctaaactaagtctcctttctaaagatcaccgaatcagaaacctttattgctttaaaccaacatcctcctagaaaccgaagcccaacctctcgcccgattgaggcactcatttgttgtccttcgaactagttagcttccttctggtagcctcctttttggtgtctcgatctgcaataaagcccaataatccagccaaaaacaacagaggtaaatcacatcagagggatcagagaacattttattgtcaaaacaagctatgttccttgttttcaagattgcccacaacaccgccccacaaccaaccaacatcaactttcagttgtctttcttaaaagattgaatccaactattaaagagatgacaaatgttcttaggagtattaggcaagttaaaagcaatttggatgattctccagatgtaaatggcaaccgaacactaaaaaagaaacaacgacaatccgacaagcctacccaaccactttttttagattttctttaaacaatatccagtttttaagtaacaacgagagatttttattttctaagggagttttgttttccacagaaacctgaacgacactttggtggaatcacatctgatctgtaagtaaacagacttgactgaaaaacccttagtattaagagcccaaatgactctatcacttacattagtcaggctaaagtcctcgcaacaatttttagattctcaaacatactagcagtatcacccactattctccttctaaacccattttcaaccgaaatgttttttatcaaaggttaactcaaataaccttttgaattttcagcgaaggggacaacaccacaccacacatcataccaaaagctggtattttccccatttccaatgtttttgctgaatcaaaggatactctttaacttccatcagccctttctagaattgcatgtcattgagcttttttctttaccaacaacaaatgacactttttaagatattttccctatcaatcctctgccaaagaccattgtaagaatcaagtctccaaagccacttgactaaaagactgatattcatacacctgaggtctaacaaacccaaaccttcctgatccctaggttgacaaactgaatttcaatcaaccaggtgatattttctagtattcagaccactcagacaaagcatatttttttctcaccagatccaaatttttaatcatagttgtccgtacctcagaactacggtatcccttactgctgtatcattttatcaaaataaagtacccacatggttatctctaatcgtgtgctaaaggact

SEQ ID NO: 3270 - DNA, 1651 bp, Zea mays
  misc_feature (1)..(100): optimal_loci_56395_G1, chr2:24801482..24803132, Cluster 19
gggaagaatgaaggtcaagctttgttgcttgctacaacaaatcgaacaactcttcttcagtcatatcaacattggagccgaacaaagacatcaggacaatggttgaatcaaacaaaatgattatgagagaagaacgagaagatggtatgtaaaattgaagttagggtcgtgtgaatgagctcaagagtttctcctctctatatagaccaggctcaattttttttataatttttttaactttttgaattcaaaatttgaacgaaccaatcaaaaaacattgtatataagacataaaacagaaaacctgaattcacgtactgaccacagaacacctgaattcacgtactgacctaacaacctagcatggtaacacaaataattctaattcacaacataaataattctagttcatatcatcacattcatacctatgataagaatacagaagtgtatataagacatgccgtaagtctatacctatatatagcaagccagacaccttaaagctgactctaaaaccgccttgtgtgaataagggcatgtttggaagcacctaatttctaagaaactgatttatatgagaattgatttgattctaaacataccaatttatacctcagtttatagaaattggattctcagtttactaaaaactaagaaactgtcctcttctagctataaaatataaaaacgagtttcttaaaaactaggttggtcgttccaaacaggatctaagctatctagagattatattatagaaaccgagtagaatgggacggtcatttcttactcctgtgcatccgcgttgctgtctgaattgttctcacgtactgtctgatcgaataccgtggtggatggttcccgtcaccgtgtcaacggtttctgacccggcttgcagtcggtttgtgatcaggccatacgataagggaaggaaccagcatatatgatgggtagatagacatcaatatcatgcatcgttgtcacacacacctagattttatatattactactactcgctacgtactaccagtaccaggcgtggtggtttctgaatgcataaaacgtccagggcgatgacatctgcatgcctctcaagctagaatgtacgtaacagccatgcaaattcgtcatcgatctgcttgattatgttgcatgttcaatgggaagagcgcatgatgggtgtggctggtgcttagttgctaggtacgtacaagatgcaatcctagcataatagcaccaagcttggttttgaccacacctactacaatccattcaatcggtagattaaagtctgttgttcggactattatatctattatctataaagataaaacactataaaaacagtatagattaaagtcaagcgaacaagccggatcgagccactcccgtatacacaccatgcatggataagggatagtgttgtcattttcattctcgatagacaagctaaagcaaaggatatgtgatccaagtcatattcttcatacagtcaaagcatttcgattggtttctaggcacgcacctatatgttatatgctagctatatgcgtgcatgaatcggtacaaaccatacgagatgcgcgtggagcatattcagtcgaaaaaaggtgaaacaaccatgcttatcttatctagtactctctccat

SEQ ID NO: 3271 - DNA, 1603 bp, Zea mays
  misc_feature (1)..(100): optimal_loci_57827_G1, chr2:32940042..32941644, Cluster 19
aataaatatcttaatacttattaatatgatatataaaaactgtagcaaatcacgagcaactggctagtatcaatgagtgcacccaaaggcttttgtcagcaaggttgcaaactgactatttatgagtttcaaggaataaaatagaacaacatcctactaaaattttatgttaagacaacggcatacactgaaggttatcttaagaggccagcgcaaaccaaaactaacatccaaaatctaccactgaaactgagaacaacaactgaaccacacatgtacaagcctcggcttaaacctcaaaccactgccacatacagctagctaatccacgccagtggcatctggcaactcgatatcggggatgaaaaacaaaatgctacttgcgtctggaaaagctaactcctcccaaccttcctctcttttgtttcatcactttgcatcttcagaaaagccctagacatgttcattcgtcttgtggatggaaatatgaaacagcaccgttgcctgatctgtccttgtgtaaacctaagagataaatggacatgccaggcaaatgacctcagtaggagatctaactaatttgttttccaaaacaaacattattcgttggtttccaaaaggcctagcaatggcaacaaagcctaaccatgtaaaactgctttctggtttactgtcagctctaaccacaatcgacgcaaggcttcaaaatagacattaaccagccgaagcattaagtggcaaaaatattcatcttcctcacaagttgtcaatttattcttctcaagagttagctcagatcagctggattattactccacgtgtagtctgaaaatttctctaagttaatggttatgattagatgaaacatgtcagtatttctagtccccgacccacaaacttatgttttgaagcttaatatattgagactttacctaagctttttatcatgctgatgcatagaactccatagtaacaagatcctccatttgaacctctccaaatttaacatcacagagaattctccagattccctcggagaaaggcaaacagttcaaagcttaactattgagattggaggtgatgcaaagcgttccaataactaaccatatttacatctagcacaattgtctgggtggtgtagttggttatcacgttagtctcacacattaaaggtccccagttcgaacctgggctcagacaatgtttacccattttttttattgttcagtcatctcttttttttcacatcttataatttgtttttgttcagtcatcacctttgttcttttctttcttgttcagtcatcacttctgttcttttcttgacatctagtagtatttgtttttgttcagtcatcacctttgttcttttgtttcttttttgttcctgtactgtacagtatttatcagtcatcgtttacccaatttttttgtgttcagtcatcacttttgttgttttgttcacatctagtagtatttgtttttgttcagtcattacctttgttcttttctttctttatttttgttcagtcatcacttctgttcttttgttgacatctagtagtatttgtttttgttcggtcaccactcaccacctttgttc

SEQ ID NO: 3272 - DNA, 1963 bp, Zea mays
  misc_feature (1)..(100): optimal_loci_57856_G1, chr2:33192664..33194626, Cluster 19
ttatgccaacaaccaatctctactacaaagcatcgggttacacatgctttggtggaactcagaagttcgtttcacaatcagaatagcttaacctaaagtccaattcttatggtggctgatggtacaaagctacaaaagagaatctgtaagtacaatctcaagaagaaagcagtcctaaatgaaggtataatctcaaaaagaaaccggtccttgaagatgacatctggtctatctatgcagcagctcagaaggtgtacgacaacatatttcaatcctagggagaccatgtttaattgaaatctgagttgtcggagccacaacatcaacatttatcccaatatcatcttcctgaaagaaattacagttgcagggcactatcggcggttgcccacatatgcacatatgatttgcacgtaccgtttgcatttcttgagcatatctggtagtcatctcagtgaactttgccaaaaccttccaaattagcgatgtgtttgagcactaaaactttataataaaaataaataaagaaccaacatacataaaatatgtcaaaggaagtgcatacctcttgatattcagactcaaacgtagacaaagcagatcgtttttgcctccacgcttcgtagcttctgcttttgatcatataagggttcaacacatacaacttcacaatatagctcgcactttagaaaaaattgtcacccaaaaaaggattgattttcagtaattgataatatagtaacaaatgcctagatatggtacaactgaaaacaatatttaccatatacgtcaaaataatgggttcctgttttcagttcatttacttcacaaggttgaaaaccatcacatcttttaaagaaagcactgtgaggatcctttgcagtaacaacctagtattaatagaagcttgtagaaataaacacaaagaaaaacaaaaagaggcaaaaggcactaatttgtatactcattgagttattttgttcaaatagatgcacaggaaagcttagaaagaacatccccgcagaacttttctcagtaatggttctctgaccaaatcagagcagcatgcaaaataaaagtgatggggccggatcaaaatagatcgatcctatttatatacatgcaagtgacattatcgtgtaaagaggttaacagttactgcagcagtaactttgagtccagagcaattagcaaacaagtagcaagatggtagaatgcaattgaaaagcatgggagatcgatagcatctatgaagtttgtatgatagatgattatctgagtatgatctatgaagacttctgtatgaaagatgatcatctgattatgtcaggcttcaactgatgtgttacaagtatctatggaataatttgatcacagagaaattcctggcagaaaatttcttcagttattttaacctggactccaactacttgttatcaaatgatgtcaaggggtacattagctcactgaggttcgatgcgaaggtgatatttctcacctttaaacttttcagttcttctttataatgatagttgctttctggaataatacatggagccaaaatttattttgccttataggaaacaatatctttctaagaaagaattgatatgaatgcaataacagaacaatcagcagggtatttgtttagcaaggactaaaaagttcaccaaagaaccaaaaaagaagacgtgcgagattgtttgtaatctcacaatcactcaaaactaacggtaagttgaagctattggttatccaaggaatcaattatgatgatttttaaaaggcttcttgatgtactttctaacaccatccagatcaaaataaaacacaattacatactgacgcgccatccgagagaggagagtaacccgagacatctcaccagcacttttagtcaagtttgactaatcaaacaacaacaaaataccaggaaagtaaagcacaaacccatttggcaagt

SEQ ID NO: 3273 - DNA, 1553 bp, Zea mays
  misc_feature (1)..(100): optimal_loci_58368_G1, chr2:36818192..36819744, Cluster 19
agtaccgtaccggacttgtttccttctttaaccttttccgtgagcaaccatccgttgtggcttagcttctttaacagcttcagaagatatttagagctagtttttcaaacaagttaaaactaaacagctcttcaaacaaatctcttaaaatttgaatatcacagagctaaaaatgttagcttttcctaactctatcttcaaaatctatctatgaaaaaactgttttactaaatattttttaaaacacacaaaaaaaacaggtaagctccggtgaccactagacaagtcagctatgttccttttcaagtgttctagtttttcgttggcttaatgcggaagccatgttctaaaactggtaggccgagttcgtggcacggtgatctttgtgcgatcggtgtgttccaacacactggatgtggaaatagatttgcgtcaacgtcgctctaatggccttgatcatacggatggcttaattggtacgtgtgttgcctcctcgataattccggctggatgctcccatgaggattgagtactcatcaattcaacatatagatagctgcaaattcaattcaaaacgaaaatgatgagaaacggtacagcgatgatgcaatagcgatgatgcaatgtgtgagacggtgatgaagacgatggtccacatcactggtgtcgtggatcggatgctccggttgtgtgctcttcaatttaatatggatagctgcaaatttaatctaaaagaaaatttttaagaaatagtacaaaaataatgcaacgtgtgagatgacgatgatttgcatcactagtgtcgtccacgcaagttacacgactataagtgattaaggagcaaatgaaaccaaggcaaatctaatcaataccagggttcaaaattttggtgaaatttcacaaattttggtaatttcaggggtggtcaaaagatcccccaccccctgaagttccataatgcactaatacatatgctatataactcaataattcacttttttatatttttatgttttatatccttctactcaataaatatgtagtcataaatcatgatatagttttgtttggatctatttttaaaataacagacttcatgtttttaagtttgttaaaaaaatacaatgaaattcaaccaagttttagtgattttagaatggttgaaaaaaaataatactaaaatgcaaaaccctaacccagaactattttaattggccagtcttctttgttagggatgctggttgatttggtccagctttatgaaccagattccccgctaaaatctggaatgtcaaccaaacgagtataaccacagaatatattcctaaaaatctatatattcctctagttcaattcagaatcatctcttaccccatattttctaggtttctgccgttcacgttaataaactatcatgcttatataatttacaatttagaattgttttaaccaaacatattttatttttctcatcatcatcatcgtcagctcgtagcagatttctcacagctcagttaatctattaacagagctgggcatgttaagacaaccgc

SEQ ID NO: 3274 - DNA, 2711 bp, Zea mays
  misc_feature (1)..(100): optimal_loci_60339_G1, chr2:48094398..48097108, Cluster 19
gagctacgaacagatctgcactcccaccatgtctgtgtcaacatttttttccatccgcacgatctgagatccgatgtcgcatgaccactcttgaaaagttcatgctttctaaaaaaatagcatggtaattattataatatacaactaggagcatatttgtactcttgcatgtatgcgtcaactttttttcatccgcattatctgagatccgatgtcgcagaacaactcttgaaaaaacaatgcatttttgaatagcatggtaattgtttttcacaatacaacaaccataacccaaaatagtgtattaaaatatttaaaactgctagtcttaactaactctgggcatattttgtgggcctgcctcttattagaaccttactatcaatagtaattcttattaaggttttggtatgtgcaattttatataaaacaaagtcaacattcctttttccagcttacacttgcagtgtttccaaacagacaaaatgatgatgcatcagaagagagcctccattctatcctactgttactaccggccgaaaggcctacatcaaatggacatggccccatatatggttttgtttcataagcaagtaaccgattgatgagcacatcatgttaacctcaatggtatgctctcccctcccttctggttgcggtcactagcccgtctatttcaccgtctatgtctttattgcattattatgtatatcaacttctagttttgataatgtctatttgttcatcccttgatggtagacattgccttgacgaaatgcatgtggtagacattgttcatacggtcgattctgtcccatatttgatagtgtttatttgttcatcccttgatggtgtaggtcattataatactccaatattcttttattttttaggagcaggaagggccaaagtcctataatactttgatctgactatttgtagctgcaattaaattgttttagcacacaattagatacgatgaaacttatatttatttaggtgatgacccaattagatatgacgccaagactctacatatattattgttttgtagctaggttttttagataatggaaacaaagaaaaattccagccttttgcagtctcctacatacagccttatatattctaataaaaacacacgtcataaaaagggacatccttagaaggaaacaggccataaaaaggaacatccttagctaggtacaatgcatgtatatatagttagcatttacatcatgctatctgcttcctgaagacaaagatagcatatcattgcatcacacataactttgaactggtaccaaaattgtatttatatcatcatatcaactttgaactagtacaatgcatgtatatcaatgttgtgttacctcaataccttcatatataacattcttcttttttatatacattgtaatatgatgataaaaaatgttgcgtgtggggcgcgagattatgtccatacctttatttcccaaacctcagtgtcatcttcttaggcatgtaagacacataaagagaacacaatgttggggtggtcgatgtcaactcatatatgaaaaaagacaaagcaacctatgttatccttaaacttctcatgtcctccatgctcttctatcctaaatgcagcatggagaccagccatcctgacaatgtggcattactttcagttctaacatcatctgcacatatgaatgcattagaattaggatggtgggtgcatatatttctgggtaggcagggttcagtggtgtgtttccagtatacagagaagattacctgacttgaaggaaacttattttggaaattgaattgcatgaccttggattataagttgtttatatgttttgacatatggaggtggagaacatagcgccaaataatatcagttttgttgtaattttttcaatatatacttatgttagactaacttatttgggttgttggtatttcggtatcatggtgtcttagtagttagtacaaaattaagctgcatatattcaacattatgaatgcatggttcgtgtactttctgtgccacttcgattttaccaacacattgtgctttatgttctacaattttcatgtcatgcattttatttttacatagtagccaatcactgctatccttttgaaactatttaagttgctattgaatgttgtcaatatctacctataatagactatttgatctaggttgtcagtatccacttacgatacactatctgatctgggttctttcatagcatcagactacataccaacaaaagattgaaccaaaccaaactaaatcacagatacaaaatttcacaaattctatcttatgatagacgctattttctaagatttctataaggatagcgtatttgataacattgcaatcagtcaataaaggaaacatatatgataagtatttttctcttttagtttctgctaattaacacatttgtattacaacttcaaatccctctcatcaactatcacgcgaccagatatccttgatttttatatatctttttaaaattgtaaagctacacaaaatcttaaataactttgtaatcatatctactgctacatactaaatatattggtatttattatccagtatttatactctttttgagcaatgtgaaacctattaagccactagctatttcatatttaccctctgtcttttacccttttagtgttttccccctatctttgtt

SEQ ID NO: 3275 - DNA, 1449 bp, Zea mays
  misc_feature (1)..(100): optimal_loci_6793_G1, chr1:34924017..34925465, Cluster 19
aggacacactattgtagatgatattgtttataaagtaaagtttgaaataaaggatgagatagagaattaaatagaggatagatggcctcatggttcaagacttgaagccataggcagctctcatttttttgttgtctattttgctggcccaatggagagtgatggagagtggccacgctgcgcatgcggagaggctcacgttaattgttggtgtggccgcgatggcgtggggaatggacgcgattattctcgcttaaatatagtagagatttttagcaatttgtgtgttggcctgtaaaaaacagaaacttgaagcatttctcttcgtatgcttaaaataaaaatgttgcttttagttatcttcgcatgttctatttgtcacttctcatatccagtttggcagagcagctttaaggctatgtctaacagaagctctgtcaaacagtttttactaagttttgttttgctgatttcctgaaataaactaggaagccaggagctgaaaatataccttctctagatttgctccatgcttagagtcactgtatgcataaagtttattctaaagaatcaattttagtcataaaatcacttctcgcaaagcatgagatcatccataggaaatctagaacacaaggagctatagctctaccaaattactgacccttgcctaccaaacaattatatgctctttatacaacttcatttgcctgtgttgtcgtcaagccatgtatccacaaaatatatattattgtggatatatatgtcctctaagcaacaatatactcacggcactgctgttaaatatgttgtaggcacctagaggacattgttgccatttccatcccaccggacacagggtctcgtccaatcttatggtggatacgcccatggccataggcagtagcgcctatcggttatttggagggggtgataatcgatcagataccggccctaaaggttccttacatatataggtaaagcatggtaggacaactatctagttaacatgtcccatcaaagttagacaagagtctattttactgtggtgtagctttatcttgagacttgatacaactttttaaaatttggtctcccatatatcaatatgatggttgttaaattgtgcgagcgatgtgcttgttgtttatctcgagttggtatgggacacacatcagaaaaattaccaggatcgtttcatttaaggcgtgctggtcagaggacggtgatccggtttgatgagcatattttagatgattccgtactagaggagattttcagagtgctactaaatatttagggcatgttcggtttatacctaatccatatagatttgagacaggattgagtgagattaaatcctaaataaattataatctttttattttttaatctcattcaacccatctagattaggaatagcccaagaagaccttaggaggattattt

SEQ ID NO: 3276 - DNA, 1960 bp, Zea mays
  misc_feature (1)..(100): optimal_loci_77581_G1, chr2:156926887..156928846, Cluster 19
aattccaaattggatttctacttgtggtatatctaaacagatgccattatatttttgtctcaattagtatatgtgcatgctttctttatgaattatatagaattaacttccttgttcttaaaatccctattatgcatatacattatcatacactatatgtgtgcatacacttaggggagattatctatgcatatacaactaggactaggatgcctttttggccaaaccccaaccgggctcacactaccattatggccgaagagttccgcaaagaagtattagaccgtagagagaataaacatataaatagagatataattttctagaaatgataataaattagatgaaaataggaagtgcttattactttagcccatgagactatatattgtaacagatacacttataagtaaagaaggaagtctttcgttcaccaagcagcgggtggttctcatccctcgatgcatcaccataccttccccaagggttttccaaggtaagcgcaatgttgtcctgatgtggtctctgatcttgttagggcggcatggtgcaccaccttaccccagtagttctttatcaaggatttttcgatagttagactgtatgaggttgcttgcacgatctaataactaaaagtaatgacatagaatgcataatatttatattggtttgggctcttatgcgagataataccatacgtccagtttgctagtagctatgcttatgattgtgatgcttctatccccttgagcggcctcgtccctcctttttatagttgatgagggattccattacagggaaatggagcctttcccattacataataagacccttatctaagttacaggaactttctatccttttctctacatgataactcccttatatgttgtgttactgtttacaacaatgatacacaaatatcatagtcttatggatatgcaaattccattctaatataagatcatagccttcctaatgtccagtcaaaatctaaatccgagaaggattctaagtcatagacatggtctaagttgggcacacaaaccaacctttcagagatcaacatgctcaggatacccgtacactacagaaaacgtcaaagaaatttcgatcaaaatagaaacatccgtcataataagaatgtcggctcggtagaaccaacacacttaacataagtatgtcagccctttatgtacatcaacattagtacatcgggtaagtacgttggttagccgacgtactcaccctaagtatgtcagcctattagacgaagtgtgttggttcctggccaacgttctataaatgttttcctataattctgacatatattttctatagtagccaacaactcaacatggccgagttatctcctcgagcaagtagagttcaaacatgttttcgttatttctggtgctaagttattcacactggattaggcctctaagtccaaatacttagttggtttactgttcataattcggttagaaggcattagtctgactcccgaaagttgcatgccactttaggttctggtcatcactttgaaacacctcaagggttataaatatacataccatcgacttctagggttacgtgaccatatttcaccttttacattctcactgtcatctcaaacttctaagatatcatccttttctttacaacgccctagcccaagctttttcgtacgcattacaatggctgcctcacatcctcacgaatttgagaagtcatcaatcataatagaagatttggaagccttgatggtaatgaagcttcttcccaaaacggacatcacccaacagaaattattaggtaagaatgaatcttttcccatgccagaaggtgacagattcatggtctttcaacaacatttccttcacaggttgggaatctcgactttggcctttttgagaggtttgctagaatattataagataggttggtccatttgaac

SEQ ID NO: 3277 - DNA, 2466 bp, Zea mays
  misc_feature (1)..(100): optimal_loci_77595_G1, chr2:156968538..156971003, Cluster 19
cgccgcctgtaccacctccaacccgtacgctgccaccagctgtgggctcgacaccctcgaccctatgaggggatcattggtggaagcatgattgatgagggagggatgatccaaataagatagactattggatttgagtgagtaagagaaagaagagatttagactgatctcgtcccttggtttcaaagggaggatggttctaggtgcatttgtttgggtgactattgcaatgtttgaagtggtgctctatataggggtatagataaatgaaataaggagactacaatttaaattctcatattaattttctctatcaacttgattatcatacccttttctatatagttatcaaacacacatatagtcatctccatggtgttttagttatccttgtgttttagcttaaaattcttagcatagctttgacccaataaatgtagcaagtcaaaagtcttgatttgagcttacttgatgaagttggttcggctgtttctagatggattgtgttgtggtaacacactagggtatgcaaggtaccacaaaaatgattgctcgggggagtaggagagtgagtcctaatgctacagagtatgcctaccaggtcatgacatcacgagtataatgacatagaaactgttatagaggtttggagcatcaagtgtgtaacatcctatgttctctttcttgtggtggatttctgtacacaaggagtgtacaagattacaagtcataaactataggcacaaaaaacatccacaaaaaactgtgggctaagggaagctaaacctggtcttctttttgttgtgggttgctttcaaggttcgtgtcgtgtgtttggtcgtgtgaacctgaaattgaatgttattccaccaccccttttattgttcaatagcgtgatagtattataagtatactctttttctaacctcggtctgtcataaggccaactacacatgtcatattacaaactttacatggtatatcttacggtggatgtgctaccatttaatcattttgctctactcctggagcattaattaccttcataccatctattaccttcacagtcctcggtacaatcctatgctagctaggaggatcctcctaatctttgaataggcaaggtctcatatctaagtgttgcaatatatgttagtttattcacgcgcggctgctccgtgcctaccccacatgtcagggcggtggcgtccatgtatcactttatttaatgcattggtgtctaagttgtcactttgtatgataacccaccacatcgctctccgaggtaggcattaaattatatgccatgaacctttgtgatgcattcacattgtgagcacatgataggctaccgacgttgctccctctacttcattgtacctcctagtactgtggccacatatcattggggttacatgactatcgtgtgccctacttagattccttaagagttcttcaagctatgagttacctttgtttatcttgctagccttgtaatgttgtccatcaaacatttaatgtgatgtaccttagacattcattaagtcattgttctacaacatatctctaaatctcactagcatgggcccacatcctggtgtcatacagtccatagtgggcctcttgccatcttttggcctcatagtacccccaaagtggttactaagtccatatttcttagggaagggccctttagacccagggtgtccatatgagggtcttaagggcttattctattaagtgctctaggatgctaggggctttatggaattgtaccactatatgccctaaggtgtgagggtccccgagatcttagtgttgggtgccttagtgtgcgagaggccctgagggttcatattattaggttccccaaggcgtgaggggtctcaaagtctttactattaggtgccccaaggcgtgaggggctccaatggcttgtatgatcaggtgtcctggggcataagagggcctagaggcttatactattaggtgccctagggtgcgatgtaacacccctagtgttaagcatgctcatacatttcatatgcatcatgaaagaatcatcataagcatcattaatcattcactacttacatcagaatcttgaattgttactatttgttggaagagaattcatgtttgaactaataggaagcctatgttctataatagtaggttatcaatgagtgcttgtgtgtataagtaaacccacttaaagaatttaggttggttatggttactcttcaactcttgatttcatgtggtgatggtttcttaaactatatgtaattgaaaggcttcgtgaatgttggacataatgagttaaaatgttaccaaaagccaaaaacctaaggagtaagtatttaactcctaaagctactaaatataaggactcaaatttcaaaaggaatatgaagtgtaaccctaatgaaggtttgagatatggaataaaagaaatgggaaaa

SEQ ID NO: 3278 - DNA, 3731 bp, Zea mays
  misc_feature (1)..(100): optimal_loci_8053_G1, chr1:41872342..41876072, Cluster 19
atgttcattttatacagactcgatctccttgacactttgtttttctctccacatatatgttgtttaagtcatgggggacacttaaaagtggctgtgataagttttttacaagatttagttcaaaatatgaaaaaaattgttttaaaatttgaaaaagatattctaattaaattttagaaaatactctatggcttaaggagactaagatataaaacatatatcttatataactctaatttaataagttatcttatataactctaatttaatagtgaaatctgtctatccataaagtaaaatgaacttgtccatgtacatgaagcaaaataattaagttcatatataaaatgatggtagaaagtcaggggtgtaatgacatatggtcggagggctcctagcggtggcatgaggcagatactaggtggcggcggcgctgagagttcctttcgaacttccttcgctcttgtatgtgagagatagtaaggatatggatgaccttttaaatgatagagaatacaagaataaaattaaaatagataaaataaggttgaagtactatttagaaaaggttcatactaagtactatattagataagttaaaactattagtattactagaaaaacaggtgatacgaatgttataatagcaaaaactttgctcttatggcgcacaaaagaggacgacgaggaaaaaagaactttacatctaactttatgttcttatacagtgcaatggatggaattaaagcactttacatcgaaaatcgtagaaagagagaaaatagcctcttatattcttaaccctcttttaaagtacactagtgcaacgccagtgcgctgcgacgacacatacattatagaatacttaaatatttcaatctacaacttgctaatgtgcaaaaacatcacaacatcattacaataatattgggactgtgacagtgacaatgagcacaaacataagaagtttagcggaacacatattttaatatcacatcatgatatgggaactgcggccatagcaaacaaaagtattacaagcctacttgagatcaataatcagcaagaactatataagaaactatgcatataacaaaacagtagaaacagactggttgagatatgacaaaagacgtcgttccaagagatctagagtgatttataaagtggccatcaaatgatcgtgcaaaaagtccaatagcatggttaaccatgctcatttgaagaaacagtgcatttttcatctcctcatcatggctcatcaacgaccacactttgaatatgtgttgtcaaatacgttgaattagatttggtgctacaaaatcacaagtaaaagatctaggcaacaggtactcacatatatgaggtaggtcctagttgatattataaaaataattgtgcttagggccatataactcccagaagcaacatcgattgatataatcctctttgctttcaaactatttggtgacttggatgatttggtcccttcaaacaacatcacaattgaagtgcttaggtattaaaaaggcatattgtaaggagtattccctctacttcaatttgtaaattgttccaacttttctaggtatatatataacttttaccatgtatctagacataacgtaatctacgcacatatcaaaagctatgtccctagaaaaactagaatgatttatgagtttggaccagggagagtgtaacatatattgaaaagttaaaaagctaaggctacaacaacactatgaagctacaaactcacagtagttataagcaacaatcatcaccattgtaaaacatgataactccactctccagtttagtaaaataagacaaacaatgagctttaatagataaatagacttagtaaaatcaaagacttaaaagaatttatggtggaaagaaaaatgaatttctactaataatatggagtgtagatgaaataacataagcatgtaatagattaacatattagccccaaacaacaagcagggcatctcatgggacaagaattgttaatgaccaagcacaacttactatgcatcatttcatcattagacaaatttcaagactaatttgaacaacgtcagaaagggacaacaaaccatgctcaactaaaacaagataatattcacttttggtgctataagtggcatcaacgactgaaattccaatattgctttcacggatagactcaccatccaagaattcatacctaaccattacacaatgatgcccaaacatgtttctgagattgtttatgacatgtcaattgcgctctgaaataatgaactaaaaatgcaactcaataataagcaaacaatttacaaaaagatatctcagatgcatggaattaatagacatagaacatatgacatagctctcaagacaagctcgatttaatatcccaacgtctttagttcgtttctaagaagtttaacattttttcttctctggaaaagaattagcattgatgtgaacttctactttactcatatcacgctttcattctaattagatgcaatatatattttcttttaactaaaatcattccacaagatgactgatcaatgcacagaattaaccaacttgctgactggattcagatttagaaaaaggaattggtccaggtgttaacaacacatttcgcccttaccgatcaatgattttgcagaggtattcttgttgatcatctcgtagcaagacatcgataaaatctgttggttgaagaaaatggtgcatggtgacattattggttatgggatcatgtcaaagagacaagaacaaacttgtttatccggtgttagccttgtttgcttttgctctttacttttgctcattttgatttgcaaaaggtaatagaaatttgtttgtgcccattctactaatgacaaccttttaaattggagaatggaaaaggtgtagttgctgagttgcaacaagggatggctatcataatgatatacaaaaatcacttgcccgccccagttatgtcagcacctttgaaagaagtgtttcttgtggcaagtgccccttctaagttggcatttgataagtttgcctgtaaaacaaaatgaggcgaaactaatcacagctcacgagtgtgttgaaagaacaaatcaccatgctgatagtgtgacatatatgcacatgtagttgaatcagtgggggaaagcgtgaagggaacaatgagaggagcatgaacgaaatgggcccagtatataaatgtctgatttaacaatggctaaacgttttggatgagaatgaggatgaggtccttgttaggcattttcaacaaaatagagtatagacacgtgcacaagcatgcttgaattgaatcttgatgaaaccaaccaaaatcatgcgcaaccctagacattttacctttattaaatttgctagtgagaaattagggtcagagagatcagcgcctgaatttgtcggacaacaaacatatccaataagccgcgcaaccaaaaccaaattaggaacttcccaaagataaagaacaagagactggaatcatcgaagatggagcaacaagaaaattcagtacttgtgaggtttgcatcgaagaagctcgcgccaagcaggtttgtgcctttgaagttcgtctgcctcagtataaactgcaccatcaagaaggtcaagattcaacgagcatgagcaagcaataccctggcaaatggcatgccttggaagatttgatgcggttagagatagggttcttt

SEQ ID NO: 3279 - DNA, 1768 bp, Zea mays
  misc_feature (1)..(100): optimal_loci_8076_G1, chr1:42028392..42030159, Cluster 19
tccattccatccatgagattgcttccgtagcccagaggttttcttaaatatctcctcaaataaaatgtgtctttatttgctaattcatttccactgatgtaccaggattttatataaaaatgtagtggaattagtaaatagtgtaatgaatatattcaacaatctacattgtaggttggtgactacaaaattgtcttttttactaatttcgccactattcctctggtctcatgtatccttccatatttttactcaagtctacagagaacttagagcctattcagttgtctgaaaatattgcaatctagatagtgaatgagaatctaaatctataaataatagtttggattttataatttaggttgtctgatctcttgaacacaagagctagattgttgttggttaggtttaagggagatcatgaacctattaacctagttattgtactattatattctctagcaatttgaaatgtttggatcacctacatatttgtatctagtttctatgatccttagatgatcctaaaagaatgttgataatgtttaaaaaagatggatgtgcaaaatctataaggtaaaaacacttctgcgtgtctgacaaaacaaacttgggtaagccaagttctataagttttggtacggaaatcaatttgaaatgcaattaggctctattaggttctatctaaaatcaaactttgtaaaggtgttcttagtgcccaacaacttgtttacacaagtactgcactcacaaacaaaacacaccaagtacaccaaggtggaagcaaatcattccctactaacaccaaattctagcattcggtgcacaaataatatatcatccacacatcacatatggcacaaaacatgctgcttggactaatctaaactcatatgcctcaagcgttactgatttttacaatgtgtgatacatcgaattcattgttggttgcaaacacgcatcgcatcataaataagacataaggaacttagatcaactagctagggtagaatgtgtgatcatgcttcatgtatccaactacacaaaaaaatcttcttataataatgaaaacctttctaattcttcttagattgaatctctctcactcttttttaaaaatattggacatgacactaaatcgttaataaatgaagtacatgtgagcaatactatcataccaaagacatcaagtaacaaaggtataagaggaaagattgttatggtaataggaagcgagtcctggtatcatagagtatgtctaccaggtaatgattacgaccctaatatgtctggaagtgcataataccctacgttctctcatggctaatggatttggtgtactagggtatgtacaagattacaaacctctaaccaaaggggaaattttattttaaagagaagagtaaattaaggcaacctaaactaacttctgttattgttgtgttggatagattgctttcaagtctattggcttgagtttggtcttataaacctaaattgaatattgttctaccatcctgttttgtagttgaaataggtgatagtattacaatatatgcttcctatggccccaacatgccatagagccaactccccacatattgtcataggattatgtgccatgtcctatggtagacgtgttctaatgtaatcacattgttctagacttggtgtattaatgactcctcatgcctttcaatacaagcacaattatatgtaccatcatgtgctgcaacaaaaatcctaccaatctttggataggtgggat

SEQ ID NO: 3280 - DNA, 1625 bp, Zea mays
  misc_feature (1)..(100): optimal_loci_81594_G1, chr2:179822301..179823925, Cluster 19
aacattgatgtgtactcttaagatttggaaaccccattggaactcatcttcacactttttagctgcataaaaaaactgtttggaaacccattagaagtggtcttcatactttctagctgcaaaaaagaactatctgatgacactggcagcactagccttgctccatgtttgcctttctaagggctagtttggaaactcagatctcaaggggttttcctaaacggatgatcaaggtacaatcctttgcatattatgagaacaagatatgatgttctgacaagtaattcagtagtggaacttgttgaattcttgattgatctagctaggggataacaaaagctacagacgatgacttgactagcactagtatattcctcgatccatcgagcatttggttcttctataatatggggcttgcgatggtcattgtcgctctttgccaataggattccatgtaacttcggtgttacttggggtgcttaggctgttcggtttcagaacatctttaaccatattagaaaaattaagtactaacaacatgatttttgtccctttttctttgtatctgtaagttgtcatgacttgcatccatggctggccatcttaggagcactagcttgcatataaaaacttcaaagaagaatatgtattatcagctctatctttaattttattaaaggatcaaatcagatgaccaaagggattaagagctaaaaaaattcttatgctcagacaatattggtttatctttcaatgctatgcctaaccctccaaaactccaaaagacaggagagagatgtgtaagcgaggtgatgagcgaagaacacattgaagtgttcaaatcgacaagaaatgtgtttgcgaggaaaaccttacaaaattgaaaaattaagcactttaatggatataaagagatcgttaaaaaaaacaaatcaatccactagtgattgcatgttttgaaaatgttttttgagatcaaatacgggcccaatgaaacaaaccgatcgcaaaacagacaccgaaaagtctaaaacttcccaaaaacaataccacacatttaggctttttttagcagaccaaataaaaaaaattctaaaacgccaatcgatctgaacgtactctggttgagctaaaaattttgcaaacaccttcataatgtagttttaaagatgtccataaaatttgagatcaaaagatttaaacttaaaagatagatcaaagaacacaaattcaaatcgaggttttctcaaaatggctcaagggattggaaattcatgctacaagtggatcagcctatatcacttagtggtaatgatcttaaaaagtcctagcatgtttctatccagcccaaatgatctcaagaacttagattcataaaatcccacaaaagatcaaaacgaagagctaagaaaaaaactcaaagagaatttcaagcaaatgattttatgttgagatttaccatagagatcacaacatggttaaggccacgcttcttgattctcagaaacatagatgtaacaagtccaaagtacataaggatcttctaacaaaagaaactagcaagaaaattgcaaaatagaaagctagagagatagttagagagataattagttggtgcaaccttg

SEQ ID NO: 3281 - DNA, 1464 bp, Zea mays
  misc_feature (1)..(100): optimal_loci_83890_G1, chr2:192441127..192442590, Cluster 19
tatttcacaaacgaatcaaaaaaaatgaaaaaatagtagatgttggagaaacttatttcttaaactaaacgcacctaaagttattccactattttttttaaaaaaataaactcatggtgtatcatcattccatctaagttggttagttcttcaaacaaaggcttcaaaaatcggcaaaggcttctcatgggtcgggccatctgaatcctgaatcgaaatttgataaaaaaaaggctctggtgctggactggaccagcacttacattctagtacatgggccgtggtcagacaccggtcagctgcgaggtgcgcatgtttcaagaaaaccgatgtagcacaactagtcacaggtacggccgtatgagcacgacacgacactacttcgaggtcaagaatctgtaccattcgaatcgcaatcctgttgtgagctgctgccacgttgaattccaaacctgcagtagccaactccaacagccagcggtgatcttccacattctcatctcaacctcaactaggattgtttgcaccgcgaaccattaagcatgtatttggtttgtgactaactgtgtcacattttaaagttagtcgtttaaatggaagcactaattttagatagaaaaagttagataaacgtaacaaattaggcagcgaaataaacggaccctaaaagctaagtgacaagcactccaatccactattaatccaccaaacgctatcttttaccttgttgaaaagtgagaactcaagttgtccctggctccctgtttagtctctctccaacaatatccttaaggccccgttcgtttctctcggaatgactctagaatttttcaggttgattaaaacttacgtaaattagaacaataataaagcttggaattgtttcagttcaccgttccgagagaaccgaaagcctcctaatatgtccccaaaccatgtctcctaaccttacatgttcgagtaaacagtgttgaccgaacggctctaacaatccaccctatccgttgtccgaacatggggacgtatggatttctccggacgcatccagggacattccttccccggatccactatttgcaggtaagtataaagtattctattgcaacctggacaaaattgttttatgctcacaaattaatttgtaatgaaaaagaagagttagttgatataggggaattgtcgggatgttggagaaatcttttaggggaggtatggaaatatagtataaaatacatttatgtgttgtttggttcacaaaatgtgacgtaaatgacaacgataataattcacactttagtatcagcggtaataagtttgaataagttgatatcattttttagcatagtgttcgattacatctggacttaaacaaacatagattaatgttatcaattatttatcatgttataaatatgtgaaacaaacaacaacttagagggagatggatataggtgttgttagggg

SEQ ID NO: 3282 - DNA, 2716 bp, Zea mays
  misc_feature (1)..(100): optimal_loci_89229_G1, chr2:222972447..222975162, Cluster 19
atcggttaggataacaggcaatcagaatcagttaggataacaaattagtaagtgaataataatgtacataaacatatatattgagaaaagaccacatatattgaacacatgcacaagacatcaatttgaaccggtttatcacaatttaaggtctttgtgagttgttaacttggtatactatacaattttggcttgttatattgaatctgcattacaaaacttaagcacgatatctttccaaggtgtcgtttggtaggcatgggattttagctttggataatgtgcccattatcttatattatcaaggtgtagttggatactcagatttttgtctagaatctagatacaaaatgagacatgtttggcatattatgattttttgtgctagattctaagaatctcaacaaaccaaataggccccaagtagcatagcatgatagaagttgatttcatatgattatgaagtaggacctcgggcaataaaccagctagtcagctactgactttgatgttaagattttaagttgttataatgtcaaagatgttatgtaacttgtaacagctttgaaaaattatattttaaatttacatgttaacaatattgtattataacagccctgggagtgacaaattttataaaagacatagtaccatgtcaattatcgaattcatacatgttaagaatataaagatgttgtaatagtcgttatcctctcagaggtattataccatatataacagattttgaactttgatcttaacatgtatgatcagacatgctttgtaaattgtttaatgacaaatctaatcatacataataagtatgacagttatgagtatgataaattttagtttttttctttttcatgcaaatttggtatagctacaaaccatttgccagccatgcaaataaaaaaataatagctacatatatgatattgtccctgcatacatgtcgggcatgaggagtaccttcataattttaggagttgtggttaaatcatgttttgacattgaatagatttattgataagaaacatcaatattaacaactaatgtatgcatgacaatagaggtggtgatccaattacacccatcaccagaataaacgtttcttgtgcacaatgtttcacatatttcctcataccatattttctatgttcctaataattgttctatattgtagaaacttttagtttacttctcagcctacatatgtagaacacagatgcagataccgtatacgatggtgagctgaagtctttctctcttttttgagttagttaaatgtgcatcatatatattattcacagatgcagataccgtatatgttggtgagctgaagtctttctatctttttttagttagttaaatgtgcattatatatattattcgttttgagttagtataaactgatttctttctagcttccaggcaacgacgatggcgtactttatagtaattaatttagtcaacatcaccagtccgtatctgatctagtaatctgctgttcaggtgagaatccctttttgtcccttttcttcacagtgaaaaaatggtattgtaagtgcccgttctaaaaaataaagaggaactaacctgttttttcgtatgaagctataactctttaggatggatctggcgctgcgatgtcacattcagtaaaagtttcggagaagatgaaggttgtagggaggaggagaatggctcataccttttcgaagcatcaacccaggtcgcccagcccagccctcgcgcgtactgaagcatccgaatcaacgtccctcgcagtctccgtcttgctccgcggttggcaccagcaccgcaacgaagaggcacctgaagacgctgacactgctgtgcgcggagggggcgaggagccgaggagtgacatcgtgagagtcatgggcggggcccacccgaacgcgacgagggacggggagggcacggacgacgaagcatagccggagctggaggaggtgacccaacaccagatcccgagaatggggcggaggagcctgcgagcggcggcggggcagcgggcaagacggtggtggcaatggcaggctgaggcggagcgtgagagccagcgggagcgccatagagaacatgacggcggtgaggcggcagcaggagcatgcggacggcgggacggggtggaacggtggagatttgacacgatcccctcagtgctctccggaagattcccgtgcactcgtggagatttggaagcggacgttgctggattttggtttcatgcgttctgtggccgttgacgccggatcgtgcggctgatattgaaattactgacgtggacaccaccagagagcccgtttcttaccggctttgtaatataggaaatgtcatgtcatgacttattagtcctcgtgcaacgctccttcctctcggcatgctagctgtgcgtgtacgttacattctttcttacattgtactgtacatttttattcgcatgctgcagaattggaattgcagacagatacagacgactgatcgtctattcgtctgtctgtctctgatggtgtcatcgtgtgtgtgtgtgtgtgtaaggaggacctgccgcctgcgtccgcgcgcttggacatgaatattgcattggtttgtttggacttgcatgggaacaaattaaaattccctcctgaatgcgtcacagactcagtgtcgcatacaatacactagcgacgacgccaccgatggg

SEQ ID NO: 3283 - DNA, 1592 bp, Zea mays
  misc_feature (1)..(100): optimal_loci_93801_G1, chr3:8560261..8561852, Cluster 19
gtttccgatggcaaaggtaaagagatctacaaagtgcataatttgattgtccaagtgtgaaacaaaggtgtgacttcacaatttgctcagacataggaatctttaagtttccggatcaggatctagcataaaatgaaaatggaacacatctctcacgagctacattggtaaatcccctttcaggtttgttcgaaatagaggaaaatatatagattttgtttcatttagggatgctgacaggctatcaaggagacattctactaaaagtacatgtccttgtgaaaatcaacaggtccaaccatcttaaccatgccacagaaatgtcaactattagtgacctgataaatgcagtaaaacatcaattggtagagtttgagcatgatagcttttatgaatgttcaataaatagatactcatagagaaaagaaaactggacgcttagtagagtgacttgctgatcatatgtttatttgttagcatacaagcaaaatggacaatcgaggttgtagcctagtcacactagaccttaatgtttagtaaacataattaaaaatcaatttgttgccaaaccagaatgacctgggcaactccggttgatagatactcgtaccttttatgaaacagctgtaccatacagtagaagttggtgttttttttggtgaaaattggcatgatattgctaaaattgtggatttttggagttttagaaactcaactttagacaacatttcccctaaaacatggatttgcacatatctagattctaaaattacaattttctaatatcgcaacattaaaaaaggcccttagttttcaatgtgcctcaattcatgttagatgattttacaaggattttgctgtctattgtttcctcttttcttttttggctcgagatcgtaaaaatgaactaaaaagaagacagtccatatggaattatgtacactgggaactggctgagcctgctgttaatatcataaatttgagggatcgcatggtaaactacttctctttgattatatatctgttccaattttcaatatatctggctccactcagtccagtcaatgttcttttcatggggatgtattggctcagactctggagattattgtagaaacaagaagctcaccaagagattcttgtggtatgtcaatccttagagatggtggcaatggagatccttgcaaaacatggttagagttctaatgccagattaaaggacgcttgattcgagaacaagttcttgtcaaggatgttattttttttaatgatgcatgttttattaattttcaatctgtaatgtcgtatgtaggaaactacaaaaggctgaaacattttttgttttcattataaaaaaaacatacttttcctggatgagtggagcctgacgagatgtgaatgagtggtttttggacccctttgtttctcttattcttttccatttcttcagcttgctcatatcagtcttgtagtatatctattgtgctcccctgctccttgagattcaaactagtgcgaggcgcgcgcgtgttttatatatatatataccagtagcacaatagcaatagtaatacaaatttagattacaataa

SEQ ID NO: 3284 - DNA, 1687 bp, Zea mays
  misc_feature (1)..(100): optimal_loci_94571_G1, chr3:12609913..12611599, Cluster 19
ccctaggatcacctgtgtagcatgagaactttgtttaccccacaagctaggaccatcaaggagtacatgtaaccaatacaaccaaagaaacggatggatctcggcgagtcgacagaaaagaaaaagaacagtacagagcagaacaaaccaccgtccatacctttgcaggacgaactgtaccatgacctaactagaaacagtaaagaaaccgactaacatcctgtttagatctctcgtctaaattttaacattaaactagtaacttgctcgcgctccgcgcgagcctttttaacgatatttttaaagcagttggtttgatgtacatatacatcaagaaaaaagttattgatatacatgaacaatatatagttgtattggtatatatgggaaccatgtacatagtagggacataattagtatgcatactttcacaataatgaaagaatcacgtacatagtagagacataattaagtgtgcatacttttacaataatgaaaacttggaatttgcaaacatagcatcataagcagttttgatattatcttacattgggtcttagccatcacaaattaattgtacactaaaataaagttcacatggagcttgtctagtaacacagttcgcattggaataggcatatatacaaatttcttggggcagcataatactggtatttaagaccacaacaggcattacagaaatatgcccgaaaggtaattagcttgacgacatgcaaaccatgtgtaattgttttttttatatataagatctgtatctatgagttggtaccttagtaacggaaacaatatttgctatcttaattgtggtgacatctcaccataacgtgataagagtgaacatagaatagacttagcaagtgaattcactaattaaaacagggtcaacctatagcgcagtcacccaaaaggaacttttttttgggggaaatagataacatctatatcataccatttataatggaacaatgtcatgaatataaaaaaatagtaattctaatccattataatattgcacatgatacttggttttaaataaaaactgagtatgaaaccaaggaaacaatatgtgctaccttagttatgctcataggtcaacaccttaccataacgtagcaaataaaccaaagcaaggtcaacctatagcgcagtcagccaaaaaagaacttcttggggagggggggatagatagcttctataaatcagacggggaccatttataatggaacaatgccatgcatataacagaataaataagagtaattctaatctatagcacaataaataagcattgagtacttgcttgacaccttggatttctaaagttatgttatttgacctttttcttatataaatatattttgcagtatcttacaaatcatatttcctgctatcatgatacatttattttacttagtcttcttatatttgtcatgttgtatgtgaagatagaggggacatgagtgtctgtggggaaaagcaatgcacatatcgggaattacgtggtggtcaggcaaacagttctagcctcaagtgagtgtgaaaatcaaacaaccagcaatgatgaaatacccagatcagagtcttatttcgaggtcaccatgactcagggttatgtatcgcgtggagtgaaggtcctaaagcagccagagaaaatcctctatcttca

SEQ ID NO: 3285 - DNA, 1674 bp, Zea mays
  misc_feature (1)..(100): optimal_loci_95297_G1, chr3:16866637..16868310, Cluster 19
catctcagtttcttacctgggtctccgtgatccatcgttcggagtgagtccgcacttatatccccaccaaacataaatttattgtcctccggtttccaaaacgaggacacataactttgggtgtttttgtgatagagggtggaaagaaagaaagcaggagcaaaggaggagcgatgaataatgggataaactcaaggataaaataagttgcatcgtaaagatcatttcttaagatattatattatatttttatctttaaattataaaaataattttaaatttatttggtttataattttgtctatacacctaaatatatactatgtgttatattaaaaattgtaggtctaaaactatgaaaatattttatagtttaaggcaaaattaggaggatgcagaaactactctagtttctctgtcgtgagtgcccaaaagtctcacatgtattgtccctcgataaaggctctctgtctcccagtaaaaaatctcttgtaataacgtattaggacatataaccaactagagtcgctgtcactgcattggcatttattccgcaactctgctattatcccctcgcaagtccacaataccactgctccagcttgtgctcctccctctccctgcgttccatcgaagtctactcgccacctcttcctattcctgccatcgcacaactaaggtattctataaatgtctaggctagaagatcctaacagttatcctcctaaaaacatatatttctaccgttaccaatctttctcctattccctattctagccgcttgggaagctcacatataccctttaaaatacaagcaccatgggtcctggtccaaattttggtcttactcttggtattatatttaaagtatatcagctcttccagaccttattcttgtcattgttgtacctcctaacccaaaacgccaagagacaaatttagatctcttaaattagggatatgtagcgcccccccccccccacccacacacacacacacaatttccttacacataggaacatatcccgaattacctcaatgatatttttttaccctcagagtcattgcaaagataattgatcatttgagcattcaaaagctttgtagcccactttggaaattttaagataaaaccaaaataggaatgctagctaagagatagtctttatgagcgttgcagtagcagctatagacaatagcctattaagagcaaatataataaggtgatgtagattggaccacaagagatgtcatgccaaatttttggtgttgtggaataaagagaaattgagagagaaagaaagtgggcttttcacaaactctaagacattttgtgagagaaagagatcgagcaagtattaaatgtataatttatatcatgagatggttattatatgagtagactttttagttggctatatgtgacatgacaatatcataaagcttgctatagcatatattattaaacttgatctaaagtgcttatcaactagaggttggatgtcttctctacacaatttaacaaaatataaaggaattcctagatatttaataggaaaagaacatataggacaatgaaagatatgagaaatcttaagtatacgattttattctaatttcataggtatgcatttactcttagggcttgcttgtgagcaataggattggagagga

SEQ ID NO: 3286 - DNA, 1465 bp, Zea mays
  misc_feature (1)..(100): optimal_loci_9679_G1, chr1:51391654..51393118, Cluster 19
ccttttctcctgcgctttcccaagttttcagtggcaggggagaggaggcggaccacttttcgttgacaacaagccaggcgggacggcggactttttcttttgtcttttttatatataaaatttcacatttatatttttatgacgactattagcatattcagatcttaggagtccgtgtcgtgaaatacaacgtcgaaattatacgattcaacgtcataggtcatgctgtgccgatgtatcaccgaagctatatagtagtaaaaatccaaaaaccagctgtattattcaattcttcacaaaaaaaaaatgtgcacataacaagaaccctatattatttataaaaatcatttgtttatttcaaattcatgtgatacacaaataaacctatagcattttataaaattgataaaaatatttattttaattaattaatttagtaacaacccagaatggagattttagcgtgtgacattgatgatagaactttcaacgagttgagatccatatatactttaacttatgttccgtaatccattacatgcttgtgtctaattgtatcctccaattcgtgtttaaaaaataagacatgcaagtcatattttctagtggtttgttgaaaatattagccatcatatgtcacaaattcaatttgaagtttcgttagaagatttaactatcattgttatggttaaccatatgactgcacgaatggcctattctaagcttcgaaggagctagaccattgtgagcttcaacgacggcacatttgcatggagctggaggctaaaatatgattcatttcttttctcctattgctttggctccggccaacactcgaataacacttctaatatccgtttacgtgcctatattgtaaacgatgacagattattaattctggatagataaaaataaggttcaaaataagcaaagatacactcactttatttttgttaccatactcaaatttaagcaacccactatgtgtgcaaaactccgtttaattagccagtggggctcgtaaaataaatgtatgcgccgagcggtagcaattaattagacaggtacaagaccatgcgcgcgttcgttctttgtttagtgctccgcatgattggaacggctgacaatttgaggggcgcgatggatctttttattaatcccgcagcgcaactaatatctctggcgcatgcgctttctgctttcccatgtcattaaccattcgcatcagtaggttgtctagtagtgactaaagtggagttaccactggatgccaccttaagccaatcaaatttatgacaagaggggactttcagttacctggttgcctcttttcgtccaccctaaaatcccatcattgtactgatgccggatcatgcggttctctctctctctcttttttgttccattaacccggctaattaaccaaggtagccaggcttttataccggcagttttcagagattgt

SEQ ID NO: 3287 - DNA, 1966 bp, Zea mays
  misc_feature (1)..(100): optimal_loci_97629_G1, chr3:29456196..29458161, Cluster 19
tctatcttccataaatgtatttggtctccatgatttatgcataaacaacactatgttagcaaatatgatctacttggtcattgtaattttagtgatttatctcgaggtaggttcgatcaaatatgattcccttataaagtcatactttggacatattattcaaaccacacttaaatatttgcttaattaatggtatgcaataccataatactatatctttaaaaagttggctcatagttcttctataaattagatatgagtgaacaagaacaatatgtttcatgcataaatgaccacttattaattgtgcaaaacaatgaaatttatcctttgggataataaatccttctagagaactatttgggtaagtgagttagaataatcaatatcttctagatagttccttaaatcttatactagagtttgaatacttgtaattcatccttagtgtattttcacattatatgttccacaaatctttgatattttaaccgtaccactaaagagtaaatccaatctcacgtttggcatttagaagataattgaattgccaaaatcaccattgttcctatatttctttagtatttagagaaaatcaccactttattgctagtttttaatatgcactttctaactatttatatgacaacttcatggtgtttattattcctcgttttcattctcttggatctacatttactttagggattaatggtgtttattcaataatcaacccataaatcatccatggattaattccttaaagaatgttctcattcttagcgaataatatatctcttccatgagatatattctctattacataagatattatcatgcaatatacataagttagagttactaatataaagtcatttattgactttacttcttctatgacatgctcttcttgagactttaataatcatacaagaatatattttacattacactccttaatgtttggtatagatttgtcatcgtattgtgacaccaaggtccaagagtactagagaaaataagagggagacatagagagggtggtaggtcaaggatcattggatcagagcatgaacatggcagattgcacacacaagatttatagaggttcggattgctctactcctctatatggttagtgttaacatgtaagagcaagcatagattacatgttgtgataatgtctaagctagcaagtgggggagagaacacactttctatgccctagctcccagctcctaagagagttaaagaccccctctcaatgccaaaaatctccccagaacgtccacccaaaaatgacacctaaaatatgaacccaaaattttccatccgttctatggtaccctacacctccattttatagtacaagggaagagaaagttatatccctgcatgggcactgagccctatccaacaagcgtccaactacttataccttataatagtcatcatactatatggattgcatgactttgatgtggcacaacaatgagtgtgacacaccacagtatcaagcatgtcatgctatagtgattataacttcatctgttcttgttgggctggcaactgttttgatactcttttgcagccatttttattaggcataactctagctgtcaacatagtgttcaactagttatgtggccgtgtgttgcgacggaagtaaatttttttataaaatttagatatggaacgacaaacattactatgatgtgcaaaatatgtgtgacaaacattatcaatatcgtatagattatttctaaagagtcaatatataatttttaatgatagacaaatatatcgaaaaccgtacactaacctaatcttttttagcgatattgacaagtctctgtttgcagggatgacatatcgacatgaattatccttataacttaacagattaatcacaacccgtgatataataattctttgatggctaactcttctgccgtagagtccttat

SEQ ID NO: 3288 - DNA, 1435 bp, Zea mays
  misc_feature (1)..(100): optimal_loci_98900_G1, chr3:37243849..37245283, Cluster 19
ttgttcgttagctaaatgcttgctatgacaaggtttttagagcatctccctagaaaataactcctaaaaaaatctaggagcatctaaaaatgtatcaggggtagatttaaattagaattaaaattaccttgtacttaatgttttaactctatgcttaaataactaaataggcacacacatttttatatgctgtcatgtgttataaacaagcccgtaaattaataggagtgttaataaatctcataaacatataggtgctcaatacagtgagcacacgcgtctctagaacgttcatttacatgatttatttacaacacaaaacaatataggctcccatgacccatcctatctgacagcgcgtatgccggtctggaccgtgctgtccacgtgctctatgaacgaggtactatagcctgctcgaagcaaatgcagcagcaacctatcgattcgaatcgatttgatttgatttgattcgattcgattcaacaccgcgccggtggttcgcaaccgtcatgagcctaaacaaacaagtcaaatggaagagaagtatgatgatgagcagcagatgaaggcaggaagaatgcaccgttgaatccttgccccccgttgaaactcgaaagccagctagctcctcgaactttgtatgtttcaatgattgttagttggattggattggatggaacacacggagcttggatggaacacgtgctagctcggggcggactggaacaagtatatatgctggcatgcggcctggactagactagaatatggagaagcgagcacgagcagcatacgcggaggcctcgccggcgtggactggaactcggactttcacctgctgctgctggctccggcctctttggttctacttcgataataagctggtgtaacttttatatccatcatattgaatcggtgcatggcaggcagaaatctctaccacaaatgaagagggccatctactaaaaaaaaacaccatgacattagaggacttcctcactactgcgacggacaagctatccacccatagtctcgaataggtaataagtcaaaaataatcacctaaacagatgtatgtatttctcgccaaatattataaaataataaaatattgctcaataaaacataatgacctcatgaccccgtccattaacatatttgctgccatatacatgtcacctccaagcaatacaaaaaaatgctgccaacaaggaaaatgtccacatatgacaccccttagacctttataaatgttcagttgtagctaattacttttagccatagttttgtttgctttattatatatgttctctacattgtatagttatagaaacctgtcgctgattccaaaccaggacgttcaagccctgccgcttcgccaacaaagtggtacgcagtagtttgagctatcacaacaagacgctcaatcttc

SEQ ID NO: 3289 - DNA, 2500 bp, Zea mays
  misc_feature (1)..(100): optimal_loci_257541_G1, chr7:125978470..125980969, Cluster 20
tgtgtttgatgtttagacattttttcttcaaacaatgcatgtttagacattttatattatatttgcattctaatatacgcgcttattgtaatgtgcacgcttatggacttaaatgctaaacctatattgccatatgctattcttatctttatattttgaattgtataccaaattattataaattatactaaagtatttatgaaattcttatgatacacctcactaaaaattctagcaaaacgccactgttggccatctatatgttggttgttgaactgcgttgaacttgctgagagatataacttctaaattaaattaaaaactctgttattagattgatactctagagtactcacttatgattacaattttatatcgtataatgaaacactagaaaaacgccttgcttctagaaaagatgggccggagtacgtagctagtcatacaaaactttgaagcaaattaaatatccttagttgctatctatcaacgcagaagatgaattagagcttatgctaagatgtcatgtcagtgacatatcactgtttagtaccattggaaaatgaattctagtgaagatattatatgcacgcagatcatattgctgtctagtgaataaaaagttcatattggacgccgaattgtagtcatgtttttttcgtgctccttagtcaaaaataaaaaccatactggcatacttaagttctgttagatttgaaaattcacttagatcactttcttcttctttttgcagaggttgatatatagttaaagatgcacgaaaaaaataaataatgaattgcttgagagctaccactagtcgcacatatgtcgttgtttatgctgaacaccatagacgaacgtgttgagatatatacctacaaaatcattttggagaatcgtgttttagattcatatttcaaagtactcatttgatatagttttgttttgtaccatacaaatgaaatactatagagcaatcgttgatcaaaggcttgtcctaactgaaggaaaaatgcctagcttgtgatagaaaatgagtgagcacatagctgtcgtccaaactctgaagaaaatatccttacatgctaaccgtaatgaagttaaattagtgcttatgctaataagaggtacagtgacagtgcttatgctaagaggtaagtgtcactgtgtggtggcattggacactggattatagtgaagttgttacatatacattaaaaagctcatgcaccgtacttgaggagttgtgttttttgtgctcctaaatcaaaataaaaaaaccatgcatacttgagaaaggagaagagaaaattgcacaaagaccattaagttttcagtttcacacatacaaggtcaatgcttgaactaattttgttttcaccacacctatttccacaatatgtttatcatacaatggcatataagtccagtcatgggtataaagattttgactagaatagggatggtactcaagggctgagttgtattcttggagcagtatgacatgccatgttataatctagactagagtcgactatgacgacgacctaatagagacttacctaacaagagtatgtatatgatatcaaatggattgggatcaaatcctagcccctgtacaaagggacgatgtatgtaacactcatgtatgtatggtggaattctgccctatacaaaattccatatcttatctctgctgaccaatgcaaaaattaagcaaacaaattgcagttgtacacagcatttatccgattagtatttgacaagctaggtcgcaccgacgagacgaggcgacgacatcccgggcccttggccgagccgcacacccacacccacccacgcgggccgtcctcggcgccaggacgacgcccggccggccggccaagcgggaggtgacacgagatcgcgagccgtgcatgcatgcgcagcgacctcgccggtgcccgcggggcgccagctggggctgtcgtgtggtctccgtcaagcgggggccgccaatcatgaggacgagcggaaagccccggcggcagggtcatcagcggggcggccaggtggaggctcccgagagttcgagccgaggcgaggggcccgccgggccgggcgaacatggtgtgcgtcgacgtcgcggccaggtcagacgggcttgcagcttgcttccagacggttctcggcatcggcacccgcgcctcccgcacggccgggaactgcccggttgcctcctcgcgcggtccgatccgttgccgtgaacagctcgcgtcgtcagtgatgtgcacgcatgccctgcaagctgactacgaacaccgtgccgggagcgacctgcaggttgcagcctgcacagtaatgctgcacgatgtatcccttttcctgcttccgatccgttccctgcatgattcttcagtttagcgtgcgaacgtgtctcgatcggacatcaccacatgataggatcaaggataatttgtgcacacagttcctagatgataggatcgctagggcaaca

SEQ ID NO: 3290 - DNA, 1532 bp, Zea mays
  misc_feature (1)..(100): optimal_loci_100850_G1, chr3:48488864..48490395, Cluster 20
atttgtttcactttgtatttaaaaatactttaatataatacttattttatatttgttgatgtcatatttaaaaaaaatattggtcaaagtttcactttaaagactttttcaaaaatgccttattttttgggatatagggagtattatattttatgaattgctgcttctgtactccttgttttggctttagtctgtgttctatttcagttctaaacagtcggacttctatcgcttttcgacacacatttattttatggaaccatcaactaatgttttcgtttctcagcattccagcaaatattgttattcaagagttttgtattcactattcagatgtttgattgacaacttgctgaaaccacatttcaatggaaagaacgagatcagtctagatctacttcgatgatggtaaatatttgtccaagcttcttgggcctttatgtcatttctagtgaacttatcaattgtctgtcaccttgtccatcaacgtatcggtttgtttgccagtgcttcttggagcggagaatccccgagaaccacttcctcacccaaacaacaaaattgcacatattctggtgggtcgcagacaagaatcacttcttcatttacaatgggaggtaaaaacctgctcttcactactccctattcaatcctcaccaaaatcactccagaatctctccacaccctgttcctccaccataatcaacaagaatcactccaccaaagaatcaaggagtctacctctaccaaacaggccctgactttcgtaatcagagtttcgattaacaggccactaaaaccacctcaaaaaagtcattatattggttcctgatttttccagtgctgattatgaccacattgttgtgtcttatgtcaaaatttctttaaaaattgggttgtataataacccacactgaatcaagttgaagagtttttttctatatctaaagatagctgaatttaagggcaattttacgtgaccaaacagggatcaatctcctactcaaacgggagaaacagagacatggaaacattctatccagctgaaatttgcatgtagaagggttgtacattttcagactcagaacttgctgccaataaccttgcaatccttaattgtacaaatcttttatagcaaattcttgaacgtttgaagacgagtgacaaattagctgagttgtgttttgacacaaaatataaacattagacttatatagagcaagtcaaaatgaaagcactgagaccttacaatcatcaagttacatacaaatttagaattaaaatatggcagaacagaaactgtaaaatttatatttttatataggtaaagtcaaaattcctgtagtatgaaacctgaagtttgaagtagtgatttgttggagatttgtttttgtctcccaatgtttcttgctatagtttcatttgccatatcattgcatccttgtttcaactagcatatagttcgtgctagcgctacgatcccagagagggaagtggtcgacggcagcggcaacgacacgaggagaggggtt

SEQ ID NO: 3291 - DNA, 1606 bp, Zea mays
  misc_feature (1)..(100): optimal_loci_101100_G1, chr3:49626974..49628579, Cluster 20
acgtgtctcggccgaagctgcggcccgtcggtgttgggcctagcagacccatgctgggccaccatttggccatttatatgcggaggtgtggtttgagacgtggatgtggttaatttgaaatagaaatagatgtgaggggttatttgtaaaaagattacgaggaacgaccgttgaaactggtgctttaatatggtagagatagagatagagatagggatagagaagagatagagattaagatataaattaaactaattgacacataatctacctcaactcatatattagggtgaatactagtctatcgaaacatagcctgagcgtcatttggttggttggttttcttctttgacttgaaaataaggagactatgtgctcacttactagtgtagtatccaaacatatttattagtttgaatatgactcacttcctagtatagtattcgattacggttggacttaaacaaacatgatttaacgtttttagttacctatcacgttacaaatatgtgaaccaaacaacaccttagacttaactcacaaaacaaattagttaaagaaaactcaaaaacaaaattacaaataggtgtagcaacaaaactttgcctgtctgtttggatgagttagacatattaattaattgggctaaaatagcttaaattagttgggattatatacctagctaggtaatagctaatcaaaagtttggctaaaaatagcataactattagatctcttgttgatacactgtggtttttagctcttcttacttaattctaaacttgtccttagagcataatggattggtcatatttaacatttggttcgaccatggccatggcgatggccatgggatacatcagttgatgtttggttggctacaacagggataaagccttgttgtgcacgtgtaagggtgccccttccagcaaaacaaaaatggattccatctctagcgagctagggtcacacatgaggcaccagaagatagagattggtgcaagacgagagatcaaccaaacaacatcccattgtggcttgcctaaataaaaatatgataagcaaacaaatggagaacgtggtaattctggctagccgaaaccgcgtttggttagctgtataaaggacaaccaggctcctccgatgcattgcacgaccgcaacatggctagctactaggcctggcaggctcgtgcagtcctggctgtcgagggaagggaatcaatcgcgccctatatctcgcgtatgagctaagcttggctcaactataaatctatatttttaagggcttattcggctagaaatgcattgaggaggattaaaggagattaaatctttttctatttaattttgaatataaagaaatttaatctctctcaatctctctaatctatctgtaaccaaacggagcctaatgaatggataataaatagagaaaagtgttttttcgtgttgtaagtcatgtgatcctcgaggtttttctaccttttcacacttgaactttttcatgctgcctccctcgtcctaccctcctcaccaactttgactaggtatggacgtatggttaagaatatcaagatttactttagggatagtttggtgacaca

SEQ ID NO: 3292 - DNA, 1705 bp, Zea mays
  misc_feature (1)..(100): optimal_loci_1077_G1, chr1:5527034..5528738, Cluster 20
atttcttatttgagctgccgcggatgttatgacaaaacaactttaaatctactaatggagttgcttgtagagttagcaaaaggaatgtaggagtatttaataggatctaacggtattaagcaagtttaatactataccccactgcaagctttatgacgttgtcatattatatgtagccaactaaaaatctcttcttataataatacaagttgtacatttaatacttgtctcatttcttcctcttacagtcaatcttggagtgcatgagcaacccactttaagctagctactagtgagcggtctggtttcattctctccacatttctcttttttcatattaccataaatttgatgtggcatatcttatagccgatctacatcatcttgtcatacttgctctcaatgtcgccctctttttatctatggctccaacgagacatgagttgattttttagggttcttcgtacaaattcatttttttattttagtcgtcactaaagtttagagtacgaacaggggcggagctaggtgcaattgctggtatcatctgaaaccggtagattttgtaaaaccaacgaagaaacattataatataatgcttgcagtgtatttgattctattctccaatgatgatgacatcaatggtgttcttggctagcttcatccccgggtacaaccgtacgaaccaaacaaacttaaatcatcttaaactaatagactgcataataacgagtcaaacaaaaaaacaaaactaattttaatatgtttaaactaaatctatattatatatctgataaagttagatcatacttttttatgtaactaaatttttagtatatttatctaagccgcaacccacgtgcatcatcaaatgcatgagcaaaatattcatggccctaaagtaacgcacctaaacctacatcagtgtacttatatgtctagtaatcaaaataaaagaggtctcaggcgctcaagataactttctctacaattttcttcaaaacatggagtgtggcgtaattcttgtgtgtgctgtgtgcaccgtccggacgagcttgctatggaataattgtactagctagtacggcgatatgggacccttgatttaatttattggagccccaggtttggcattgccaaattaaaggtcaaaaagagcagcattttcttattagaattagcatgatcgagccggcctactttattgtggatagaacttagagctaaggatcgagttaataaagtctagaactaaggtcccgtcttgccaggaattgaatgtcgtgtaccagagcattagagttgaagaagccataaatcgacttcattgagggtgtcggtacaagcaccgcgtaatcacgaagatatactgtacagtgttttctttttgggctcttcgtttggcactcaatgttctacgtattgttcgatcgagcctaatatttgagcccctttaaatcgatattactaattgttttctttgaaactatgttatatttaatagtctacagctataaattttttagtattatattagtcagttcagggcagaactcttttctggatactgtagctgctcgccaatcaaaactcccttgcagcagagtttaaaaacgcagggtggcccaccgagaacacagcaggagcaccgagggccctagaaagaaaaaaaaggagaaacgggtacgtagctcgttttgcacga

SEQ ID NO: 3293 - DNA, 1862 bp, Zea mays
  misc_feature (1)..(100): optimal_loci_11051_G1, chr1:59760976..59762837, Cluster 20
ggagggtctgaattgagaggaggtcacatttgcagggattggaattaggttgaaatggtcaattcaattccacggacaaccaaacagaccaattgttggaaaatgattcaattcagaccaattcttggaagccaaacagcccgtatagagaatccggaaccgggtctcattgccaatttgccatctctggtcggaacttggaatcaagaaacgcaggaaatccttcgcgaatgctaagctgacagaatacttaagcagagttggtcgctctttgtcgtcaaggagacatgcatggcaatatacggcgacggaacgatctctcgatggggtagagactcaccggagagccaaagccacggcacggagcagtggagcaccacgaagcttcggatcaaacccaccgcgccgcgcccgaaagggcctcaacagagtgactgacgctgacgcgacgcagggacaagaagaatagaagatgctagagagcatcatccatgcttcaactgatctgtactgtagctttgtaaaaaaataatttactgctaaatctaatttaagtaaattatgagtttgcagctaactctaaaatctctatacaatacatattcctacgtctaaacacacacatctataaaatttctgtttcccagccagctgattacatttttttttcgtttcttctatccgtgtctctatacgttgattttgttatatctttgtatattgtattcctttgtttactaaaatctcaacatagatatattgtatcaagaaaccactcaaattaccatgattattatcggtggggaaggtagagcagatttaaataggatacgtttgccttgctgacacatactatgtgattggttcgatgaatgttcagcacttagctggctctaacctggctcatgggatacactcttgtattgtgtctccacggatacgggcaaagttattcaatttggcttgaattgcacccatagatgcagatgtggcatgtctcgtacaaacaaccaaacacagaccaatgtttgatcaatgcatatgtagatcgagtctggttgtgctcgtgtatacaaccaaacatatggataatgatctattatagacatgcatatatggtgagattttaactatctatatattttatatgtttttggtgcgtttgcaccctctaaaaacaacgtgtcttcacccctgattaatatcatcctcttattgagttggcttaaacagagtattcttcatagttcgtgatatgcgtctcatacaacataaggaacgacattttatatccctcgccaagtcaagtatttgtcacatatatacgtaacaaagcaaaaatttagatgtctacaacgatttttgtttacattaaattctcaattttagagttatatagaatactaattaagattcttgcctatcctatattcctatatgggacatgtgaactggataaccgtccatatttcaccaaacttgggagtcctaaattagaaattaatttccaatggataactagtgggtgcccttctgttatcgtcaccaaaaactcgaaagtgctcttactattcatcgtgaatataggattacactatgtaggatttacccaagtaatataaatcatttaaggccttttcaggtaataatgttaagttgtataaatactattttgtgttttcacttatcaagctatgtagttatgtacataagatttccttaagcccttaaggcacgtgtgttgttgagagggttgttggaccatccaaggatatgcctcgagctcgaagtgtctgtcaaggatatagacatctcgaacttaggagtatcacttggctctatttagtttatgtgtctatgtg

SEQ ID NO: 3294 - DNA, 1724 bp, Zea mays
  misc_feature (1)..(100): optimal_loci_110941_G1, chr3:118178922..118180645, Cluster 20
attaacacccgaatcccattttcttaatagacacatgtctcccatctggcgctttatgtcgtcttctattttcaattgatagtgtcaaatcctattattttagatgaggttgataactaataattatagtagtagatatttgtgtggtgttcacatgtatcttgtccatgtctaaattgtgcgcatccaccatttatcattaaataattcacacctttagttctttcttacacttatcatatggtcatccaactcaccttataattttagttgtgtctccatctatatacaaagaacaccatcgaaaggattctgaatctctacaagggatctctagaaacaactcattgataggtaacaaaaatctttctggttctttctcaattttgtattttttgttcattttggcgcatgcacgcttgttctttttaccttatcaatagatatatctctactatataaatttgttcaaaatatatgcttgctataattttcttcatataactttgttccatgtttatattattaatattaacaagcatatattgattaaaatttagtcaaattataaattaacttcacttaggttaagcaataacatattgccaaaatgatgtgtgttgggggtattgattggggtataaagttaatatgtgcttctactataaagaagtccatgctaatgtataaaatagatagatggaaggattagatggtagtatgctttttgtagtgtgcacttacatccgtcgccatttcactctcgctttcacctgctagatggaaggattttatcaagtaaataccattgtgtcatttccactatgttcatcttttaggcataatcatgtttgatacaatcatacaatactggtattttacaacctcatcacaatctaaattgataaaacaaactgctgaaagtatctctgcataaaaagatgttttttgacctgcacaacatctctttgctgttgatgcaagatattgacgggaagatctaggaaggaagcaaatctgatagcttccgagccaactgtagttgatatttatggtacttgttctagatattaaaataagacataaataagtaacatataatttagtaaaatgtattgccattatggctttgtgtggatcttggtttgagttcatacttcgatgccatcagggaactatgcggttgtagctggaaagccttaaatttatgtagaatgtgcaatagctgccttaacctatatgaaatgtgatggtggtgttgtaatttttgcatgaatatttggcttattctggactattttttatgcgaatagttcctaacttatgtttgttccatctatgcagaaataaaaccaagatagttcttcttgacttgttgcagaactcaccgtactcgagatcaaagttgcaggcagacacgatcgagaacatcgtgaccaatattgcttcccaaaaaaatggcgaagaccgtagcgacaaatggaagaagatgcttgtcgagattgtgaaagtcaacatggagcaaagccggaggcatgtgtgacaattggggttgggaggaaatgacaccattaccggttgtaaatattggtgtcgtccctatcgtggagaagtttctcacttcaccaaatgaatgtgctcgtaaacaagcatgtttggaacaaattatctctatttgaatcgcgcacacatttcatgttattagtgggaatttgtgagatatt

SEQ ID NO: 3295 - DNA, 1478 bp, Zea mays
  misc_feature (1)..(100): optimal_loci_113401_G1, chr3:132392908..132394385, Cluster 20
attgcctctacccacactcttcatataaacagctccactcctagtggtcatactgcaatagtcatttgtggtcatagacgctgcaacagcataaaaagtctccttcagaatcacaggaattaatgaacttgattggatctatgtatgtaggaagagttgtgtatttgtcaggaattttaaccaagtatagcacaagtcgcatttagcaaatcaaatggatgaagaaacaaacatcctaagctgcgcaaagtacatattatggtataaatgtttatctttggattttttggggaggttttttgacaggtggtatgccatcctcaacgactgaaaccgtattttggcaatcggttaaaatactggggctatcaccctaaaactgtaaaaaaaatattatggtataaacaaattctacgatgctaaatatcagatatgtgaagttctatggaagaacaaggaataatatactattatgacagttaaatataaatttttattaaatttatatagatcaaatatacatgaccaaaagaagagaaatgtaaagtagagggtcaccccaaatttccctagaagatgattggagaaaatttgattgctctagcaatcttgacaatcaacttgccacttggcctccaccacttgtatacatagctctggctcgaagacaggaaactgaatcaggataaaaaattgattcctcaaaaaataaggattagaaattgaatatctaaatttattgataggaaccaacaatgaagaatatcaaatgcacatttcaggattaacattgctagcctcctgaagtttggtaacaattaactttttattaattgagtgcttcagcacctacagtcaagtgtaaaggtatcattacactacatatcacaagttaaaaggaatgcctatccgaaatagtacagatcagggggagattcttaccttcataattgtccatacaaagcttagaaaacgggaactgtgaacttggccacgttcctcgtttcaggaatgttcgttccgttctgtgaatgtgggaacaatcatgttcccatagtgttaaatcctagtttttatagcgtatcgcgtaccacgtttccgtccctcgatcccatcgatccaggaacctgattattaagatacaaagtctaaaatattattgttaactagttttattacaatagttttcccatgtaagggcggttgattcatttgctttccattttatattatatatggttttgtcaacacaccatcttcatagacgaagctttatgtcttatgaataagccaatttatctttatttcctttttgaccttgcttctcagtgaagtttatctggtggctttgcttcatctctgaagaggagagtcttcatgagggaggcttcattggtcttgatgattcctatccttcaacactatatgagtttacgcctcgtccttggtctttatagtctatcaaaaccatacaatgg

SEQ ID NO: 3296 - DNA, 1605 bp, Zea mays
  misc_feature (1)..(100): optimal_loci_115496_G1, chr3:145793074..145794678, Cluster 20
  modified_base (210)..(210): a, c, g, or t
  misc_feature (210)..(309): n is a, c, g, or t
  modified_base (211)..(211): a, c, g, or t
  modified_base (212)..(212): a, c, g, or t
  modified_base (213)..(213): a, c, g, or t
  modified_base (214)..(214): a, c, g, or t
  modified_base (215)..(215): a, c, g, or t
  modified_base (216)..(216): a, c, g, or t
  modified_base (217)..(217): a, c, g, or t
  modified_base (218)..(218): a, c, g, or t
  modified_base (219)..(219): a, c, g, or t
  modified_base (220)..(220): a, c, g, or t
  modified_base (221)..(221): a, c, g, or t
  modified_base (222)..(222): a, c, g, or t
  modified_base (223)..(223): a, c, g, or t
  modified_base (224)..(224): a, c, g, or t
  modified_base (225)..(225): a, c, g, or t
  modified_base (226)..(226): a, c, g, or t
  modified_base (227)..(227): a, c, g, or t
  modified_base (228)..(228): a, c, g, or t
  modified_base (229)..(229): a, c, g, or t
  modified_base (230)..(230): a, c, g, or t
  modified_base (231)..(231): a, c, g, or t
  modified_base (232)..(232): a, c, g, or t
  modified_base (233)..(233): a, c, g, or t
  modified_base (234)..(234): a, c, g, or t
  modified_base (235)..(235): a, c, g, or t
  modified_base (236)..(236): a, c, g, or t
  modified_base (237)..(237): a, c, g, or t
  modified_base (238)..(238): a, c, g, or t
  modified_base (239)..(239): a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
ggctatgccatagattgcgctatggagtccttctgctttagtactggaatgagagattgcttcgttgcaggcatttgctcgtggattgatgcactggtctaaatgacgctgaccaatcctcctcagctcgacgcagagaagtcatagacgtacgcttcctgctaccgtcacagtgccgaagtacgaataacaggttaactgctaaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgaatctagagatcgtccgccatgtgaagccttgtgtacataaagagcactccatgtgaaaaccacaagcgccgcttttgtactctaggtctgattgtttgtccgattgtctactctcagtattgtggacatgcaaatatcaattacgaccatcaaatataatttaattataaaattaattatagagataaagactaaacgactagataatttattaagtctaattaatttactcgtcttaccttttagttctaattagttttataattaaactatttttaatacatcaaacatctgatgtgacacggtaaaatttatcttccaaacgggccattagtcaagatcccatcttcatgtttggttgtctagtcattctctatagtctggctctataaatacaaaaattctctctagacctatcttccaaaaattctctagagtcagtttatgctggtgcaatcatttagtattatctaatggtggattaacaatgtctattaaataatttcaatctatttaaaattaggattaagacttggttcatactagtccatttactatttatgtaagtagtgttttagttgtttattttgcttagtgattagctagtcttcttctacgtatcttttactagctactaatttgattaagagataacctagagcaagctagaacaagtaatttcgtccacatattcaaatatattggtcctagttgtaatcgtaggttttgtcaaataattgtttatgagctattcaccacctctggccaactaagtcatatcaagtagtatcaaatccagaaaaccattgtttttaggcttaacatcttacggtgaaaaaattacttttagtcatattggtacaactcctccttttgatggtactaattatttgaaaaaatgatgtgcttacatttaaaagttatgagcagaaagatatatggtgttgtggatatttttgtagcgattgtcataaaagatccaacacatagtgaagaggagaaattgcaattaaattatcaagcccttaacgtcatatatgaagccttcgatcccaaagtctttgaatcaatcaaatacttagaatttgtatgtaactctagaaaactcttatgagaacacaccagctgtaaaaaagccaaattatacatcttcaaatacaaacatgcaaggttcaagatccaagaagacgagagtgtgcacgaaatgttttgtagacttaatgtcattatagttgggataaaaaacttaggacataaggtggacgatgaggattttttcattggtttgtaa

SEQ ID NO: 3297 - DNA, 3148 bp, Zea mays
  misc_feature (1)..(100): optimal_loci_115703_G1, chr3:147279019..147282166, Cluster 20
aaaattgtggcatggaatgaggtagacagttctacactagcaaaaggaacactatttgtggcacaagtaagcattgtcaaatgaatgttaaagaaacattttaaataacaatatcaatgcaattccaatcatatatttcataatattgaaatcaaaccatgttcaacagttggtgaaaaattgtactaaactgaactatggttacaacgtcttccatttgattatgacacccaggatttgaactccaaaccctgaatctagggctaggtttgtactccaaaccctgaacctaagactgaaccctgaacctgaatctaggaggaacaaaaatagtagcaactgacatggaccacactttcaagaaggaactgaatcattaagcaactaatcgattaaaaccaaaagcatgattaagagaaattcctgcctcaaagttgcatagggagaagaatcgatggtgagataccacagatacattgcaaatattttaaataggggggtatgaataactttgttccattaaggagaattaaaaaccagaaagctaatatacagtaaccaaaccaattcaagacaatgcatgtataaactagaaaaagactatttttaaaaggacgacgatacaacaagacagttcataaataagtagcatacatgtgtgctggacacaaaagcccccgttccatcaaaattgccccacatcaaaattgcacccgtcctttactacctgcgatagtaaaaataggaaaatcaattttatgacactataacaaatcaaaagaaagcaagacatggaatctcaaatcaggacacaatagtagaacagagaaagcaagactgggaaaactcaatatcaggacattatagtagagcaaaggcatccaccacagaaggtacctagcctatcaactgtttgtctttcgaagagtgtgtttcacagaaaacagaatgctttggtttcatagtgggaatagcacggtcagcctcagaacgaggttgtatgtctcgccattattttaaaagaacaacaacctacaagggacagtaaaacaagaatcagatcatggatacacaataccatatgcccgttttagtgcaaaaacatgcgtaataaacgtaattcgtatggcaccacacacacttattcattagatttcaattatttggaacaacttgaggactaatggaaggactttagtgggtagccactacaacataaacatctacatgggattcctataggtgacagaagtctgattgtgcccaattcttgcatatggctgaactgcatgctttttagataagtctcaatgatggttatcaattttggattcagtgtcttaactagcctataatcctaattttttttgcctttttggaaaactattatagatacactggtaggattggagtccctaccaaggactaggggcggacccacggggaggtccaggtgggccacagcacaccctaagcgggcccaccaagacctaccccgttctttggtcgtgcgtctgacgctagttgccctagccacagagctcgcaccgtcgccggctagccacgccctagcgtcgtatgccatgcgtgccaccgctgcagtacttgcccaccacgcacacgtaagccacagccgccaccgaccaccgctcagcagtccgtcggcgcccagccaccaaacacgcagctagccgggtttggccagcgccaggccaccatggccgcggctccaacttccaacgctgtgccccgcctggcaaccaactgcgtccaccgcctcctggctggctaggcaggatagagacagatgtctcatccagtgctccactcctccagtgagcactgatccggtctccacaacagcaattgcgatttttaattcccaatttctaaggtttgcattagtaggtgttgactttattttcttgcattgtggatgcagtagtataataacttcattggatttaattattgcggcatccttttctgcttgagacacctgctgaagctggaagtacatgctttcttattcctctcttttctccttatggtacaaggatgattatacttggtaaggaaatgttggttttctcatccaattcagataatctcgtttccatttgatcacacgtgcttcatacatcacatggatagtatgtatgaatcctaaaaagatctaattgaacatcgtcatttaattaatacatgtcggtcattttgcaacccttgttaacaataaccagactgatggattttctaccgccgtaaatttcaagtaaattttttgttatgatgttcaatttttcttgtcatgtgcggcggaaacataagtaggctggataaatagttttgtaatttttatgcctaaacatgttcaaacaaattgtttgtaatctaatgtatgcaactttgatgcttagctgttatgttaaatactgaatgtactataaaattatatattagatatgatttatatataaaattatatattatatatgatttagtccctctattttatttcattttagattctaaattgctaaatgcggaaactaaaacttcattttataagttgttggcttcagattaaacctagttgtttgtactgctgcaattataatatacagagattttttttttgtaagagtagtagaatttggtatagactaaacccacacgaacacgttgacgaattacgtgcttctcgcgaaaaaaaatcatatggctcatagagacggcccaaattcataatttctaggccgtgatttgtagaggttattgcaggaaaaaaaagagagaaatttttatataacattaaatgggatcgttacatgtagctgcatgcggatgtctttatttgcatctggtgtgatggggatataggctgcacctgggtgtcttcttgcatctggtattctggtggatggatgctttagaagcatatacgaacgatgtggtgcgccatccatcagtcgttttgctgcaaggatgcaatgcaacccacctatgcaagcagtaccgcgcttgccgctacaggagggagtattgtattgtggtggatactgtttgacagaggtttatcatcggaaaagaagtgaatttggatctagaatatacttgaattctccgaagtgtttgttatagcttc

SEQ ID NO: 3298 - DNA, 2450 bp, Zea mays
  misc_feature (1)..(100): optimal_loci_116108_G1, chr3:149555408..149557857, Cluster 20
ataaaccgcccctttttagcccacttgtgcatgtgtaggcttactacttgtgtactttttactagttctcgtcgaccaataatctaagtatccagtatacgacgacgtctttgcagtttgccaaatctacaccggactggtttggtttaaactgtaaaatcgggcttttcgtgctcgatttgtttgcactcctcgtctcatgtgctggattgtatttgacttgtcaattactaccacgctcgattcgtacgtctttctcgcagtctgtggctctgtgcggtcgtcgtctatacgttggcatgtcggcaaggcatctgcttcgagtagttagttatattggcatggagccgcatgtccttgggtgcagtttggttcaaaaaatgtaacgcaaatgataatagtaatggttttggcttgattactggcgataacaaatttgaataagttggtatcaaattgtactgtggtatctgattacggttgaacttaagcaaacatgatttaatgttatccgttacccattatattataaatatatgaaccaaaccgcaccttgattcactgggccagccacaccgccataggcattaggcataccgcatgtgacctctgctctgctctgctctgcgacgtagcacaagggaacaagaaacaggtcgcgagtcacgaggctgtcattgtctcgtctcgtctcgtctgcatggaaacggaactgcctcaaaaggctgcaatgcatggaaaccggcgagaaggttcacgcacgccacggtcagcctcaacctcgggagttcccctaaactaaacgaaaaaaaagagggcatggaccaatgcacggatcagcaccaccagcagcagcagaagatattccctttggtcaaatactgcagaggctcctagtacgaacgagcgctctctgcttttgctttcaccccaacccgactactccctgcatgtgtaatgtgtccagtgttccaacttccaaggacgtgccagtgctgctgccagactttataataataattaaaaattactagcatccatatcatatggttgggcaattgtatgatagcagcagtattaaccagcagcacggccggattgtcattaacgggaaagctgagtggattcggagcggggggtacccgtgaaaatgtaaccatgctcgcatcgcatcgcatgccggcagcgcaagaggtatggacgatgcctactgagatttgtgcaattcccctctggaggtataggtatgcaacgcaatgcaactggtgtgcaatttcccctgtcccagacgcaaattcctagttgtacttactagtcgtgcgtcaaaataaaaaaaaataaaaacgaaaaaagagatgacttctttttcctagcctcgggggactgggtcctcccaagaaattgcaaggctgacttccttccaccggtggatcttttggatgctgagagttgctgcgcagtttcaccgaacctgactccgcagacttgcttgcagctccaagctagtatggttctgatcattgagacagtcaatcggacttacctctattctgaatggagacagatttaagttcataccgaaaggaaggctggttaaagttggcaaccacacaaagaatggtgattgactgcaaaggaggaacaagtgcacaatacagaaagagcaagtatgcgaataaaagtgtacgtaatacctaaagaaagacaaaggtataataagataagtcgttttgttctaacgaggaatgaaggcgcaatggagcgtatgttcgaatttaggatagagtgtcataccattaagagggaggtctaattagacaacgcgatcatctagctagctgaaaacttggtgttggaatgtcatgcgttgcatattaagcgggacgcgagaaagcaagtggaaagatttatttaaaatactttttttaaaagaaacgctaactaggctctaacatgtttggcaaaatatttatttaagagctagctcgcttcaaaatattctcggtgcgaactttgacggacatgtccggtaaggaataagacacgacatggaatacgagcgtggctaaggtttagtatacagttcttcagccatatcagcatggtgttcagtgtgcaccgaacgaacggaacgggtggcatcggaatgagtctggcgtgaggcaccgactgttgtcccagtgtagctcaccgaacgtgtttgatgtggcagtggataccacagtggacatgaaactgaaaaggcctgtaaatttgcgtagctaaacgtttctgggtgacttgtttgtcggacgtctgacaaggttagtttttttatggacaacgcatattttttttatggacaacacatgttttttttatatggacagcacatatcttgtttctatttttaatgaacaaaaaaagaatattcatattattgttgcgattgcttcaagcgcaagaagaaa

SEQ ID NO: 3299 - DNA, 1410 bp, Zea mays
  misc_feature (1)..(100): optimal_loci_116502_G1, chr3:151935730..151937139, Cluster 20
gtgatctattaccaaccctacctagaacatgttacaattgatgaaccaataaatctacacgatggtaagaagtggattatatcattaaatgaaggtaaagtattggtttgtgttagaataataataagacaatctcaatataactatctaaaatcaattgccaatacacatgccggatcgacgactgtaggccttaaggtcgataggttagcagtttagcacgctagcgcacgacaactgtgggtctgtgtcatattggcccagttaagaattgtcctaaaaaagttttggtggcccagttaagtattgcagcgaattttcggcccataatatagataggcggttggctccaacgggtcccccggtggcatcgcctgctccaccactaatccgtaatcccatcaactacggctgcatgcaagtggaagcaggtaggtggtggacgaaccagcagttgcttttgacgtctctctcggcgccggcgaccgggaccataaaccacacgccgaattgccggtcgctcggctccggccccgccccgacgtccgctccggcggcaggctccacttcgatcggtggtctgcttcagcttcacggccagaaaaacggccactgatttcgccttcattttcccagcaaaaacggccactaattgcgtgtgagtgcagccttaagcgcagcactcctaggcgcctgacacctaaccgtcggttcctcgaactcgcgggagggcgtcgccgtcggggtcgggagcgagcacgcgcgagtgagggagacgacgaagtagatattctggtctcgcaagctaaagcgtgccactatcctttctaattgggccctatttgaaaacatccggtttttaagaaactggtttataaaaattgaggtgattccaaacatatcagtttatgtctcaatttataaaaattagattcacagttacttaaaaacgaagaagttaactttttctagcaaaaaaaattaaaaactggtattttaaaaactaggtacgtttaatattgttttaagttaaattgttttagatttcttcaagtttatattcagaaaaatatcaatccaaatataatacttctgagttatgacactacaataaataggtgcagcatgaaaatatatttcattatggatctaattaaacatatgtattccatttttttgtatttttttatttaaacatggtcaaattttagttattgggacttaagacaacttgagatactaagaaagtactgttttttttgcaagaatgtcatatggtctgtttggattagttaagactaattatatattacctacgataaaagatagtttaatttagtttggatcgacaaactaattattaactagcagttagttgaaggcggtttggctaaaaataatgtatctatt

SEQ ID NO: 3300 - DNA, 2480 bp, Zea mays
  misc_feature (1)..(100): optimal_loci_118813_G1, chr3:166007432..166009911, Cluster 20
acaaatgaataatttttagaaaatatgttgaaatcagtcaaatactacctgattggttgcctgagcatcacaggccaggcttgtgccatctaggtcagctagaaatggaagtttttgacatatgagcagatgcagtcaaataacctcaaaatgattttttttttgtattcattcgtgcaacccacgcttcaaatatagagacaaccaaataaaaacctaaataaagtcaatgcacgcaatggcgcaagatgagaaagtacgattaaccaatcacgcaaaaaatgaattattttgtatatactcgtacaattcacgattcaaatatataaacaaccaaataaagacttaaataaagtcaatacataccatgacttaagaccagaaagcacgactaaataatcggacgaatagctactaggctccggtcagagggacacgagaatagctcgtcaattcgtcatcgctcgatgctcgatgcctcgatctcggccactcggctgctctccacacacggccgggtgacaagtgacgctcccctccatcgcttccacttcgaaacatttcgaattcctcaacccccgaaagggcgaaaaccccaacgcctccaaaagtttcccgcccgagcccctcgaaccctagtaccatcaccgactggcgacgcctcgccggcggccggcgagatgcacatcaaggaggtaactctcgaggggttcaagtcgtacgcgggacggactgtggtgccggggttcgacccgctgttcaacgccatcaccgggctcaacggttccggcaagtccaacatcctcgactccatctgcttcgtgctcggcatcacagatctccgtcaggtacgcgctgcctcgctccaggagctcgtctacaagcaaggccaggccggggtcaccaaggctaccgtgtccatcgtcttcgacaattccgaccgctcccgctccccgctcggctacgaggactccccggagatcactgtcacgcgccaggttacacatcccttcgccgtcttcattacttcaagcggccttctgaagcgtacccttgctactgcatgtttgagttccttttgtgtgcgtgtgtgtgtgtgtgtgtgtgtgtgtgggggggggggggtaggtgatttggggtttgcgccacgattttgatttgcatatcctcaatttcggcgctgatgtgtcaagttggattaagatgctgccctgcgaactccgaagaggagctgctgcatgaggtggtttcaggtaaaaggagatggtgacttgcgatgtctggagctggaattttgaggaggttgtgtgatttcatccttcacgtctaagttgttgaatacttgaatttcttgatgccagggttcaattgtttgtatgttttttggtttttgtgaactggaatcgttttgtattttttgtacactgaagcgttggagatggcgattctgagtttgaattttgatatgaagtaccttttgtctcgttgctaaaaactgtagctaactgaggtttagtgtctgttaaatatgttgttccaagtgctcaactggatgtgttcatggaagtctgtaattactaatctgctatgcgtgctgaattaaatctgtgtctagcttgttgtttttcagtttttcagtcaaacacctagttgatgtgtatgaatctggggttcttttaaaatctgtactagatgacctacttttaatcagggattgcaaattgctatgaatgttgatgtgaaatgtgcctagaggatttttagtcaaatatacactgtttttttttgctaatctgtgtgtacctgactcattttaagtcaaacatttagttgatgtatatgaaactggagttctgttaatgggtgttctaacaactgattattttttcttaagagtaatcaggaactacaaagttgcttataatggtactggatttgttcatattttgttgatgctcaatctagcggacacatttttttagtcaaacaattcattgtaaatataagatgttttggcttttctagacacaccacttttgttatgtatctagatatagtgtatatctaagtgcatagcaaaaactacgtactaaaaaaaccaaacttcgtataatttaaaatggagggattactttgcttctcaatggtgtgtgtcgacgttttgtgcctagtgattcatgatattattcacagataaaattttgaaattattttaggtccatgagtttaattctactgaaatggtgctatttaggttgatgtggagtgaatatatatagctgagtgttgtgggccaaggcccattacaatggaggtatacacagagacgtaaacaacactctaacaacttgattaattcataaaatggctgatagatcggcttcactcatatgttctttgcactttgattctacctatttgtttcaaaacgttttgtgttgtttctggtgaaccaatttcgtcccaattttactgggcat

SEQ ID NO: 3301 - DNA, 1659 bp, Zea mays
  misc_feature (1)..(100): optimal_loci_119833_G1, chr3:172339173..172340831, Cluster 20
tataatcatacaaataataatttatattatcttttataatgacatgagcttgatgcaaacttagaacggtactttgcattatcttttataataacaaatattaatatattataaaataataatagttttaaattatctttcttaatggtagacgttgatgatttagataaaaaaagttgaagggttattttaaaccatcctttataatggtaaagatatgtatgtttcataaccataagagtgcgcaatttattacgggattattttaaattatatttcataacgatacatgtgggtgacttatagaagaatagggagttcttttgaatcctcttgtgtaatttagaggttggtaatttagatctaaaattaggaggttacactaggtttttcaatgatgataaaggctgttaattttttttataaattataataaatgtaatggttattatctcgagtttgttgaattaaaggctaaatgtttatttattattatagggatttctaggattattttcctaatgcatctcgtgtggtggctccgttagtgtctctaatgtattagtaaatgtcgtgaaacctaaccacctacactttgtttttttacccaacatttagttttttataaactgtttatcaacagtcggtagccaattcaaatattaccaaaatttgtgttatataagtatatatttaagctaccgaaatatgatgtctagttctcttcatttttttctaatgggacaggcacacttttatattttgtcagcactcgtataaaatttagtccgaaactttgggtatcaaaatcacattttaggagaagaaaaaaagagaataggagcttggtgacttgataccagtggatcatgaatcatcaggaaaaacacaggagggaagggagaataataggttctagatgggatatctatggatgaatggatcatgcatgtctgaaagcagagttacacagtaccatcactgactaatgcgcttacacgatataggcacttgcaagtggaatgcaaatctgtggtacggcacgaacgcaggtgtctagatgcaatgaatctttgtgtagggtgccctgtttgcgtcctgcagggaacagcctacagcgtagtatatataacagaagttttttttacggaggaaaggtctgcttttgtaacaaagcaattgtttacaaatatagaagaaaacgcaacgccgggctggggacaccatccaacgttaaagatcaaaaccaaagaaactctgtataatagaacttcaccgtggctgtattcattctgtccacacattctccaccttaagggctagtttagtaatcttatttttctaagaccttgtttatgtactctagtattcacttcaatccacatgtattgagcttgattggagtgtaaaaatttacactccaattaacctaaatacatgtggactgaagtgaatatgagagtacctaaacaagacctctgtgatttttattttctcaaataaaattagtttatttattttaccaaactaactctaagaataaggattttactttggacgaggattcgtcaagcattgacttttacttgattattaccacctgttgaaggtgcgcatgattactaggcatcgcagcaggttggataaaagcataagaac

SEQ ID NO: 3302 - DNA, 2597 bp, Zea mays
  misc_feature (1)..(100): optimal_loci_1217_G1, chr1:6213724..6216320, Cluster 20
ggccggataaaactctgagataaatatattaagtgagatctagttttaaagtttccgtcgtgacgaacacaatggtggaattggttttcaatttcgacactcggattagtagatattattatttttaaatgaaacatgaatcatgcatgaagtcattttttgagaaagtggttggagcgtttatttagtgcagcattgcaacgggctaacgacacacaaaatatttgacaaatgttagcacccttatggttatttgtctgtatgttcaatggtacatctggagaagaagcatgaaaagaagcggatgagagagaatgaaattgggacgaatgcaagtgcaatgtacaaaaatatataatatgtataacgaccagaatgcaaaatggtagcatatcccatattatcataaaaataatggacacattggaatcctgaagaaaacataaggggcgtgttagtattttattaacagacaaatcaaattcaatcagtacatgcaacaaattcaatctcaaatgaataaaaagtgaaacgacatacgcacaatttcatataaaaagtgaaacgagtcaacagttgttccagtttcaatcagtacatgcacgggcactgaagtaaacaacttaatcaccttcaggtatgagacgactatgcacaaaaccactcatcaattgtttatagtaactatcatctccttgtgacaagcttcatggtattatataatataataaagtgtggcaacctcttgataagtacaggtcaaactcgaccatgcatttgccctgcaaagaaggccaggatagttctctgtgcagttgtcttactccaatatctattagaggtcttcttggtgatttaagaaatgtttctggaagggaaaaatcttatctgcattgcaaagagctttaatagtgtacttccacaatttaccatgcagttttgttgtgtaaaacccttaaagaagatataatatcaagtacataaatcattttttcaaattaaatatgtgtttctccttgatatttgatcaaaccttttctaaagaagatgataaaaaaccagtaaaaaaggtattgattaaaaattcatgatcattcaaggaagaaaaatacaatagagaaagcatgcccagtcatggcaagcaacaaagaaatgatcagctccttttgtcctattccaatatgggtacatggtcgagataatgttggtgtgggttttaacaaagatggacaatggctcaattgtatttgagccaggtacataaaggttatgctctagttgtcgagagctatatgtaagattgaataaatgggctctatttggatctctcacaacaaaattctggtttgtctccatcaatttcataaaccatccctcagacacataaatacctttcaactctggggaatggaaaatagggttttctccatcatgatatatgaaaaccttaagaagtctctccataagttcataactcctgaaagcatgagtcgaaaaaatttaataaatcaaccactgaaatgaaacaaccaattcacatcagagttcaacacataacaacagtatgataagttagaaaacacagtatgtcatattaggaacataagttatcattgtagcttcctttttattaggaactgctcacatgctactgatcatccaatgtcatccaaaattagttctttttttcgaagagaacgataaacaagaatgttgttaaacacatgattatgcacttcttttttttggaaaagaatcatgtaacataccaatcgaaagagagacaatatgaagcctaaccaattccttaccttttaaaaatggacacattctggaacaagggtgcataaagatcaaggtcgtctaagatcaatggtgcattagtgatctctttctttgcatatataagttcttcatcagctatcgttgaccaaagaggcacctgctaaattatcaaggtaagaggagtgttattaccattttgactcctaaatcctaataataagcattgaaaccacatcctaaaagatgtgaagcatcaacctctggcattaagacatatttggtatccatgacatattctccattgacatcagagctcattgtaggcaaacaactataaatgtaggcttcacgggtaaggaggttataaaaataaatatgtaagttgctacagggaaatttcacccatgtttagttagatatgtacctcttatttgagaaaaggagctgattcttttggtggatttatctgaagtgtcattagaagtattgagaaaacacgatttcctaactgcattaagttgaaacaaacatggcatgcaaaaaagaaatagatatagtgatatgtcaacttttctaatatatcatcgaactcataaattatagacatataattataaacatcatcggggagccaaaacgagagtgacaaaataacaaatttctccctccgggcagagcagaacgtcgctgtggcccacctacacgctcgcccgtggtggcctacccgcacgcgaacctggcggcgacgttgaaggccgcccacgcgtgcgtgcgctggctcgacagtggcttagctgggccgacgcggccgc

SEQ ID NO: 3303 - DNA, 1464 bp, Zea mays
  misc_feature (1)..(100): optimal_loci_124985_G1, chr3:200695018..200696481, Cluster 20
gttctaagagcttgtacctaaactactacaatagtaacatcattcctgtacactgatattatacatatatactaattaattgctcgtgcgttaccacgatttctatatatcatatgagtagacttaattaataagacacaaatatatactatgttctattggttagctgggtgtgaatgtggagccaacaatcaagattcaaacctcatttgtgcataattttacttcatttttgcactacacgtgaaggacacgggatgaacgttaaaactagtactttatatagtagagacaattagtaactaaaatatgtgtatggtcatgatatagtcgagatctaggactaccgaaaggaacaaaagaattgaaattttggttataaaatttccgttcgtttgagtacgggtgtttgggtccctgactaacgtgttctattgaatgttatatgtattaaatataggcttaattaagtttaataaatttgtctcctcttttaatcttcaactgtataattagttttataattagattatatttaatatatataatttaaatatttgacgtggtaatgactaaactttagcgggtgaaaatgctagttcccggatccataccagaatgcacaaaaaaaacctaggccatttcacttttcattattcgtacacccttcccggtatccgtgcaggcacatgtgtcttgtttttctgtcgcggtctcgccggttgctgccgccgtgccgttgccggtacgccgagccgtcgaggcctggaggccccgcgtatcgatagccatgtgctggacacgaagtggagagcgagcttcgtgaccgcggcttcgttgcgtccacgagcagatcgagggggggaatttcgcccggggccgtcgggccgccgcctggagacagcactgctctcgtgctcgatcgacgatcgcggtcgcggactcacggccgccctcgccccgctgcggaggaatctttgctgggcgacgggccttcgcgttggcgcgcgtttcctgaaacatgcatctgcccgtccacgagctccgaggcggcgaggccgggtttttttgcgctctacgactaggcccaaaagtgtttaataataagtgacctagattacgtcatgtcagattttttttgaaagaaaaagaaagaaagtgggctaaagtggactgcttctcagactccaaaacattttacaggacgaagagattggaataaaaaaattaaatgtatagcttatattatagcctttcaattagacatatatatgacatatcaacatcataaagtccactataaattatattattaaatttggtcgtagagcaataaatacagccagccgttggctataaagatttatttcatccatatagtagttaacgttttattattaatataagactctgcttgtgtattttacatagtttggttcgtgactaaatgtgtcacactttatc

SEQ ID NO: 3304 - DNA, 1737 bp, Zea mays
  misc_feature (1)..(100): optimal_loci_125246_G1, chr3:202051600..202053336, Cluster 20
ctctctatgcttttcttttcaccagatctacatggcacgacaagctgcaagaaaagctatgttttcaaccaaacaatgctctttctggagcttttcatagaaataaggagggaactatttttagataagctagagtcagggttggagctagcagagaaagagccataccacagaggtatttcagacagacagatagacatattagtaggtacatacatatatgttcattccaccttattcctgaattataatctatttagattttttagagagttaaaacgttttagatttgtccgaatttatataacgaaataatataatttaggtcaaattttgctatggggcaccggagaaatatagaattgatccgttcacatcgtgagcaccgttacgaatttggttcattacagtacagaaaaacaccacactgattattttatgtatttctcctgttttagatagaaggttggggtaatgtcttatttgccctcgtcttcgatgctgaacacttggactgtttactaaatgtttttttaccaaacatcagtcaagtgaaactttcactatatgtagacggtggcttacaagaggagtaaaagaatgataacgcgtctccatttacagaattgtaatcacaaactcaacaataatttcttatataactttagttaaacttaagatgttttaactctgaaaaaacagcggagagaacacgtagatatacagatgggcgcaacacaattcgtccttgagcagacagttcaaccgtcaaggcccaccaccatattccctctcctcaccaaactggggcgattgagatgccgcatgtaactacaaacattagctattgattactcggccccattcctaattgtggattggatgcgggcacattcggatcctgtcacatggagctggtgctcattgcgctttcggcaagaaaaaggtgagatatatatatgtgacaccacaaattgtcatgaatttctttttctcggtcatgcatcacacgcaaggggaagcgtgcatgtgtttaacatcggtttcatcacacacatgaataacggttactacgtttgcggttgcaaacaattttgaccgtggcaagaaaacgtaacagaccgagaaaaccgatcaacaggtcagttaggcttatgttgatttcgttcttcaactagtagactctcgcacacacttcttaaaagaaaaaaaactgccgagaagaagcacgtagaggttgttctaggattaacaaaaccaccctaaaataacatcaaatcttaccaaaagacatgtgacaacaatatataagatagagagaattttggaaaattttgtgactaattaaactacgcctagctgagaaagacactgcacgcaggcgcattcggatcctgtcacgtgaagttgatgtgcaagtgcggcaatgcactttcggcaagcaaaagttgacagcggctgaagaataatagtggtgcgattatatgattatcgttgttgttattcaaaaagagcactagctcccatcacgtttgcgtatctctccaacaacaagggatcgtagtagtcgtagcacgcaaatagtttgcatattgaccaaaaacgagtctcgctagcaatttggcatatatttatcggtagttgttcagttgacgacttgatgtttttgttacaaattataattcgcatcgatatatcgtgtaaataaggggtcacgagtatgtgtattgtagagta

SEQ ID NO: 3305 - DNA, 3034 bp, Zea mays
  misc_feature (1)..(100): optimal_loci_126434_G1, chr3:207543816..207546849, Cluster 20
agatattctttcttatttactgtagttataaaaacctattaattagtagacctttatttagaccttcactcagacattacattagccccattcagatattgtgctgtgtccgcccccacgtggacgtaccgtaggagtagcacggtaacatttgaaatggcgtttatttttttacccctatgtgacctgacgacagttaaaaaccgtctttctaaggccgtggagtcatgcgtggcggagcggtaagttttgatgctcccggcccaagatcattgcggcgtgcagggcctggactctggcgaggaacacaaacaagcccacccaaccgtttctggcattgtccttgtcacctgccttaatcctcatgttgacacaaacttctaacttacggaaacgcaaattaaaaaaacatacggaattgcacggtagttctcacatggatgcagatctctgcgaagtatcgccatcaagcaagcaccattcgtcgacacccatatagtacatcttttctaaattccacatatatatagtacatcttttctttagataaaagcaataggatgtggcttcaaatcccttttaaaagaaggagtcggtccaaccctatacaaatcaactaggaaataccaatcgtccaaacattattaaccaatacgaaatctcaaagtaatccttggaatgcgaaaggctccattgctctggtttctaagcgatggcacggcgaaactaaccaatccctatgatggtcaccggtgcgcggtaacaatgaaaccagtgtgtgtccctttgaaaagtacaactggaaagaataatttgtgtttggccagatgattggcattctgagaaattttgatgcctgatataaaaaacgagaacataattcggtcgcacgcagataagactgatctgtgtcacatgccatcattcgtcgtctgcatgattcgacgcgttcaccggcctcgctcgcttgcggtttggcacaaggtagtggaggccaggccactgtggcttcgctggttgtctatagcacaggaacactagtggggtgctccatgatattccgaagcatcttttctcagtagctttgatctgctgcctgctgtgtgtttatcccttttgaacagcaggggctggtagtgtctgctcatcggtctgcgactttaaaatatcttctcttccatacttgctgacacttcgcttccttctgaagacgtggaagtgaaaaagtctgtcgcgataaattccatgcgattttttttttggaaaacaacgtctttttttgttttgaaacggaaaagtaacgccttattattagttcttgcccatttgttaaaaaaaatatagcgatactttaatcgaaagatatatatacttatatagtgatgactggtgagccatgagtggattagtgcagccgttgctgtttcgttagcttttgtgtacatgtcgggctcgcctttgctgtcactgttcgggaaaacttagaagcaatgccttgtgaccagattatgacgacctcgacgtctctttttttcacttaattctgcactgtcgtttattattcttctttttttgtgcgacttttcgacgtactgtcgattaaaagacgagaaggccaccggagaccacgcaacaacactagtttttttcccgttcaattttcttgagagcggcagccattaaattttgtacaaaaggagaacacttggtagaagtagcacctaactcatttgacttgacgatccttgatgggtgtccacaagcgtctttcatctccacacgttcccgttgctatttcaatagaactttaattgcatcgagattaaatttaattagatcacgaagaagtttacctcgatacaggcacatgtgcgatatattgcttaattcaaaatcatttgctaagcatataggatacacatagctgcacaacaatacccaaaagctgtaagttgagatgatctctgttatatcatatggaacagctagaagccaacaaaagcattggcatgtaggttgttcgatgtatactatacttatgctccgtttagatgtctatattggaagacatagaattgaattgggtttaataccaaattagccatggtattgaaatgagatgcaattctaattatattgtttggacgttagtgaattatagttggatttgtgtggtcaaattccacataataaagaggagtgatgctctatattgggaaatgaagtctctaattatactccaattccataaaattgtgtctctgattccaaatcttaattctatgtacaaccaaccaaataatagaattctagaaaggtgattccaattcataatttcgttctccaatatctatacccaaacagggtattataggaaatataaaactatctttctgacatgcatgattaatctcaacttactgataagagagagacgtattattgataagataataatataaggaaaaagagggattgtcggatacaaaacacctgagggaacacgaagagcaagagagaggtttccgaggcgagaccgggggggggggggggggggggctaggaagctaaatagaaactaaaatatgattgaaaataattaagtgttataatgagtgaaataaaaatatacttttaataaaaatatttaaaatggaattgtaaatttgatttattaacgaagagatgctacaaataggaaataaaatgtgattaaaaataattaatccaatatattgaattattgattaaggcaacttttctaaaccaagcgcatcctgagggtatcgttgtgttggcagtgactaagatcatatttattttccttctaaactatataagttagattatggtataaaagtgaccgaataaaatatcactttgtgatggcaaataaactgaaataagctatccaatgttagtttatttcaacttatttatggttataaagtaatattttactcttatatttttttttactataattcaacttatataatctagagaaaaacaaacaactatgtctagttacaat

SEQ ID NO: 3306 - DNA, 2382 bp, Zea mays
  misc_feature (1)..(100): optimal_loci_126699_G1, chr3:208895335..208897716, Cluster 20
tatatattttcttaaactgaataataaaacgattaaaataagtacaacaatcaatataaatatcaatctatgaatataccacaataacattgcataaaaatgttttaattagcgtatgcattccaaaccctaggttaaattgctcgagacgacatagtatatatactcggagaaagaaatacttatagccaactaaaaacctatgtttagctttgttaattgaaacaactatgtattaacctctacactagtgttatgattgagataggttaaatccacaccaaggttgagcaatattgatacttatgaagatgatgagaggtggccaaaatataaacttaatttaaagcaagcaaagaaacccaaaagaatattagagtccaagataaacattggcgaaagctttaccttagacaaaatattgttatcgccctcttgattaggtataatatgttggaaaatacaatctaaatttattttaaaagacctttctcaaccggtctcttaacactaatagtaaaaaacaccactaatagttgtatctattaaaacaataagaccatattgagaattgggtcaaatatttgtactttatactctatcaatcatggataagtaaatccccttgattcaagtcatgttgctccttccaacactattgtaagttaccagctaatgacactcttaacactttctcgttgttttttgggtttcatctttagtggcttggtgttctttattaatcaaacgtagcctcgctataatttaaggatcatgaacaattcgatagtcattagatagatacaccacccctttagctcctgaaaagtcaagtctaaccaatttcttgcacttccattgttttgacacaactagactcatctcttgagtgaatttaatttagaatggatttattttgttcattttttattcgataaacactcacttatgtttgaatcaactctccctttgtcaattatgttagctaacaatgccttttgttcttgtaaaattctagccataatctaagattcgaatgcatttgaccttctagcaactttttaacataataattgccaaatttgtttgtccaaaaaatataagctatgtaggttaagctattagcaaactgccactcaatgctttcaggttcatatggcaataaaacatcaacaccaatcatactttacaattgactaattcggccatgactagaagataaagctaaaacaaatcaagagacacctataaaaattctgctactacatctttgttgattcactataattaccagtaagatgtgaagacaaatcatgagtattagtactagcataccccactgaatttttattgatttctttgtatttattagtaataacatagaaagctaaatcatgagttataacactagtatgcactgccgagtttccatgaattcgactatagctattagtaatataggaagtcaaattatgtcaattaacacttgaatgacttgctaaaattgtagtagttcgcccatagttatgagcaacatatgaggttgaatcatgagcattagacttgaatgccttactaattatttactgaatttttattgatttggctaatcatttcaagcgtatggagattaatcattaccattatccctgaatactttgctggaatttcaataatctagtcatagttattagtaatatatgaggcaaaattataagcttatgtatttaatatgatactgaatttgtaggttgaacctttattttattagcatattgtgcatcacatgaaacttgagagtaattggcagaatagttagtattaccatagccaattctctcattcatcgacacatattatggtggaagcacacattatgaagttatagtcgatggataaggttatgtatgttgtatgttgctagtagcattaaaccccaaataattaatagttgataataactcttgaacataatacccaacattgtgatgcatatgatgaagaatattatctacataataattattcaatgcaaagtacctaatattattatgactagcaaaatcaacatgagaattcatatgcaaaataattattagattcctatgatgaatttgcaagctacgccttgggttatttgtagtagtattgtgtgatgaaccacattggtactccatgatgtagaacttgactactttgctgaatttttcaataacaagagcaacatgttacaaaacaacaagcaagatcacgtgatttcaaaccagatgtgataggccttttggggtcagatgcaacaatattaacgagtataagaagatagaccaataaagaatatagctaggacaaagaaattcggctacaaagtagagtcaaagcaat

SEQ ID NO: 3307 - DNA, 1711 bp, Zea mays
  misc_feature (1)..(100): optimal_loci_127248_G1, chr3:211735175..211736885, Cluster 20
tcataagttgcagaacacgaacgccagataaacatcgatagcagaaatgaattgtcagaaaaatacagatattacattattctacgagggtgggtcaaagcaacttgcctctatactagagtagtttatgattcttctagtgtagaccaaaaaataatcctagaagtaagcttttaaaattccaattcacttccccccctctcggggctaggagcctaggacccatgtgtcccctctacatgattaaagattacatatttagaaacagtccataaatgattttaggttctttcatagaaaggacattaggtcaaaacttgttaatacatggtacatcatgtaataaactagaaaccatgatttaggagtagctaattcaattttattgtcgtttggctaacagtagcgcacaggccattgttccctcaccctggcttactaggatgttgacaacttcctctattctaaattataaggattttttgatataatggttttctatgcatatagacatagtatatatttaaatacatagaaacaatcatgaattttaaaaggttaaattattttgtaatttagaatggagggtgtagctaattatactgaatcttaggaaaatcatactgaatatcaaggggtactgtaaactgttatgccttacagtctggtatttgggagttgggactgaactctaagaaggttgtctgtagtgtctatttcaagtttaaatttacagcttaattcaaatcttaatcaatgaataatattggtaggagaatgcttgaccataatactgaaaaaagtttcagaaggctcaagacacaaggacatggagaccttgttctgtgtctacactatagggttatatattctttctaataaccgagttatgtggaataaatcaagtgcggagttatctgaaacaaatagatgagtaagtaatcactatcactaagctaatttacagttcctgatttaactctaaaattacatcttactacagtcttaatcagcaaagaatactgccagagtaatacttattggtcacaatgatgaaaagagttccaaatgcctcaagacacgataacatggagaccttatgcacatgtctgcaatttggagttttctagcctttgtgactcttgaaatattttgaatatgaatcgatacgaagttatatacgaatattatatgagacggtaaattagtatcacaaaacaatccaactaaacagacaagtacaagctgatcatattcaaattactattgcagatacccaagatttaagctgtttggagggcaactcaaaggaatagagatgataaacacgattaaaaggctgacagatagttgtttttttctgtaacgataaggttactccatgactccatgtaatccatttacattacatttcggcgagccaaacaccacctaaaaattctacttaaaaggacgtcggtcttatatttctagtctgaatttacaacttatcccaagtacttaaagcacctatagtaataatctactccctctattccaaatacaaagtcgttcttgttttttagatacattatttttattatatttatagacataatgtatatctagttatataacaaaagttgtgtatctagaaaagtcggacttacaattttgaatatgggaagcaataatagaactgtatatttatcatctaacactgaattgtaat

SEQ ID NO: 3308 - DNA, 3019 bp, Zea mays
  misc_feature (1)..(100): optimal_loci_132840_G1, chr4:6628398..6631416, Cluster 20
agaccatccaacatcctaacatttgaaaaacctataatgattggttcaggagggatactgtaagggttggtggacttagggttgttgtagggtcactagggctatttagagcacatcaaataatcattatagatgcataaatcagaagggcacaaaaataaagtcttatattttatgtgggaagctacctccatctatatttcgtataaagctattacccattaaacgtctatagatgggcatataaataaagtcttatattttatgtgggaagctatctccatctatatttcgtataaagctaatacccattgaatgtctatcgcaatatgtagaccatctacatcaccccactaactttccacatcatctccactaatagttatgttactccactaacttccaaaatcttaatgcaaattatccatgtcatccccacttaatttatatatcttatgaagctaatgcccactataaatctatatcaacatgtgggccatccacaccatcctccactagcacatgaaagttggaccacctaacatcatgggatttgcgaaaaaacctacaatcaccaattcaggagggatcctgttagggtttatgcaaggctacttagaacacatcaaacagtacttataggcatataaatcattattacataaaaatgatgtcttaagttttctatgagaagctatatatatatatatatcttataaagctaatacccactactagtctatctcaacatgtagactatccacatcatccaccactaattttcaacatcatctccattaatatttatgtcaaccaactaacttccaacatcttagtgcaagctatccatgtaatctccacttaatttatatttcatacaaagctgatatcccactacaagtctatctcaacatgtaggccatccacatcatcctccactagctcatgaaagctaaccttgttgtatcactactagacggatcaacaaaatggacacattggtttcaaagaagttagggagtacatgtcacaaaataagaccatacttactagcaagacggaagcaacaatgaacaaggtcaacatttagtggtctattctttgcatcaaattagtctttcaaacttttgatccatgtaacaagttatgccacttgatctaccatattctagtttttgcggaaaacaaaacctaggaaaaagagaactatctactctgtctctgatagtagctgctacactcaaattttataaatatgatggcgtggatcatgcagatgttggatctacgggagctacacaacaaagagatgtagagatttattgtgaattcacctcataacaacaactaccttagttatatatattaatttcttgtacatgttgccatctcaagctatctgtctttgcattacattgtggcatcatgttggtccgttttatgttttactactaagtgaaaatgagttattgtataatctcctattaaaagtattgattgttcgatggccattctctattgtttgtcatttgatcaaaacatggaaaagacatgacatttaaaaatatgatgcatggatacttaaaactaacacgaaaggttaaaaatccttagtgtgtgaaacataattcactatatctggaagagtttacaagtcaagtgtgttccagaagataacttgaacttcttttgacttttatactttcccctttttcatttttaattccatggtcctgtagataggacaaatgaatgggggaactagatttcactctgaagttaactaactattgcacaacaataaattatagtcaataaaacttatgtgctatgaggtgcacatcactaatgcattagtaggtaacatagagttgatgcttgtacatgacgacttgtggatgaggttatattatagtgccatgaataatattggtgacacaaaacataaaacacaccaaagtgctacatttttggattgtagatcaataaggttgcaatgagctcatgaaagctggaccatccaacatcctagcatttgccataaaacctataatcattggttcagaagggatattataagggttggtgcacttacggttgttttagggtcaacatggttatttagaatgcgtcaaataatcattatagatgcataaattggaagggcacaaaaataaagtcttacattttctgtgggaagctatctatatctatctctcttataaagctaaaacccaatataagtctatcttaatatgcatgccatcctcattaccccactaacttcaacatcatctccactaatagttatgctaccccactaacttccaacatcttaatgcaagctatccacatcatctccacttataatttatatatcttataaagctaatgcacactataagtctatctcaacatgcaggccatatacatcatcctccactagcacatgaaagctggaccatcttatatgcactactagacaatctaacatcttgagattttttaaaaaaaatctataatcactggtttagggataccattagggttggtgcacttagggttgttgtaaggccagcaaggctacttcgaacgcctcaagtaatccttataggtgcataaattattacggcttaaaaaataaagtgttatattttttatgagaatatatctatatccatctctcttataaagctaatatgcactacaagtctatctcaacatgtaggctgtccacatcatcgaccacaaattttcgacatcatctccaataatagtcatgtcacttcactaacttccaacatattaatgcaagctatccacataaccttccattattttacatttcatacaaagctaacatcccactacaagtctatttcaacatgtaggccatccacatcacctgcactagctcatgaaagctagaccatgttgtatcactactagaccatctaggattgtatgttttcccaaaaaaatatacaacaaatggttcataaggggtatcactagggtt

SEQ ID NO: 3309 - DNA, 2043 bp, Zea mays
  misc_feature (1)..(100): optimal_loci_132947_G1, chr4:7010486..7012528, Cluster 20
ccccactatttctcttcaagatgcatcgtgctcgcctaaagcgcgagaacagttttgtgcacgacatggcggtgactacacacacctggcgcaacgacttgtttgctgagtatggggtggaagccccacctatcccacgtagcttttattttaagttttgatccgatgatagatctatgctcttgttggttttgctacctgtacttcttggttttgctctgagtcttggttttcttgaggaactctccaggttttgctaagatctttctcaccctccttatcattgctgaataatgaaactgtactcagccaccgaatgaatgagcagtgactcattagaccatcatcacattgtccgttaaatgagttccttgatgtatgtatagacaactggttcttctccgaataatacaggagagatcatagtttagtggtgctatcaagaatcaactcaacaattataacaaatgtcagtctgtcatttcgaacaaccaaaaaagttgcgacattagtgcagcaccaatcctctctttagcgtgtgtatgtctttgtgctcgccgcggtcttctccattcgccgccgctgaccgtgtcaagccagggaacgcctggatccaacaacaactaccccagggccatatgctgtaacattgtgtctgacagccagattgaaaaggtcgatgccgtcctgaatcagaataagtgctagctgcaatggttgtagagatgcatttcctttgaaatgtcccatcaaaagtaaacaacaccctcaaaatctctcgggtgccttttggattgttgatgttgcccgacatgtctaggcttgaagaattcctaagattaaactagtgcaggataacagtccatatcagtttagtgaagagtcacactttaccaagatgcttctggatacggtatgcacaagcgacaaataggattattcagaagcatgtttgaaaatttcttaatattccaagggtggaatacacttatcgaccagaacttagcagattacccaaagtttacacatatgtatagactgtactgttcgcaaattacggtttaaatataggtacgagaatgagtaatctgagatttatggattgccgtttaggctgttgggtaagaaaaatcttttcatgtttcttttcgcatatatcgcatatatgcaaggcaaacaatagagagtgcatgatagaagttcagtaacccatcaattcagtttgtcctccatttgtcgcgcactgccgtatggtgaagttcaagggagctgcaagcttttactcagcaattgagtagcatccgtacatgaggacagacgaacagggattgcactgcaaaaacagagtgccatacgtgacaactaccctatcttatcccgtattttaaactttactttgtaaacagtgttatctaccatacaaatcccctattttacgcgatctgctataatagaggtcgcttttgtgctggtagcacatacataggtgtatcatgtcccaaattgtttttcctttgatttctggactcgagtacaaaatagtagccggaagatgtaaatggaacatgtacaaagttcaaatttaacatttgtactagcgtggcaaagttggataatggaggcacgtgatgcattgaaggcctctatttggtaatacaatactagttagccaggatccacattttataatggactaatgttagctttctttatataggacaaaatcagatgaaaactgttctctgaaaaatagtacagtagagtatgtcgataacttgtgtgtttccttataatcaaagtcactggcatagcagagtttcagagatccatgtgttttattgaaggtagcgtataatctttgttcatgcattcagagatccatgtgttttattggaggtagcatacaaatacaatctttgttcatgcattgataactacagtctgaatagagaccctaaaacaaaactgacaagtaaaatatttgatggccacattggtttatatgagtttttgtttgccttggacaaacagactgtttctttg

SEQ ID NO: 3310 - DNA, 1507 bp, Zea mays
  misc_feature (1)..(100): optimal_loci_135413_G1, chr4:18570184..18571690, Cluster 20
aaattatctacaccatgcattagaatcgcacatcattgattaaagagagaaagcacagttgataaaatgtcatctcttgatggagagtaaagtgcaagaaaaaacaaaggaagaaagaaaatactatgctgaaattttgatgatacatctgttgttagttcattaatgaacaacaaaactagatatagcatcaaggaagaatgaatcacaatcacttggttggcgtacattggttgaccaccacaaattaccaatatcagaaactctcgtttaatatggaaattacagataatgtacttggttggtctacattggttgtaggaaacagtagataacattcaggaaggttaaatactaaaaataatctgaccacaacatttgctgataatcacaagttgtcaattgtgatcggaaaaaaaaaactatggctggatgaactgacaatgttccttgcataatgcatctaatgacatttatatgactgaaccacatctcaacaaacagaatagcttgaatcataattaaataaatgtaaactttaaaggcccattggcccaacaaagttacttaacctcaattcacaaaatgtggcttgtcagtttagttacttcacctcaattcacaaaatggacagttttgatcatcaaaattgacctagctgtgaaagttcatctgaatataagcaaacataataataatcagctcttattctattcaagatcaggcttcacatgaaaattgtattaaccaaacgaaaaataccaaatgttctgctacattaaatggctaatgagttagccccatgaagttaacagatggtagggcctcagaaaattctgatgaatactaaagtgacaaaaacatgacagactaatctacataggaaatggttcaaggcttcaagcaggttttacatgataggttcagtattgtgaccgttaattttcagaatttaacacaaggtaaaattactagtaactgccacagccttcattgagcaaaccatggcaccatgctaacacaaacgtctgcatctcaatagatttgacaaagttgcaagttatatgtaaagaaatagtctatacgctagtaccaattcttacagacaatgatatgctcccagaaacattaccactagatggttgcacctcacctatcatccccatatcgtaagtgatttgctcttgaaaaatgcaatgagctagcaattcatttccatatattattaacggcacgtccctaccacatgtctcacaattattaaaacttgattggtacaaaagcccgataaactaaacaaatcatcgttagcatagaaatagaaccataattagcaactacaaattacagcaaagaagatgaatatgattttgctacaatgcattgagagttgatcatttagctgcagcagagtcatatagtagtatgtcactaaaaaaaacctgcagctgataatagtttcacggagtggtggcaggatgccactgaggctgctaatgtttcagca

SEQ ID NO: 3311 - DNA, 1442 bp, Zea mays
  misc_feature (1)..(100): optimal_loci_1382_G1, chr1:7304181..7305622, Cluster 20
  modified_base (1007)..(1007): a, c, g, or t
  misc_feature (1007)..(1106): n is a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
ggaatacaattgttagcctcttaggggcttgtttggttagaagtggattaaagaaaaattagtttattttctcctaatatcctccaatccactttaatcctcctaactaaacaagcccttaatgtcgaaatacttgataaatatttcagttccaagcatgttatcttttgaatacaaaatattataaacatttgtgtcttcaaatatgtttgttacaaaatattttacaattagattcttattcggtatcatttacgctagtacttttgttttggatatatcaatttgttagtttgtgtcacacttgcacttaagggtggcgtccttgcatctatttgacctttgtcgacattcttgaaggagggtaaggagagcacttttagggcgtgtttgggagaaggggacttgagggaattgagagggctaaaatatctttctattcaatatccccttgctcccaaacaagccatttagtgcctttggttttgcttggagaaagatcaagaccacaactattgatcctaagaagtcatgcactcatgttccttttaagagttgtgaccaagaagaggtttgagaaggtgtcacatgagttatatgccacttcgcttgacagctggtggtgtgggtaggagaggtcgtcgtcatatagctcaatgagatcttgcacaggagtcctcttgctctctttgccttcttctaggcagtaggcacctctttttccttcggagtcgctttattagctaggtcttgctctgatttttgctaggccaagagcaaggatgttagaagagtcggaggaaataattatggctattgattgatgtagggattacaatatttaggccaatggtttccctaatcttaatatgtctaataagctatacatgggctaggttaggctagactcatgatacacacaactacacatactaaacacaatcataacacatatattagttgtataacatcccctgtagttgagactctagctacgaattgatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggattctagagaattcgtctttgttgtcgagagttatttcactatgatataagactacaaaaggaggaagggcctggcggacactgcccacaatcatggaccccagaagcccaatctccttggcgttgagtgccctggctggacttgtgatcctagtgagcgggctatatgccctatggagaagctcgcgaccttccctcccctctatggcgggcgaaattatcttctccccctataccgcaccatgacaccatgggctcccactcctgcctccaatatctgaggttgttcccaaggaacatgacctaccctcaggtgtactatggcctatcc

SEQ ID NO: 3312 - DNA, 2682 bp, Zea mays
  misc_feature (1)..(100): optimal_loci_138993_G1, chr4:39334737..39337418, Cluster 20
aactccacacgcacgttgctgaaacaagcagctaacttttgtttccttgataccactctgacttgcattgtgttgccttgcctctacaattttcttgtcagcatgggcggtagacgaatggatggatggatacaatacaactgaggggtgggagagcttgaagagcaggtcaagaagatgcggtgagctaataagaactagtcccttgcttgcttgtttaatttcccttctctgcatgcaaatgcttcaagaaatctagaactagcatggtacgtactacttccttgttccttccacaggccggctactacctaacctgctggccattttttttctctcttatgtagcaagcatgcaggctatctattacctactaccattaggatgtgaccctcttaataagctggaaaatcatgtcaagaccttccctttaatgcctctgtcatcttacgccaccattattattgctccctcttttttttttgcaggtaaccgaattttcgctccagttgttgaatttcatttagactgcataaaaacgttcctacctgctgtctgttcctcttccgatccggcgttgtactgcagaccttgtcttgcttctagaggttgtactactactagtgcatgcccttctgtttggtgcatatatatatatacatgaggaaaaggtgtgggtgattgatggatagatttcagtttgatgatggatccattttgcttttctttctttctttctttctttcttcatgtgctgacaggacaggtgccaataaggcttagataacaagctgctaattggggtgcacaaaccagggacttggcaggccacctaactagctagctgctagagatttttctgtcacctcgttcccacaattaatgtatctgaaaagcaacaaaagtgttgtttctgaacacgcaggagatcgaaggaaacactgatgagatcacgagcatgcaatgcatgcatggggcatatgtcgaaggaaacaacgtgcattacatcagattccatgcgtcctagaacagttactgtgaccactgaaattttgcctattaccttatttcttaccgtaaacgttctaaccacttctatgccgctcggatacaatttattacctttctatgtcatcgtcagtggtctagaagactagaagggtaaaaaaagctacatatcttaatcccttctatgtcccgatgatgagtgattaagacaattgaggtgataaataagataaatactgagcaaaattatagtgacatacatgaaattgtgccatatattatggatgtttcaggtgtttggtgtaactttaatatcagcttattaattgtggtatgaaatactatggatgttttaggtagctatatattatggtatattataattttctatgcatacagttatatatttggttcatatgtatgtgaacttgcagagatggatcttcgttcgtgcatgcatgtgggcttggtcagttggtctagcactctagctagcaggtaaatgttgtagtcatgactgcagttacgcatcgatcagtttaatataaaaacttacgttgaaaagagaccgaacaataattcacttgtattattctaaagacagttaataagaaaacggcagcacttgcaaattactacgtatactgcttgctcttactgatcatatccatgagcagcagatatgcatgcatatgcgattgtcaactaatctaattagctagtacatacgtgcaaagcacgcacatttcatgtcgttgtcgtccgcttctcatcagggtcgtcgcttccaagttccagctccaatctagaattaccaagtcatttttaattttttttggggggcttgcctacgataaacatgtatacatgcatgtcaatgtcagcttacctaccacacaccagcgcgcctcggcctaacggcttagcaattcatgcgtcagaactttctcatcatctcatgaacccctagcttaattacgtgctaattaaactgttcttcctgtctccagatggcctaagctagctaataataataaatcccttattacgacctgtttagattttatgaattgaaagtgcttctcgatcgatcatttcactagctattcgattattcttttgatttcgtctcttaaatcctggaaaccaatttaatttcttccggaaaatttgtggagtttcaaggcgtgttggtgctttgcttcgtggcacgcggcgcgtccagtagccagacgcgaggtcggcggcggctctcgccatggctgcctgctggcaggcaaaaccgcgtcttgctagcttattcgtctggtgcgggcattattagttgactttccggccggctttgcatgctctggccttgatcttaggagctgacttcttcttaagaacgcagtgtgtacctccgaaataaatcctcagctacgacagttgaccgagctaaatggcacacatgattaggagggagaattctttcttacaactcaatcgatcgagaaatgggagatgcttttattcgtacatcaatttgtggatgatcaaacatgagtagttggtagtgtttcaggtcctaccagggatatgctgaaagggagtatgggttaggggaggagcaggacgggctacgggctccggcatggaggtggtgctggtggctgcctcttgggtgccatagtc

SEQ ID NO: 3313 - DNA, 1937 bp, Zea mays
  misc_feature (1)..(100): optimal_loci_145861_G1, chr4:82772655..82774591, Cluster 20
ttaacatttatctagtaaacagtgtatctagagtttcatcttcatgaaactctctcgtacctctttttattaattaaatgtcatatcattctggttgtttaggtggtatgtcatttaatgataataaaactcctcccactaagacctaaaagaatagagatatattatttttaaggggccaaatataaaacgaagaatttactcatgtcttcaaaaatgggcctcaatctatcagtagatgcatggagtttgtcggttacacaacccaatagattcacaaaggaaatgaaaatatggcctggttgcatattcaaagcaggcccatgatcacatttcttactaatacactacaagccccatttaacctactacgttttgctgcatgaaagatttgtcattcaaaacacaaaagtgaaaaaaatggatcaaacttccgcatccatgatacatatcttgctaatacattgtgcgggccatttaaactactatgttttactgtatgaaaaatctttcattcaaaacacaaaagtgaaaaataaataggtcaaagtgttgttcaatcaatatcccgtgtaattgtcatacaatcaaactatcaaaagtcatgaaaaattctcaaaaaattaataaatacactttattatttactctaccaatgtattgaatttcatattctaatttatcctactaagagatataaataacagaaaattctatccaacatgaagaatttagaaataatagaactttctcttgttttatatctcttaacataggatgtattagaacttgaaattgtatacattgatagagtatatgatgaagtacatctaaaactattttgatcatattttgtgacttttggtagtttggttgtgcggaaattgtacaagaagcttgattgcacatatgtttctccaaaataaataaaaggaaataaactacacctcttgtttcgaattaacactaagtcaaacattctcactttgttcaggtttatgctaagaaaaaacatataaatatgcaaaataccgaattagtttaatcaaactaaccattgacccatgcattgcaatggactcaatacatttgaacaaaatgatataatgcaatgaactagacaaataaattaaggtcaatacatgtcacgtggaccaaaatttgtaaggaccaaaaaattatcacgatcaacgtcaagtttcctaaatattttctaatgtaagtcgtagttcgactggttgcacgccatgtctatgttggttggatagtttggtggccatatttttttttcaaataagaaactccaataaatataacttgtagctttaaatgcaagagccttgtaaaaaggaaaatttagtagaaaattgtgctccagaactcagcagtagccaaccagatgattgtaacatttattaaacctaaatatattgaagtagctacatccctcggatattcctttatttcctcgagcatatcatgtactccctctgttccttatcttatctacaaaaatagttattttaaattaaagaaattatatattgtgctagatgttttaataataaatgtaatattttcatttttatttaatcaatgtttatgaatattttactattattggtcaaagttttaaaagttcgacttagacaaactttcgtgaatttaagatatggaagagagggagtatgtgtaaagtattatgtgattggaattgcacacctaaccacggcggcgtactctatttatatattgccaaatgagctacaatacttgaacatgaaaaggttcagttttaattacaggaagttcagattacatattcagtttagcttcgactctatcttctaaacaacctgaactagatagatagtctctgattcagtttaacttcgactctatctcctaaacaacaggaactaaataatatctggtca

SEQ ID NO: 3314 - DNA, 2168 bp, Zea mays
  misc_feature (1)..(100): optimal_loci_14838_G1, chr1:81598285..81600452, Cluster 20
tgtagggttgagggcacgacaacggctatccatctcgacctacgataacctctacatcctcttggatgccaacgacacccacctcctctgctctaggcatggtggaaccctcatccacctcatgagatctaccattgatgtgatcaccttcctcaacaagatcacactattgattcaagaggtggtgtccgacatcatctttgacaagaactttggtgggcttgcgatcggtggcaaatttacttgacctcttggcaggcttgctgggatcactagctctttgatgcattcaatagtaggtttagcaatgggctcatttccaacaatttttatagaccaataaccactagaactcatagatcaagctctattacatttagttgtagggttagtcaaagttgacaagccatctataacagcatcaaaacttgggatagctaagatgatatcaatggtagcgctggtgatggtgccaagacccgcaccttcccctcactaaccgtgttagtaattaagtcttttttgtttgtgggttagaggaggtatcactaaatattggttagcatactattgtcgtcttccatttgtgtccatagtgtgaaggggtcgtaaccaacagattgtaactttattcttattgttcttgtttttgcacttgaaaaactaaatggtgtcctttatgtgatgccctttctagcaacatcatctacaaatgtcatcatccacctttcccgtttgagctatgggaaaatagcctttctccattagaacttgcttccttactatgtggccttgtgaatggcctattttaatttgagcttattcatgcttggggagacatgaacttcttacgctgattggatagccttgattcttgaaatgagacttaagaactgcaattcacaataatagtctcaaaattttaggtagtgagaataatattaagtggacaatgaaattattctttaatttcgtattaaaggacttatattatttgcaaaatttgtcatcttaattatgtgcttccttatactagaactatcatatattttagcaatatttttttaatattagtttcaacatatgctttggaggaactagtgaattgttgttgaatcttgtcaaggtactttacgacactctaacattctaatagtgctcccattatagactttatgatagagctctttaccaccataatgaatttattattgatctttctcacttaacgaattcgagatcatatgccatagttaaggttctcattattagctacacaaggagtttcttctactctcaataatgtggcaacaagcttcatattatcaatggttgctctatttcagctaataataatgccataccaaaccaaccatttccctccaagaggaatatttagaaccactcaatggctcaagcccaaagatgaaactcatgacattgaaatcttgtatggtcatgctttagtgaataataaacataaataggtacataaataatttgatgttactttaaattcataatatttgattaaaaatattttaatcctaaatcatcatcggacggaattagaacaaaacaaaaccctcttacaataaccatataattaacatccttcaatattcgcaatatgtatatatattggtttcaatttaattagagaataaaacatgtaaattcaacacaaaattcttaattttttagcgcttaatttccttaccaagtataaatattcaatagggtgccaaatacatgtatagagcataatattcaacgtatacgcttcaaataatacaaaaacaaacatcgttttttggcaaaccagtccatagtggtcgcctagtctcctccccacgcgaacctatgcccattccacaatctagccttagtcaagaaaattgtggccccacctaggtcaaattcgtcaacttccctagcgatgaccgataccattgaaaatgatctaataacaatgattcgtttgcacatgagtaaaagaccaaaaaaatctgccccttaaaaccctaaccactcttcttcttcttcttctcatattctagtcgtagccatgttttgctctctctacctcttccattgatcctatcacacgtgagagggagggcattctagagtagcagtgttgctagcccgacccttcgttattgcag

SEQ ID NO: 3315 - DNA, 2958 bp, Zea mays
  misc_feature (1)..(100): optimal_loci_14988_G1, chr1:82696754..82699711, Cluster 20
ctatgatatgttgttttatttacaatatcgtgtgtataaatattttatgtttttcactttgtttgatttgcagtaccacacatataacgattttatgtgttttccgtggcaacgcacgggtatagacctagtctaataatagattagaaaacactttctcaaacaagcccttaccggtttacttccatgttcctttcttaaactacaatgttgtacacccttagcctttgcgcattgccaggaactttttttttggctatcagcgtcccagttgcctactctggtaggtagtgtccaagtcactttatgtttactataagcatcccagttgattaaaaaacactccgaattttaaggagcaacgacctgttggaatggagaggaacctaaacagactaaaagtagtcaagacatgcttatacccctctaagttggcatggaatgtaattagcatcaaatatactggtatatgaatagaaaatggaaaatcttcctaatcattattcgtttatgcaccctagtccacagcaggttaatttataagcttttaaagccacgtatctgaagataaccaagacaacataaaagttaaggttcaatgctcatgcagattttgtgcatgatatcataaaactcaaaaggggacgcacgagacacagtagctatcgaaatgatttcatgttagttgataaacaaaaggacagctttgccaggtatagacatgaatgacatagctgctgtgttgtcactgatcatctagtctttgttccaaaacttagaaatagattagacatagcaaccatgcatcaattactgtcgaccatagtatgacaggttctgaacttctgattgtactttattgaacatcatagtacattttgcccccaccagtcttatcgcacagctttggagccccttcactcaaactcaaagaacacatcatcattaagaacatgaccctggacagcccatgcacgtcaatgatcccatcattatcattataaccatatcaaacagaagatggatcaacagaacagatagtaggcaattccactcaaatacaaatataacagaaccagatcgacatttttggcatgcactactaataccaagtgatttttttcatggcttgaattttcatgaaaagtattccaaaaatgcaataattatgtgcttcataaaagcatatactaaaaagctaattgtccaagtgataccttgtataaaacacatgctgatgttcaaagcaacttatatagtatagctatatttgcaatttgagatagcagcagttaaacgttaccagcatgcttccaataaatgtacgttcagggttacagaagaggtgacaaaacacatttgtggtataaaaaatggacagatatgagatttcagctaatgttactccaaaccaaagaaccatggacattgtctatctgaaaccaaacatacgagataataaaaagctgaatatttgccaatatcgtcagatgccaaattttgtaactgagcaagtgccaaaatcaatccagtataattcagaagatatactagtacgtagtggctgtagcacaaataggacaatatgaaggaaaatggttagtcaaacttcactagatactgttcaactttcaggagtaatatggaaattaccgtggattctgctcaccattatgtaagtgtgagaatttcactgatattgaattactgactgatgcaagcacacattttttgtttgtataacagtagcaatgtagcttgtaaacagtaccaatgaattagaactcacagatcagcacattatcaatgccaactgccatggcaatatactgtcacaacgcttttgcagaaacaggtaacatgcacagactgtaataaaataagaaaagcgaggaatgttacacaagtgacttgactagctccctaaagctaaaattatagaatggtaactgccttaggagtgtcaccagcatgacagagcacaagctccaagcatttcgaggaataaaaaaaaagcacttcaaacctgttgagttacctggtgtctgtcaagccattcgatgtaagacttggtccttttacgctacaaccatcttcctccagagatcctaactttttttagttgtagctaactagctatcgttgcagcaagatcagtttgtttggatgtgcctaccgatcaggtcaataattcaatgcacggtaaaaatgtgcatatgtcataaaacacaaaatgagattcacagtacaaaactagctgtctaattatttcatgacgggcaatgcagaaatgataggttttccaggtggagacatgaatgaccacaattgcttgattgtcagtgatttgctactccttgctccaaaacttacgaacagatcagacagagcaaccacatgtcaactactgtccatgataacatgacaccatctgaatgaacagtacagtgcattttgcccccacacatcctagattttagaactatatatttgtggaccctttactcaaaggacttagcatcatcattcaaaagatgaccctggacgacacatggatgtcaatgatggcatgattgtaaccatagaaacaacacccagagtacaaagccaaaggatggtttaagttacttcatccaattgcaaatgcaagttatcacagcggtcatcacatttttggtttgggctgccaaatatcagtatacagaaaaaaatttatattaacaatatgcaattagtatgacttgtatttcaataatgtacaactctaattttaaatatcaatgatcaaattgatatacatgataccgaaaaaaaataatgtcaaagtgatataatatctcaatggtcaaaacttaattcttgatgccttgggtttttcagttcttaccccacaacctgatgataggagattttcaggctggtggtccagggtggtcaggcaagtggctagagagctta

SEQ ID NO: 3316 - DNA, 2942 bp, Zea mays
  misc_feature (1)..(100): optimal_loci_152901_G1, chr4:133458981..133461922, Cluster 20
acattctttgaagaaagagtaggttattacattatatctagttattgaacagggcccttgcttgaaaaagaaatagttagattatattatgctcatgctttattaacaacacaagtaaatagtagtaaggggtctaatttggtaaggttttgcgtcagcttctttgaagcaaattctttgagaccttatcaaacagttaaagaggcatttgtaattatacccctctctagtcttgcaattgtgattttacctcttgtttttcaacattgtgattttatctctccgttttgaaaaaaagctctgtcatacctttgcgccattacatgtagttgacagtgttaactatgatgcgaaaatacaaaaagtgatcatgcattttattgtgattttatctctcgttatgttatggaagtgtggttttaaccttattggggttgcccctcgtacaaatcaaaaggagaatagttcggacctttcatccatttattttcataattgattttcactaacaatgttcgaagaggggcaaacggtagattaattttcaaaacggagggggtaaaatcacatttgaaaaatagagtaaaattataattgcaaggctagcgaagggtataatcataattgtgttagattcgggtatggagcttacaagaaccgcttctttgtttaaactatgagtctgaggtctctttggttcgactatagattcttgaaaatctgattctacttgcaggttgagagaaaactgttgctagttaacggttgtgataaaagctaaaatatatttgtttaaaataattgtcaactatgtagatttggtaagagcatgatagttagattttgtaagagcatgatagcttgataacatggacgacaagaatctaaaaattttgaggtaggaggtgattttgaattggatttttagaaatctattttgttgtatccgttttgttgggattttagattttttacaacaaatttggtttagaaagttaaagtagacacacccaaaagtaaaaatattctcccattgttcttcattcattcactattagaatcacttctcacctagataattcaaaagtaaagctcaataattaggatagctttaccaaactagcgcgctaaatgaacacgttgattccacgaacacttttctcgtatgttacttgttaaagataaaaacaaatgaacaagtaactggaatacctatcaatttcattgatctcttggtgtatatatacatgtgaaaatgtgtatctttattagtgaaaagataattaatcattaaacaattattgctgaaggatatgcctctttgataacatgcctaactactaatcctatcactaactgtatatactagggcattgggcgcgcgcgctcgatagttgcagtcgttaaaactgtagcccaaccaaaaactaaagatggaacattattctcgcttataatgacatgaagcataatatcaataagaaaattagagcacaaataacacatgtcacaataatctaaagctgatgttgcaacagtagtttaaaaccaccaaacattacaagcaacaattagagtgccattctaaaagcaaacacagtttgtgtaatacattttgaacgtctaggaaggagcaacctacacattatttggtggagtgaccagttcgatccatacatgtacatatacatatcctgctaccttaccgcatggacaaacggcatttcatcacttgatactaattaagaaccatcgtcattggacctaagacacaaaataaactgtcagtaggcaattgatggcatgcaaaaatgtgtatctataataaatttgtgaaaggctaaaaagtgaagagagaaaaagtctagaaaatatgtataaaatggatcaagtaataccatgtagatcttagcaataacatgcatgatagcataatcatgatgtaagctgaaaccaaagttgtggatctggacatgatggcatgttccaggaaggattgaaaggtggataaaggaactgaaggttcttgtcagaagggagtgtatatgtgtcttcatcgtcaaagtgaaaatgagactataaacaatattcttcaactggtggtccacctttttttactccaacaacaatgtatgtgccaccacttgtagcaagagaactgacatattacaatgttgttgtctgcatgttgtatttgctagaggaaagaggctacttgttgtgttggattccctggaagacttttattctggagataatcttgtattagatgggaaaaggatggatatatcattggtgttagaaggatgtgcttgatgttgatggagtcactcggacaactaacatgttcctctttggagggtcacatgcttacaactaatagcatagagcgagcaaagaagattgcatttgattggaagtccaagctatataatcttgacattgatgattgtaatgggaactgtccctactatgcaaactttaacaaaagaacaaaccttctatctgatataatatcaacacacaattcaatcatacaatgaagctattatatgtgcggacattaagttatactatagttcactacatgttaggattgttaagtatgtgactctagctgtgtggatgattaggctacaagaagtaatggtcgtgtgtgtattgtttctaattgtagtaggtaattttatggtctctaatattctcccttttggtgtacccaattatctttcagatgagagcacaaattcaaaatcagagaagccgtcttcaacagctagtgcaggcctctccaatccttttgtttttttcttctatgagaagcttgctcaatgtcactctcttgatattgtcttaatatgttttgattaagatgcctatgttggacaatatctttttctcctggctaaatcacgttcctattcatccattttgttaatttt

SEQ ID NO: 3317 - DNA, 1425 bp, Zea mays
  misc_feature (1)..(100): optimal_loci_15388_G1, chr1:84818568..84819992, Cluster 20
atggttggattatggtccgcctaccatttatgtaacctgattgtatacaatggtttactgtatgtgtcattatattttatatactattcaatatgacttatgtgtgtgactattgccgtataattaggtgtaacttactgcccgataaggcgcccaaaggggaaccccatgttctagttctatgaaaacttgaatctatttgcatagatttgtaaagctagggtttggattgagagttatcttgagaatgaggaaggagagcaagcaaagagagagggagagaaaatgtggatgccggagagaaggacatggatgtcatgtgtatatagaaatatatcccacacgagatagttggaattaaatgttttaggttggaaagcagacgagtggcaccgttgctcatcctccaacaattaatagtttgactattctctttcctccttatatagatagacatatatacatactactcacacttgatggtcacaatagataaaaaatatagatcatgaccataaaatatgagacaaacattgataaaacattttgacgcatataaaattctttatagtgttccctggtatgcttagtaaaacatgtatcataacacaagtcgaaggtgcgtgaatataaagacacaaagccaaagctttagctccaaaagataaggctttagagaagacaagatttctagagcgcatataagagaagacgtgcccaatacacctatgtagtgaaatgacattgttgcactctctaaatactaggagcgactatgtaaccatgcaagagggataaaaatataattttatatgaagatgtatctaggctcaaacatataaatagataaacagtgccaccattccaagggtcggccatttctgcaaatctctcgtccatggcatccctgtgtttgaagaccttccaaatgtattaacatgttgaagctctcgtattaagcatatgtcagtttaacactcgagcattcatatatatatatattcttcgtcattgatgtattatgaatggaaatacctgttattcggagttgtaatcaatcgaatgacaatcttatcgcacacacttgcaaagaatatccaaaaccctatttcacaccttccatccaaaagctttggagggaagaaagacctttgaaactaatggtgttgcattgttgttatttttaaaatttcgacatgtacccaacacatcctattatgtcttgaccgacaaaaaaaatctttatttatacatttgccttcaatccatatggtattatttctctttcttattttccaaatgttgagcactttgatcaacttgtggccacatctcatctcctccatgagtggcatccttgcctaaccttggtttgaatataacatctcagtcacaacacttagagtaaatgttagttcactagct

SEQ ID NO: 3318 - DNA, 2236 bp, Zea mays
  misc_feature (1)..(100): optimal_loci_154390_G1, chr4:143073893..143076128, Cluster 20
atcccatgaaactgaaaaaatatactctaataataaccatcaggtttctttgcccacgtacgtagcattaaccagaaatgttcattagctatagttattactctagccatcagatttcttctgtcccacgtaacattaaccagctgaaatgtctaggttacttcattgcaaggtaactgtcgtctagaaagtggagaactctttcaagtaatactataatatgaatataaaaatattttcaatttttgtggtatatagttcacttagtactggactaattgctaataatctaagtatatataatgtttttgtactatcgaactaaatgtcgcccactaaaatgagatggagtgagtatatataagtttttgtttaatctttctactatccgtctctgaggttttattggcccctgatgcaaaaccacaaaaatgggccctatggcctatactatacagagataaaaatcacctaaattttatttcactatatatatatttatctcaatatttaaaacaacaatagacattaacgttaaaaggtaaactgtgtatcacacttactgatatatttttaagttatactaaagatcggatcttgtgcctgtgttccacgaaatgaaaccttcaattacatatctatatttaatcttatccagaacatcattttcaagtttagttattgtcaatccattgagtctttattgtgtcatagtactatgcatgtaggagttgagcaactttcattttcaaaaacttcattttgcagatgcaattgtcatcagaatagtcagcaaacttctatatgtaatatggccattacaaaaacattaaatccgcttcataaacttcagaatgttacaagggcccatgtcttcgttagagataaacccttggaggaacattaactctatatacaagtctttatcgtcgtcatcagaatactggccactatctagtgtcaactctagttgagtgtaagaaggcatcaaacttttgacatctaaagagcagaacttatgcgaagtaaaaaatctaaagattttctcgtacctctcatattgtctaaaccttgtagctagtgaagtaatagcttgatcaacaatgtgtaaaaatatttgttcaaattttaaagcaaaaaaaaaaaaattagaggccttgtgtcatggctccccttgcgctaggcaaggcatgggcctatcgagtatattaattgtttgcgacatatatacgagctacatctatagatatccataatttcttattaacaccatatgagtagcacaataattaaatgaaaccctcaaatatacttcctcgcttctaatttatagtttggtttgtcttttctagataaaatacttttattatgtatttagacatatcataaatatatagatgcataataaaaaaatacatagcttaaaagctaaaatgatctataacttagaacaaagggcgataaacataaaacttgttttaacaaaaaagatgatagctatatctgcgagtttgcctagctcccatagagcgatttggccatttttggaaagaaccaatatactcacattttattacgagtatgtcttaggacttttgtgacaaaaaccactatacttttacaaaacctcgtatatgaaaccatggggaccaaataccaataccacttttctatttattttataaagagctgcaattttcaaacgtcagcttaacaaaattaaggttcatctacggatatatatttcaaaacaagaaggcaactgtatttacaatattgctcggcttctcgacagtgatatgtatatttttttaaaaaaaatgggcagaggctactctcacttgtcatgagtcaatgtcgtcgaggaatttttacaaaccttgggaggctaaaactagaagagcaagacgtaacagctccgcactccggtagatctttttataatccttgtaagggcctacagaatcttgaaacggattttttttaaaaaacagagcatggagcgcggcctacaataaagaaatcacttttatggaaatataaaagattacaattccagttgcgaaatacgaaattactactaatcagtacatcctttttttgttttgtgatgattcattcgcaaaaaaaaagtatgatgagtcgagtgctaccccacccactcgcttaatctaataaaaccctatcccaccgtccgtaccacataaccataaaccaaaaccggtaggggtataag

SEQ ID NO: 3319 - DNA, 3112 bp, Zea mays
  misc_feature (1)..(100): optimal_loci_159726_G1, chr4:173326080..173329191, Cluster 20
ggcaacaattcttcttttttggcatcagggaaacttaatacacaacagttattcaaattggagcagtttcaactttcaacgatactaatgatacccatgacaataatagataaaaccataataagattatacagcacatacacttaatactgataccttctagtgtttttttcttggacaacgcctgggctttacatgcacgtaattgacgagatattatctcttcgactgagtttagaattgacaggcacttatcatcaccttcatctctcaaaggcagaccaaaggacatagtaaagagatcctcttcctacacatacatgaaaaaggatctgtctcacaggtgaaatcatggagttacaactataaaaaagatgatggtatctcaaatttcaggtcaaacagtgatgaaaactgatgctcatattgacatatgaattatgtacggcagatctcacacattacagcaccctaaagctagcttcctccataatcacttctaccactaaaagaatatgaaatgtaagagacatattcagagactagtgaagtccattccagtactccacacacaagctaccagttgctagttgtctaacaaagtaacaaagttatgccacttaccatatactaaaaactaaatcgcacaaatctataagcaacaatgttaatttgtgctattcatttgcagggagaagctagtcttacaaaaataactcatcaatgtgattctcttcagatccaatcaagttcagcaacacgatagattaacgcaattttcaagaaagaatttggtggagatagtcaaatacgtagggtataaaagaacgaacttagtcaaggtagtcaatatgcataaactatttctagaaccatcacattccaaattcctgacatgccgaaggttactgataaaagtaaccaggggaaaatggagatagatagcatccaaggtccgacccagtacctcatgagttcgggcagtagaaacagcagaaatgacagcattacaagtagcacgcaaaatcctgcaaaagctatttagtacagcatgcgatgaagttctttccattctcataaggtagatacatgtaaatacagtctgagctagagtgtgccccttgtgccatgttgcctgggaaatgaatcattaaaatacatggtttagtcaaattgaaaaggttgcacatattacatgcaacaaaggacttaagtacctcacatgagaaaagatgatccatgacatcaatagagcgttgaacatcaagtgtcctgtccaagctaagtgggattggggcaacaccatcttctattgcttcatcaatggagttgtatcgacttctctcaattccagaatccatttttggatccattatctatcaggacggagtccatactgagaactaaaatcaagcaatagattgaaacaataaaaacaaaacaaatcgattgaattgcctcactcaatgtctctcagcagtatgatgtttggcttagtcactatgaactaaaatgtcctttgaagcattcactaatcactaatatttttaaaggttcctaaaacatatctgcctttttgatccataccacatcttgaattgcctacctacatgcatgttttagattttggaatagtgagcgggttcgctagcagagtatgaagttaatgttctctgtctcatattttttaaagaaactctgatcggtgagaagaatcactccatacaaaaaacattgaccaagccaatctaaaaagacagatccagtgctggcggctcccacatgagtggggtctagggaaggaatagctgaggcaagccttacccctccattttacagagaggttgcatcgaacccaggtccttcggctcaatgggaaggccaagccaatctaaaactaaaaaacatttgcctatcacatcaatgagtgaattgccaagatattgcttttcacaaggatgcatgcatccagatcctcaagtgcccaaacaagttgagtgatagttcataaaagcaactcgggtgacctagaaaatactatgcctacaaggaaaagatcaaccaattgctaagtcatcataacaattaaattcgcaaaatagttcagtagaaacaagagcatcatgggcctcaacacccataatgcacaatagagagaaaaaagaagatgaagcacaattaaataccaggggatgtagtgtggccttacttccaatgcagacattgcagcaaatagactaaagttttctccatgtacaagttccccatcctcgagatctacaattatgaacagtcagtaggagacaacaaataaaagataagttagctagtagatcttagcacaggctcaactcttagttgtaagtttctatcagtacaaaagagttcgagatggatctaaaatccaacatcaacatctcccatagtggtctttggcaacaagcactcaagcagcgctaaactctctagatgcaagaaaactacaaaccatcccaacttgagattgaaccaacttattagttttgaaaaaacaagattgtgtacttctaccaaattgtaaaatatttttaacaaatcagagttattttcatgtgtagcattttaacttgattacttcctccaataatgttgttcatagcaccaataatgtatataaaaatgtttgaatgtaattcagttatgcaaatgttgtattttactgttttgcatttatagaaaagtcaattcccaaacaaaaatcatgaaagcaccatgtggcaaaggatacataatggaaggtcagaaaacttttcaatttaacttggtggataaaggtgagtccccccagactgctcatagctttcagggccatggttcctcacaagtcacaacccccagaaactcagcccctggttcattaccaacaaggggccgagccaagggccctgccacccccaaacttggacactatccctaggtgatcgcatcttatacttcacttagttacaaaactattcctcaaatagtgccttcagggcacgtaagcagacaatggagaaacatctgagtttgcttctcttactgcacatatagctagctgaaagaacttcctaatctttaaaacaaatccatg

SEQ ID NO: 3320 - DNA, 1501 bp, Zea mays
  misc_feature (1)..(100): optimal_loci_159993_G1, chr4:175140148..175141648, Cluster 20
atgaaaatgatccttactaatacatgcgcaagatctagcgtcattaaaaaaaactttgatagcatatgttactccaataaaaaactcttcttatttgcagcataatgctctttacgatgaaataccaacggatttagattggttgaactaggcagattctatttcataacatgattcatgacaaagcctgcaaaatctatgtttaggcccgttgacagcgatataataatttacttcacatgccatacgataattgaaccttcactagacccaaagtatatttacaagctgacatcgtttgatataatagagcaggatcttggaaataatgaaacatttctaggtatggccctattctatgtgtagtaacaacatgtttgataatatttgcttccttccgataataaattattttctactaattgctatgcagatgtactaggtgtgataacatagatatatgaacttcgatcagtttgtatttcttatcaacaagaacctattgtgaatcgacataatattcattagagacacaaggtacatattacctaaacactttaaatattttccattgttatcttcaaatgaacatttagaaacttcatttttcttcttacaaataaacaaactcatactcatagtttcttatcgttttgttaaacacgtgtattgtatacaagcaaacttctacattattttctatttatttccctgatattgaaacacatgtgccacagcgatgcaaaccttaaagttactttacggggagaacgagtaatatctacaatgagacaagaagcaaaccagttatcgttctctttgttggatgtttagcaaaatattttaaaggtttgacaactaacatatacttcgtcctcactataacgattctattgtttcttaagtgctgcacagacattaagtattgagtcccaaatcttacagtatattctccaaaatatgtcactggtttttaaatcgaagcattttagaagctgaaacctactaaaaaaggttcattagtgtacatcttactctttaaaaacaatcacttactattcacaatgtgaaagtattacttatgaaaattaggaccatttcatgtttactaaatacagatttcaaaatgcaacaaaggaatttttgtacaattttttttagaaaatgtacttacatggtttgatgcttttggatatcagttatactctattttcccgagcgtgactaccttaaaaaaacagccacatgcgtccatgtgtagcagcttcattttgctcacatatacaacttctatttctaaacacacaacgtgccttttcttcatcttaacaaattatattaatctgtgacatctatttgattgcgtcacctggatttcatttactgtattatttgagcataaaatacaatttaccatattgaataaatctaactcgaatacgtaacatagcgcacaagggcgtgccccatctactagtttctagcaagtaccgcacgcagc

SEQ ID NO: 3321 - DNA, 1418 bp, Zea mays
  misc_feature (1)..(100): optimal_loci_160235_G1, chr4:176530889..176532306, Cluster 20
atgcaccgtatcactaatgttagtaggtaccaactggcttagatcggtactaactgaaccatccaacacactcgtatcgaccatcattatcgaccaacgttagctccaatataatgtgatcgataccgaccgaaccaatcggtcgaccgaccgacgtcggtaccaaccgttctgcaggccaataacatcgacccaccgttaactcgaggtactcaatcttaaataacgcaaacaaaggcgccatcaaatttaattacattcacgagcagcctatttttgtaaattagaaaggatataaagagagtattttaaagttgttctatcagttgtgcctttaatctttataataagcatttaaagcgcccaagtcacgcatgatttatttagttctacgtactactagcagctagcaacactagaatactgcttgtctgctacagtgctactgcagttcaaagatgtggatatactgcagcacgcaacactgatcaagccatccatcacgtgcaacacattatataatataattatatatataatcatatatatcggtcgtgcaatcaagacagaatgatagggatagaagatttctttagaaaagaatatttttaaaaaagatatgatgagtatgtattgaagcttagacttaaaagtgactgcacataccgtgttgaataaagtactcaatttgagtctagcccctgtgtgtatatactagatccggcgcgttgacattcgttactaaggaaacgccgctgcagttgaatggcaggaattaaccacattagattaaacttgctacgcctctctaatagtagtgatcaataagaaaaaatcactatatatggcacttcttcagatcggccgtggtagttaataattgacatatgagagagtactacagagaactataatattagctagaagatcgtcgattgaacaagcagcctcatctctcaaggttacatatccatgctcaataattttaattatacgacatctcgtttaagggatatgatgatttattatcttttcattcatatttttttgtttggtttgtgaaatggaatccatcgcgagctttgtataagcataagaatagaaccatttcatcaaaaatcatataataaactcatgatgtaccatctcaaatgaactttcaaatcggttcgcctagttgctcaaaccagagaccatattaatttcatctctaaactttcgaattattgtcctaattcctcaaacttaacactttataaacttcccctttctgaactgaagtcatcctttgtcctcggaagatatgccatgttggtgtttatagtaatcttgaggtgtggtgccctttgctcatgagatgcctctttcataccgtttactacatcaattgaggacacacctcttcaatccacaatgaa

SEQ ID NO: 3322 - DNA, 1938 bp, Zea mays
  misc_feature (1)..(100): optimal_loci_161094_G1, chr4:182053347..182055284, Cluster 20
aaggtaaaacacactaccaagatatacaatgtaaatacaaaagctaaagagccatagagatacaaacactagaaaggcaataacacgatccaatatgatgcacgcaatgatacgaccaacagtgtgtgagcgcggcgtgtagtgcggggtagggtatagagagagcatgcgcaacgagagaaagaagataccatgactatagaaatagaacctcgatgcaaagatatgtaatgctgatctcggtgtcaggagctacaacactgatgaggaattgtatcatcatgactacaataacgtgatccacatcatttatagcataatatcatggcgttataatatatagtgtcgaactgtgtaactttggtgtacacccctatgattaattcaccggagctttttacttgatttttttatataaaaaaagccggtagcctcgcaccgtcacacgtacattacgcgaatcaagcaacggcatcgtgtccatgcactaaacgcggcatatacacacatcgcaatagccaaaatgtagatgcgaatggacgtaaatcatgcgccctgtctctcacgggtggcagacagcaggtggacaccaaccttggctgccgccactttgagctatcctaaaatcctaatcatagtatactaacgtttcatccgtgcaatcagcacgtgttctgagattaggaacgagaacgacctcgcgtgcaggcatttaaaaatgtcccaatcaaatcaacgcacaagtgctccgtttgtcggggtggtactttctggtgaaaggcaacaaatctgcttacatgtagtgcattaacgaactgccatcaggcatgaaaaggcaaagcgaaaccaaacttgccgccgccagcaggaggatccctgatgccagtggtggatttgatctttctcatcaaccagtaatctactcgaactcggttagtggtaactgcaattctcaggaagattatttgctacaagtgtggaagcgatccagaggaaacaaacattggcgggaacggaatcagtggaccttccactcgagtcccgggcgcacgttgagcatggtgttgagtggtgtctttcagtctcggcagcatcaaaccttaagcaaggttcagtagtgctcatgcaactgccatgctttctgttccgattccgacagaaatggatcggtcacctttcctgacgtgtgttaattgccgacagactggtaactactaccgtgttatctttcttctattttttttccagcatatgtggagggggccagtgctccgaatgctcagttccgtggtgtggtagattccagcttctgctgaccggcttcaatggatcgtcaacctgtgaacagagagcgccgtaactgtcagctcattgaaacagtgtcgcgaggatgacactgtgccccgtacagtgtccggagccgtatcgtgcaattagcttggtactgcaatgcaagcaaagcaatagattactcacaaatcatttgtccactgtttgctgaatgattaacggcatgatgatacatggtggcctagttcaatggattcttatccccatatgtggggcggactgaatttttcttctgttcaaagaatggctcagagttgcaacttacagctaccctcttgcactgtgcttttttgtgtctctagctcacgctttagagcataaattttatattatactatttttattatctataaaattaatttaggtctgttgcagaacagctgcaactccaattgtaacttctctggtgaaacaactctttgtgtctttaacttcactagttaaaaaaacatttaatgaaataacttctcctagctattaaccaagtatggaaatttcataatgcattattttttcctctttctcttctatctccaccttatctgctctcccacgcttcttctaccataccacacgcatccacttctc

SEQ ID NO: 3323 - DNA, 2235 bp, Zea mays
  misc_feature (1)..(100): optimal_loci_161102_G1, chr4:182186415..182188649, Cluster 20
tagtgagctatatctagtgttgagatttttgtgtattccctcaaatttacccccccattctttgaggctaatatacccatgcgttgtcatgagagtaaaaaattagtatgaaacatatatacaaaacaataaacatcattatgatatgcaaaatcagcgtgacaaactatcaccataacgttaatattgatgatattaatattaatatgaggaatagatattgaaacatgtttcaaaccattacaatacatttagtttttatttgcattgagaacaaggtcaataagcatagggctttccaaataacgaacttacaatggttgcacaacacatgtgtaacagaacggtataccatattgatgactgagcctgtgactaaaatgtttcataacctttgaactggtttttgctctaaaaatttgatctggtgtctcataacaatgttgcacgtgaacccatctgggcacaagcctaagcgagtcatctcctgataaagtgtcaatgcttcttgtgcatttccagacctaaaagctccatccatcgaactgttgtgtacatggacggtaggagcaaccccaaacctgggcatctcaaaaaacatatcttttgcttcaatgaacctcttcgctttacagaaaccatcaatcatggttgtaaagataacaatatttggaatcaagcaagtcctctttcaaactatatacacgaataacagtgtatacatgaatgcataggttgtattagttgaatgttgaatgccatgacatgcaaagaaatggggacaagacagtagagagtttagtggatgagcaaacaacaatgccaccttcctaatgaccatcaaattctgaagcaactgagatcgttctgtccttggactccacaactacaagataggatacatgacccatataaattaactaagacctagcaagtccaaatccaaaaggaagaaagatataaccccttggctagattcatctatactattcaattcatgcaaacactctattcacgaatgatagaaaaatagcaaccatattatcatatataagtaggcaagatgcttttgtaggtaagaagatcaaggccatgaagtatggtgtacacaaattattttagcacatcatcgaactattcgacgccatgaaaacaaattagcagaaaaaccagattgccagcaggtggacattgtacaactgccacgtagatggtgtaactgattgattttgtaggcttgtagcagggagggagctgccaaggcactccctgcctagctttagctgctttatggtgccatacaagtttccatatagaattacagaatcccgtgcaaacaaaaaaaggacaacacaacgttactgcaccagtttagctcatatcctctagcggctgttgtgactcgatttccattcttcccacctgactgagctttctttgattctgattttgataagaacactgatgttaagagatgatccgagactacatgtttgtgctaataaaaaagcaagagtagtgagaaagaaagatgctaggataagacgggtacctgatgatatgcattctgaactccttcaagcatctggacaacatgactcatctttgggctcttgtcaacatcaggatcgacacacttgaagccaaccaagatttcctgcttaagggcacattttggtggcttaacctcgaggtttggatgcactacctcatctgccctcttattggtaaccatcattttaagccactctaagagattcacctgaaacaaacaatagaagaagtttaagaagtaaatggaaacgcgatcgcaccaatgctttgaaattgagagaactcgtacatcatctgcaggattagcgtaatcaactggatccctagctatcacacattctaacaacaccactccaaaactgtaaatatcacttctttcatttagtatcccactatttgcatattcagatgctacatacctgtcaccggattaagatgtgttgaccctgaatataaacaaagaaaataaaataaaaattagacgacatagttgtagttatgtttactatcagatcataatgaaggtgtatccagatagcattgggtgtttcaaccaaacatctgcaaggaacaaactataatgcatgtaaaccttgttatgtacactggtaacacaaattttcatccatatgtactctagtccttcttagctgttgagaggacatcagaacaatcgaatca

SEQ ID NO: 3324 - DNA, 2573 bp, Zea mays
  misc_feature (1)..(100): optimal_loci_171244_G1, chr4:234715780..234718352, Cluster 20
gtaagcctaggattatctaagtttaactaagcagactatgatgaaattctatactctaccattgcaaccgagaaatgagcaagggcatgtgccctcgctcactactacgtaggttcgcctctgatgcggtatgttacacatatatttttgaataatcggcagtcaaattttacaacgtctggattttaaaattctaatagcatcctcaaacgaggtcattataagtacaggtacaatgatgtcacgaaaaaaaaatagatgaactgaacagaggagaagcgcatggacggatgacaacgtatgttagagagcacacgcgacatggcccgcagcccagtgggctcccggctaatgtgcttccaaagccctcttttataaaagaagattaatatagtgcctacgatagtgcattttgtctgaattggtacacatacagcctaccacacacgtggcataaggatctcgtcttgttattaataatcattgaaaaccaactagaaatctagatatttttttgtttttaattatattttagataatttattttgtatcgctgtgtatgagcgggcttattttttatgaccatcgaatataacattcattcattaatttgttgctaaatacacattgttctcgatctatatgatggcatgacatatatgtatgctttaggcgatttttatgcatcaatattgattgaagcagatagtttaggaacatagacataattcatgtgatttggacattttttatgatagcatatatataccgttacttaggatgctaatttgtattgcttctggtagcagctaacatagtagatccaatatctattcttaacgatggttagagttttagtaaattggtgagtaaaattttctaatcctataagaatttctagagtttatatttttatgcatcagctcatctacagcttcactgacattctttttttcttcttcttttgcctgcttaactgacacgatgttatttatttatttatctatttatttattcagatacgcctccgtgagctccgtaaccctgaaacctcatggtcatggctgtcacctgctagttcgctggatgcaggattgtgatccttggcgatgtcaagagcccatgctaaattagcaaaagagatggatgcatctgagaaggacgcaccagatctctgcccagccagattgcacaaagctgcaggcgtgatcctgatgaggtttaagggaaaaaaaaaggtaaggattctacataatctcctctcatccatcgacacacacgacaagtaaaaacgccttgagttgcagagatgggtaaaataatctattcatgcatactgcgacgatcagcgaccttatcagtctctgtttcttattcctgatcactctagtctccgcattatcttgaattaaaaaacaacaacaactctacgtgttttgtttaggagcaaggatacctaacaaaggagctttgattcgaatcatctctccggtattcttgctcacaaacaatccctaacgaatacctaacaaaaggacgctgatccttcgaccaaacatggtgcaagcacagattctcctgcaaattttttaaaaaaagggcgcggctgctcgatctcctgaacaaagatagattagagcagcgtccaaaaaaaaaaaacgccagaatttaacacgcgtcactacgagttcctcgtccagctctctttcggtgcacggctcaatttaacacgccacgcgcccacgcgtggcagcttcactttctgaccacgtgtggaatacagcagcaagtagaagaaggtcatgacatgagtggtgatgagtgccgttctgaactccgacgagttcagcacagtttctcagctttttcaggtgtcgcgtggctcgtgaaccttttgtcgtcggtgggaagtgaaaagaagagcttgtttactgactgtgctgtggtttaaactgataaagaaaggtaataaactgatcaagagagaaaggtaaggttacgatcgtgcatatagacgtacaaaaaataccgttctacaccgttcacggagaaggattgactaatatttgtgaggagtcgtaccaaacaattaattgtctaagttaccgtcacagatctccttctctttgagacagtggtggccctgagggtggggcagaggggcggtcgccctgaacccccgaattcatagggtccaattctactcatgtgatccaatagtccattaacaaagtaataaatatctaaatatgttagaagaaaatttaaagatgatactacaatatatataaatatttttaaatttattttaagtgtttaattattaatatttatatattaaaaataatttgaaggacctctatttaaaactttatcctgagccccggtcccctaaaatgtttggaccgccactgctttgagagatcaaaagatagaaccgaataggaggagtctgaaaaagataggatccattcgaagggtcattctgtacgcgtttatgttatattataaatgccctttttgtttcttctatctctcgttgcctctgcctgaatttgttgttgccgcctgga

SEQ ID NO: 3325 - DNA, 1468 bp, Zea mays
  misc_feature (1)..(100): optimal_loci_171599_G1, chr4:236358269..236359736, Cluster 20
ctagttaaagtttttcttcactcatagtgatcttggtagtgcttcactatcaggaactttggttccgcaacttggacagctcaaaaacttgtagtacctataagttatcttcctttgctacagacaaaggttattagggatatgcgatctgggatgatgaaggtgatgtaatctaatctggagctgggaaacacagtgaaaagtggtaataatatgagcattcgaaagtgagaattaaagtattccattttccaaattcttcagaccacatacactaaaagctttgctacggttttttccgcataaaatggtagtgataacaatctttgctactgcgcattttggtggattaagatgcaagtagaagagaaaaacaacaaaatacttgacgaacaatacatgtcccttagcttttagaagcgatagactctgacatcttgactaaaaaataaactataaaatgttggaaacttctactcagtgaaacattacaactttttgtgatacatgctacacttgacaacggaaaaaagaagcagactgtgcaaatttactgttaaaataaatgcacctctaaagtatggctttcatcaatctactgaaagggacaaaaaagaggaccacaatgaacttgtatacatgtaaacatgtagaactgtaataaagtaaatatagattagtagtgggagcatttgtaaaatatttaatttacttaacatttgaatagttaattgcttaagagaagggcaaataatgaaattaacattgttggataaaaaatgtgcttcatttgcataagagatacccgaagataaaaatgtcaaaatagatttgaatcaagaataatctaacgaagaaaaatggaaaggggaccttacaggttagctatatcgttgttgaagaaatggtataatatttactacagcagagaaagccaaatagattgagttttggttcttttttacaagacaataagaaattctgcagcaattcaatataaaaacaaattcaagatttgtgcagatagaaggatagcaggaaatttatattagtatttgtgctatcaatctataatcataataaaaactgctttgcaattcaaaagaatggagaaaacggatctatctttggacttagcatgtaatagaatctaagagaaggttattgcaacctcggagatacagaagtttattttgtggtgatgtgtagaatgggagtgctaatgttgtatagtgatattcagaacatgttgatttccaagcacaggaaattttgcagagatagaaacttacgtggtgacaaggttggaagtctccccgagctcagcgacaatcctaagttgctccagaatacaccagtcgttgacatggacaccaatggagcacatttttatctttgggtatctcttattatactctcagtctctgacttctctagcacaaggctcgcaattcctttcctgcaggat

SEQ ID NO: 3326 - DNA, 1527 bp, Zea mays
  misc_feature (1)..(100): optimal_loci_171964_G1, chr4:238383801..238385327, Cluster 20
gcattacaatttacaatgtaaagtagcagtagaagagcaaacatttaacacataaatattcccataccaaacctttcattggttgcttcctatttgtttaaaaaataagtgatacagtggagcagtttaagtaaaaaaaaccatactacgaagttgcaacttactggatgtagaagtttatcactggtgatgacaaatatactccaggatcaagacatttaatatcagatctgctgagctcaacagattcccgattatctctgttcacataatacagtcaaaagaaggtaaagtgaattcatgatcttcagaaaaaatgcacaatattcacctcgatgggtagtagatctttggtccattcctgaaaatacaattcgttcagttgaaacataaacaaaaagctcagctaacagtttacatgatgaatacaacaccagaaagaagcttactgtccgtcagacatgtcacagtttacttcttcctcaggctgcatatcttcgtcatccaatagaaccacatcttgaaccttataggcaactcaggttagtaattgtgtaaggccaaaataacatgtaaaagtggtgcaatgatcaaactactataagaaagtatgccaatgcaatatatgacagccaaacttattatgagcagataataccatggtaaaaatagcagtgtctgtctaacaaagaaggtaaataactacctgacctttctaaaaacaagcttcagtatgaaactcaaacacaaacctttgtaaactcgtgttaacaaagagagtttatttttctcaatgcaatatatgacagccaaacttattatgagcagaataccatggtaaaattagcagtgtctgtctaacaaagaaggtaataactacctgacctttctaaaaacaagcttcagtatgaaactcaaacataaacctttgcaaactcatgttaacaaagagcgtttatttttctcaaccttgcctagccttgctagtgtttaatcgttagtgcaatgaaaccatcaactgtccaaagaaatgtccttgataataaacatcaacactcgctatgttctccattgttcttatgaccacagaagtcaaacatggcatgctcattacacattgcatgcaataggatttcattgaaatgcaacataaataaagttcgcacaatttagcagataatgttaaatgaggaccgtgtggttttaatattcaagcaacaaaggatgtatgataggttatggaataaaaatctatagcagaattcacaaattactaaatatcagcaaacctacctttcgagggtacacagaagatgaattctgaagttgttccttcctcctgcatagaataattaaaaatgagctgatgattcatacttctagacagagcaaagtaataagtaataaatataataacggtacattataaatgcccatatagatgacaatatgtccataatatgtaaatgatttgtacaatatatacaacgcagaagatatctttaagaatctatataacataaaaag

SEQ ID NO: 3327 - DNA, 2467 bp, Zea mays
  misc_feature (1)..(100): optimal_loci_176247_G1, chr5:22095542..22098008, Cluster 20
tatagtaagggaacataattaatgtatgcagcaagagtattttcccttatttgtaacctactagtacaatggcaaaggtcgaatattgtctagctatatatgtggtatatgcttaatttcttaagtctgactttctgagttcaataatggaagcgcctggtctaaattactgttgtttttctttgacaagagacacgcaccaaagtgaaccttagcaagtctatggatggtattttgttacaatataagatggcattagtagtagtagctaataatatgggtggttagagaaggtgtctggcatactgctgcaaaatccaagcgcgcctgtccaacttaatttctgctatgcttcgatagtggcaccgaatacatctattagctatatataaaataccatattgtatatatatacaaggcacagagtgcaagaacatatatatatatatataattatcaattgtacatggaatttaaaactttatctctaagctaaattatgctcgttataataagtgttgtttggatatgttcaagctgacagattactcattctttatttgtggcaatgggacatgatgtgttatttgatctaatgatatatgatggtcaaggcttgcacaaaacttcatctcaaaagagatgacatttattaaaagattgtgcagctcgcataatattttgcatatttcgaattattggaaccattcatagtttctaaaagtcatttttgtgtaacatgtagctatagagttcatgattgaccagcaaaaaaccataatgactaacatatatctatacaattcatgctactagatttcatatgacataacaaatcactctaggaatccttttggagttttataaatcaaatttgcattttatagaggtgtctcttgctactaaataaataccatgggatataatgacgtgagaaatcatgcacaaacaagttaaagatatattgatctctatgatatactcaagcattttgattcaacgggttaattggaggatatgctaaaactagaggtgatagtcaaagttttaacataataatattaaagcattaaaaaggaatatcaaacccaaaaaatacagatatagatagagaaattgaatatcgtaccttcccatatttacataggagcatcgacaatttcagtatttcaatagtattgtgtgatggacgcaatatatattaatataagtaacatacaaaaacattaggacctacatgtagatttttttgctattgagtgcaatgaaataaataactgtaattataaacaaattgtgtatttatgtagttatttatacataatatgtgcatttctttaagagaagaaaaaggtcaaacttagaagtgtggcttctctcatatattttatgtataaagaaattaaaagatatagtaatatctaggagttctagtcgattcaacatgatagggatatgcgaaaactctaggcatgacactcaaaaatttgatataaaataacattcatacattgaaaagcataaagtgggccaaatatgtatatccaaatgaagaaattgatgagttacctttgtatattggcatatttatgagtgacaactattttagtatttctttaatgcttcatgatacaagcaatatcttttaataagcaacatggaagccaaggaactctacatgcatgtttctgctattgggtatggtgtgataaactaataacagatcatgtgggtatccttgtgtagttgtacatatcacttgtgcagaacgagaaatagttaagatttagaggcaatatatttttggttttcacactacattttatgacattcgatagaatggtggtgtaccaataatgtactaacaaactaaatatatagtgatatcgaactaattaagtgccgcataatgttacaattcaacacacattgggcaaacatatgattggagatagaggtgaaagtaaaaaacacatgacattcgtccattgggaaaaaatacacacattaaagttatgagatagtgttgagatagatatagaaattgatgattaaatatagtgatatctatgtgtcaataattttttggtcaatgtcaaaccaagataccccacaattaaagttagcaccgaaataaagttcacacattacatgcattgacaaaaatatatatcgaacctgaaaccacgaatatagctagaaaattcttatatcttaataaagataagaagatatctatggtacaaaagatatgaaaattcatagcttaaacatatggtgatacctacaagtcgttgaacatttcgattcaacacgctcggcaaaaggtattctaggtattaaaggtgtgatgcaagagatactattttataatagaaaaaaatgatttgtacaaggcacaaactttccctatgttggtgcgtggccatagcggtgtcccaatgcacctttaagcccctctgttcta

SEQ ID NO: 3328 - DNA, 1591 bp, Zea mays
  misc_feature (1)..(100): optimal_loci_179499_G1, chr5:38481506..38483096, Cluster 20
aacaaccttaggatcttggtccgttaagcccatgagctcttcatggttgaaattttgatgccttctttaatctcctgatcatgtccatgtataatcaagcaacatctaagtggtctttttaagagaatccatgaaattctcttcaagtcttttgtatgtgtgttattgtatgatgaagtatatatgcttagtccccaagcctttcactatttaatataaatagcttgagagtcttttctacaaatctccccatctttaaagaatcctcttaaagatttttaaaacatcttttgagtatatgtatcctatggcccctgagcctaaacaatcttttaaggaaccctcatccttgggctcttcttatcttgctccttcaaagggctcattagtgactggttagctccatcccatcaacataacttttcctaccaccatccttggaaccctagattggttgatcattgtgtcttgaccatcatgttcttattagcacattgtctagattcatcatgattctccttttcatagagatccatgtcatttgtatcatctgccaatacaacaccccatcccatatcatggccacgaccacaaccttacattccacctcttggttttctttctctcctgctttttctagcactagattgagctaaaattgaccaatagtaaattatcccactcacgattcttcttatgcaaaccatctttgcactctatcacatcctgacaaatgaagttacaaaaatcaaagaagtttggaagcttctcatattgactataaatctcctcttctctttcattatgattggcatgacctaaaccatgggtttcccaatatctacaaatactcttgaattaagatacattgtcaaatttattttcctgtcgtttaccatcattaaaatgggaggttatgcaacttcccttgtcactctctttgccaaatctgtcctcttcatcaaagcattcaaaactccttgaccccacacccaaactgtatcttatcaagcgtgtattcttttactcttgagaagctatactcagtagaacaataggcgcttcgttgaacaaccaaggaccaccctccatcacccgattccaatctctaaggtaatgaaatcacactagaaatagatttggttctagcaccttgaatttgacatccttcgtggccactcgtgcaaggcactgaacaatgttacaaggctaaacatttcatggtataaaacctaaacaattccaaccagtgagcctccttgatcatttcaaccatctcccctaagagatcaaggtcttcctcctctctatgtaagttcagattctccagacactctttgatggatgctttcgatgcaacatgatcgtccttgccctacatctccatgctggatgaaaatgccatggctagcctcaccgcttgtgttgatatgctcttgttgttggcctttgattgctttcaatcttacaatagaaagtagcatagtggactctgacaggcatcatagctagaggaatgggaaacccaaactaatgtgtgttaaagggagatgaaatctactctatcatgtttttgctttattatgagtgc

SEQ ID NO: 3329 - DNA, 1639 bp, Zea mays
  misc_feature (1)..(100): optimal_loci_180190_G1, chr5:42862167..42863805, Cluster 20
tgttgttccctagccttccaacatttgcccctctggcctctattataagatttggtgcattcaggtagatgcctcttctcatgtctttgtcgtcatcaaatcaataatgacatagcttccaccctgatcttgtagcattcaaacttgggagtaagattttccttgtgtcgttatgcgtcgaccatgaaatgatgttggcctcaagagtattgtagactttatgtcctccaactttatgaaagtcgaattcaagattatgtattgtggaactgtcaagattgtgtttattgcatcaacgatggtacatgtcaatgtttctactctcatcacaacgtcactgcttgacctcatttagtttgagtatattagaatgacatcaatcatgtgtacattattgtgcacgttgttgattcttgtgttgccgactttatctctcaatgttagtcttcttccatgctaccttgtatatggagatgtcgacttcctcttcatcattcatatcaataatagttagcataaaaacctcccaattgtgatcatagttgttcgagctatcataggtgcatggcttggtgattatttcttctatgatgtctatgagagcaactctagctagatatgatagtgggtttatatgggcaactatgtaggaagaatcagaagaattctcgagtagctaggtgccaagccaatgtatgatattcctttatttatctccctcttgctctagtgcaagagtagaagagatgaatcttgagactgtcatttgatgatagagttagtattcttgaacctgaatgggagttgagttagtttggaccatagtcgtttgatggcttagaagctgacttagaaaacttgatcatgttgatgtcaaacataatctatacgggttgtttcctcatccgagtcatactagaattcaaaaaatcattgaaattttctcgataagatcctccagtgagttttaatgaagagctagggattcttagtactttgtagtctccatgaggcaaccgtggattttgacaaagtcgttcgccatacagaccgaggaaccaaagatgaagattgatcctgctatgaatgtcgtgatgatcttgaagtccaacgacctttggagaatattttgttgataaccccaccgagagtgccatttgttggtatctgatgatccataatgttactacggtgttatccggagcaagacttggtggttcaaggggagatcaaatttttacggtgaactcgagataacgatttaaacatattcagattattgaatagcttaatatcctacatcatgcacgttggattgacttgagttggattattgagtataagatgttacaaggggagtgactttgcctctatttgtatagtctataatacaaatgcttgattctagccctagttagctacaatagaagaatcctaatcctagtataaagattatctttctttagtcgactatgtcaattttcttgtcgtagaagccacaccaccttgttttgtgtcttcctagtaatatgtgggctaacccatcatcttgtcggatggtgagccttatataaaccccttagggattgtttggttccatgggacttagaggagattaaggggcatataattccttgct

SEQ ID NO: 3330 - DNA, 2590 bp, Zea mays
  misc_feature (1)..(100): optimal_loci_184065_G1, chr5:69967592..69970181, Cluster 20
gagaggaagtacctttccaatacgaaatgccaccatggagtcatagcgataaccttaggtgaggggcagttgcagggtactaaagttagaggagggtagtcacagttgattgttactgcacagtatatttacttttgatggttacctaggataagactgaatcactaccaggacgaacaaacctatgtctgttacatatccttgaagtcaggtatgtagaaccatgaacgaagttatgcatcaatgtgtttatgcagaggaaatattcatacccagtcttatacattaaaaaacaatgttcgtggtaaaatcatgggaaaccactaaaaaattaacttgtttttagggtaagggttttgcttcactaattttacattcacttgaattgcactctacacctgcacaatgtgcctttactctgcagctacattcacttgagctatgatttaacaacaccacttctattggcaatttcctctgcaacctaccttgggtattatgttgggcttcatagagacatatattatctttgatttctttggttagcaattaaaaacattttgtatcccttattttctcgcattcatatttattactctcacatcctccttgcagagccctagcacaacattgctattgaagagctagaagctactagcttggacttgacagggcgttgcgagtctctagaggagagcttcaacaaggagaagcctaaaaactggtgaggggtgatcttgttgggccgttgtgtgataacttctatattttcgactgcaattttatattctcaattttacatatggcagatcactatggaatcttacgagaaagtaaagcagtaaagggaatcagctgagagatcatgagatgtgctaactgtggacctagaaagggtcactcatgatgctaaggttttattgagcaggtaatggttgatagaatgtatttttgagaaatgatgaacatagtcttattgaatatttttacatgggtttctacacctatttgttatataatatgtgttgtgttaaactagctaaaaatgatccaagacacgaataaaaggcttcaataatacaataccagcctgcaacaatacaactgtaacctttaggctgatgcctcaaagagtggtgagactatctcgaaactttagaaaagagtgccatgatggaaactatggcaactctgagagagtgtaacaacttaatggacaatcgacttgaatcttctagagtgagtatttctatgaaatatatttgatcgactttgtaagcatgctctctcttctgccttgaaagcttaagtgctctctcttctgccttgaaaggttaagaacaaggcttgagtccctatatttaaatgatgtttgatgcttatctcatttggtaattgttctggatttcaggtgagaatttgagcccttttaaaccaaaacaaaaatacttgggtgtagaagttagcgattccttgcttcttgtttgtgtgggcctaaaaaacaagtatgggttgatggaataaatatttttggcctttttggttgtttgaatttcccaatttaaggtcatagcattagtgtgttagatttacatgatgacgtgcagttcacgaatagactgtggggcttctagattgggatgtggttagtgacttcgattaccagcacttgtgttagttaggctaacatcactgattttagtagtatgttaattgtgtgatacgtctagctatttgaatatgatttgacatatattgtagtcactcctgtaaatcgttttctttattcttccattttctttcatttctgttagtagtattttcaccatgctcttaaagaatcaaggccaaaatatgttctatgcgtttatcttgttgtttagattttcttgcttgtagccataagtcatgcttaatttttcgaatgtacctaggtcactcatttttggtagttatattgacgccaactaaaattagtgtttaagtattgtaaactacagatggtaatgcaaggtcttcaacctattttaccggctttggttgattgccataatctgttttggtacaagtttgcaatagtttaattccatagaagtattcagatgttgagtgagtatagcttgtggcctatcttatgatcatactcatgtgtactttagtttatgagaagcagcaacaaaaaaaattaatgccataatgttccaggctcttaatttttgagatacaattagttcattgcacctaacatattttgtttttttaagacagaaatcttcatttgatggttcagatccatgtaaagggaggaggatgcttgtagctacacttatgggtatcatcactttaaactgtgataatgcaaactactcattctttcagcctttactacctgcagatgctgatacaagagaaagtggtcggtgtccccctctcaccagaagccatctcagctgacgccatggacatacagtaagatgcttttatccctgctttctatactcgatccgtagaattgagttagtggtgtctttgttgatgaaaatgtgcaagaaagtgtagcaaaattctctagggcatccctaatcgactg

SEQ ID NO: 3331 - DNA, 1713 bp, Zea mays
  misc_feature (1)..(100): optimal_loci_184523_G1, chr5:73031867..73033579, Cluster 20
atctatatcttcacatgggagataaatgatactttagtatgtgaccatttgtcatgcaaaatgacaatttatggctaaaaccatcttaaatcgatgtcctttaagggtagactacgtcaatgtagatcaccgatctaaagcgggaaccccagtataaaattctaaaataactggagagaaaaaaaaggtaagccaacacatttaaccatgatgagatatgtatagtttttttagtttagaaaaaatcacacttttgctttccacacagtacgtcgcccttcacgtacatttcttaatgtttcggtcgctagctagaggctattagcaaagcaaatatagctttaaaaatggaacctcaataatacagaatgttgttttgcgaaaacgctcttagtttctgtgcaattcaagccgttggaggaccgaatcaacgacaatggagttgtggtccatatacttgttactgcataacaacgaattaactatttcaacgagcaatacgtatttttttaaaaaaaaatgagaggcggatgaattgtgaaagcgggaaccattcaaacagcacggactctttctccgacaacaaatcaatttttttttaaaaaaaatcattaagaactcgcccacctaccaaaaaaaagacaaaaaagcataaactaattccgcgtcacaccgcatatttcgacactagcaccagcgaggattaaaaaaaatgcccctatggacgatacaaaacaaggaaacgaataaaaaaatcccaaccattgttttgaaaaattcccactaatttagctccaatcactaaaccgaacaaggctaataaacttcccgcctcggttaagatctctgtagtggtcgtagaacctcagctaccattgcttcttttttttttggtgcgcaatattgtatatacacagcacggctatgtatgtatttgcttttctagatatacagtatttactatttatttagatatccactgtatctagatatacgataagaacatatttaaaaagatataatatcttatgatttaaattagaatgagggcatgccagccgaggtctcacatgattgcatttctgattgaaattattatatacaagaaagatgccgaaaccatcagagtttactaggaaagaaaattgtatttgaagatgcttcgtttcataatgatcgaaaataaataaaataaaataaaataaaatacatggatttcctaaactattttcatataatttaataaaataaatcagaaaaagagataaggcaggtgggtaggacttatctacacaaggggtgcgtgaactaatggacaaacagcagcacgtcatgtgcctatgttgttttttaaaaagaaaaaaaacatttttggcagcgaggcaaccataacaagtcaatcgacatcatttcatttgggtataataatgcaatactatgtcacactgactgaaccacctagatcacccaaatccataattcgcgtaaaataagatactactacaatgttggcccattgatcatatcaaatcgtccgaaatttgcccctcactaaaaaaacaattcagtcaaattacgcctcaataaacaaaacgtattttataagatggtcgagaatatataaataattcggctgcaagaaatatggtcccgggcggatgcatgtgaccgctttggaaatcgtaattaactactagtaagtgcttgcttcta

SEQ ID NO: 3332 - DNA, 1666 bp, Zea mays
  misc_feature (1)..(100): optimal_loci_187450_G1, chr5:92359147..92360812, Cluster 20
attcatcattctagatgattatcatcaatcctaaaatggtttcacaaaaattaaaaatggtttacaaattaataaagatttgtttaccaatttcagggtgggggatcaggtgggtgctcctacagtcaacaaactataggtatttgtactagatcatcaagacatcaacactttggtgtgcaaagattccagcaatcgttggcaagtaccacgaaaatacggcaagcagtaaaacaccttggcaggtagtctgatgcgtgactgccacacgtacatactcatcaactgggttgagcgggcaactgtactatcggacctcttgctatctctattcaaaagaatacaactcggtgctaacagtgttgctatattaatcatttttttaaacttaactagattgctaacaatattagcaatatttatattttaaatacatttattaatatatatatatatatatatcaatagatttagctttgttaccaattatacatgataaataataatatttttttatatttaatcaaagataaaatatttatcttcccaaaaaacgagggtggtgttattttctggagatggagtaggcacatgttaaattatttctgttttggccacagtttataaaattattttttacactacaaaataagtattgtcagatttatgaagaaaatattgattttagtaggtatttttggaacaaattaattcataaagtaacataaaaagtaatatgacatacatgatcaaaattaacagtattattccatatgtgactaatttagagttcatctcaaaggtcgcacacaagaacaagagaaaagcaaatggatgaagatactctatagcaggtcagtggcaagaactagagaaaagaaaagtaaggggatgaagatatactatgtagcgggaccagtgccacgcgggcacggaggcactgttctgtgtggagttgctatcaattttaaattgatcgacattgatgggtcgatagagattgtatgttgtgtagtagtgagaatgcatcgaaaatgtaatagaatgaaacagattatgaaaaaggaaacaagttagaacaagggaccacaaaagacatacaaaaataaaaagcacaaagatcgaagtgctgacatgcatcatcacaaaagatataaaaaatagctagcaacaaagaagcaaggctggaatggagagctctaagggactccccaagttaagatatttcttagttttttctactttggattggctcaattcatggatcaaaaatcaagaccgaacctaacacgatacacccatatgtatgtttctttcggacaagttagagcagatgacccatgatcaggtctacccatcaccagtcttgcaacacaccttagctagcgtgctaaagtgattcatcatcatgggaaaagttgggtatagtcaaggaaacaatatctttaggaaggagtcatccaactaacattaattcaaaagagcatggactccctatatcaacccaaataaaaatatgggcatgaacaaggtttgaacaaaaacattcaaccctagacagtaggtggacccaagttcacaaactagtagtgtaggccaactagagccaccacttacaacatgcatgaacttgagattgatatatatactcaagtgttgctctacg

SEQ ID NO: 3333 - DNA, 2460 bp, Zea mays
  misc_feature (1)..(100): optimal_loci_199951_G1, chr5:173160950..173163409, Cluster 20
cttaataatctttcaactattgcatacatggaacttttacgcagtttaataaggctttttatcaatcagcataggtatgtgtataggaaatcttctatacccaacagatatgagtaacttgatgggtaatttttttataagtataggtatgaaataatactacccatagatatacaccccgttgtcatcggtacatggagctcaacaacgaacgggctgcacaaatgtgtccccgacggccggacggggcaggtgcgagcttagttgggccagacaattcgctggagagacgctgttgggccaaccaatttgtactagagaaacagcttgctgggccaagaatcaaaccggagaaaggaaccctagcaagcagaagccgccgccgccgcgggcaagctataaatacggccctcctgaacgtttctacttccaccatctcttctgtccgccgccgccgccgccgccgctaggaaacgacgtctcgtctcgtgccttcaatctctccttttgccgtcgtcctgtgtttatcgcttgatttcctctgttatcccgctttcttcctctgtaagggcaaatgatgatgcaaagtcatgcaccactctgaatgaggggattatcctctctttgggctgacaaacggacttctacccatttttcgtctgagccttgtgattacatccgatttctttattgtctccctggcttttcttttttcttgctgcttactgtgacactgatcttattgcgtttgattaatggagctgtggagtgatctcggagaactagatgatgtgggtctgccgatccaaccatgatgcggactgaattttatttgaggtcaaatgtaatggattctgatggttctcgagtttatctcccttctgacattggcatatttctttcttccctcgaatgggtcatggagcgaaaattagtgcggctttgtttttgatctcttgctttcaattggtttgttggttagaaagctcaaagaaacaggtgatgaagccaatttgcagagcaaaggggccagataagtggcaatctttgcattgaaggttggccacaacgaaactgcagttctccgtgccgctcagatttctctgttttgtgacggcctcgaacaagctgccacattatcatatcttatatgttatccattttgttttggtttttatcttcttcgtatcgtgtctccagttaaaagctacggaaactaacatgaactacataatacatatgtacagtatgtagcgcatatcgcatgacaaccgaacactacatgccacagatgaaagacagatagtgtcagtaaagaaacagacggtaaagccaatttgcagagcaaaggggccagataagtggcgatctttgcattgaaggttggccacaacgaactgcagttctccgtgccgctcagatttctctgttttgtgacggcctcgaacaatctgctacatggtctcttatctgtgatccaatttggtttttggtcttttttccatcctagttaaaatcaaacatgatgaactatactaaacattacgtgtcgcatgacattggctttgaagcggcagttttaacagatgaattactgctcatcattaaagaacgagttaatatcagtaaagaaccgagtggataaatcagagcagatcagtaaagaacggttaactagggcccgttccaatcgcaactgctctttggtgcctagtaccgcagtgtggtatttaattatggttgaacggtatttgattatggttgaactgaagaggtgattgttatcgatctatgagtttgagaatgattatgcacacattgaaacattgattttcaagaatctacaactgaacaaaacataccctaatatgctgtatcaaattacgagggatactcaaatcactgatgctcaaaatattatgagggatactcaatttcaagcataactcactttatacaacatgttcatttggatgattctggaacatacgatgtgaacaagctagttgattcattcgttagcaccaattatcatcttcaaagcactcatgatttttgtagcaggttttcaacataaggcctaatctattctagttcggtttatgattaactataaatcgattttatgaagcataacttggatctacataatagcgattagattttatttatatgaaccatgagttttttttcaagttatgttttatgtcagttaaacctttatctaagacagattattgtgatgttgatgtagctgtacgttgatggtaaaatttatatgcagaataacaattaacaatgatctatagtagaatcaataattcagatgctacagttaatatagatccataccattcgaaaatttgttgaacatttcttttagtttttacctacggttactcaggatatgtttggttaggttgtgactatgaaaaaaattgttgtgaactacgataatat

SEQ ID NO: 3334 - DNA, 1820 bp, Zea mays
  misc_feature (1)..(100): optimal_loci_200497_G1, chr5:176879526..176881345, Cluster 20
tattactagcgattcagaagctgaagtgtcggtagcagtcatgtttcatgtctacactagttttgatatgatgtggtgtaccataggcctagaacccaatcattaagcgaaataaagaaatcgccgctaatatttctatgggaggttcattagtaattttacatggattttgtgtggcagataagttctcaagtgcacatgatagaactgtcccatcatgtatgctaggaatatatattgtaataaccatagtggctcgccagttatattttatgcacttatcatgtcacatgacccttcttttcatgtgtggcatgtgaggcttcaagtttttcacttaagaatagagaggggctttaaacaagactctatatgatatttatctcttatttttatgcttgcatgcaatatttttgtccatcccttttctcatcagtcaccttcctactccatttgttctttctctatagcagccatctttcctatcctccttgtttgaccataatagatgcaacctcctctctagaccagctttctcgagagagagtgttgaacaaggaggatttggacaaggtatgagagctcctaggatggatcatgtcgttagcctccaaccatgtccatccaatgtcatctcttccatcaacccatcgggagaagttgggagaatatatcatttttatattctcatgtaatgttgggtctaaacttttcttttatcgcttatttcttcacatccttgactgttatggtcccaagttgggcatcttatgcttattgttgtacttgtcctctcaaccttcacatacatgtgtaaagcgttcatcgaattgaggccatgtgtagaactcttttgcctttctttcttctttaggcatcaagtggccaaaatcgttttggttagattacctccaccttttcactaggccctaatatcgaacaacatatgcgaccactaaacttttggggaagtaggagcactagctcattgtggatctacatcatggtttgcccatcctcaatgttgaatcgagactagtgggaagatcttatagagatggatgaagtatgagagcttgttcttcgatgtattaaggagcttgctatggcaaggatatcttctacaacctcctagcacatttatatcctagcaccttgccttactttagaggcatgcaagagccatgttggacttcactagtgaggatgacaacatgtagattcaatcaaggccaagctcgagtcttcactctaacaccatgctgacctagtgcgattttgcaacgggtcttacaacgataatatgttggccaccccagccaaagtattccccttgtttgaggatgatgcaacatttgattgggtggtccttaggatgcccatacaaaacttagtggtttgggacccaaattgtagttctatcatttgttaaggccacgaagctttcaaatgatgtgattagggacctcatcaaaagaaggagacccctggtagtgagacaactcgctagaggcaaggggctgcagcaatgcatcaaggaaggggaaaggagttaccccagaagaggtcgaacctaataacactaggaggaagagggtatctcactatggcgattcatccctagagaagtgcaagtgatgggacaaaggaatggagctagaaaaaattcaggaggggttgaattaaaccgctacatcaatataatctcactaaaccactcacattagatataatagtttgaagtagtattatattaaatataaaagtagtactacattaaaacatcgacgattgataaaaaccatgaaacacataatgag

SEQ ID NO: 3335 - DNA, 1591 bp, Zea mays
  misc_feature (1)..(100): optimal_loci_202223_G1, chr5:186723002..186724592, Cluster 20
ttagccgctaaaaacggttaacaatatgcggtttgaaaatctgaaaaatggcctacatcccaaacttcctaaaatatcatctcttctagcaaaatcaatcataatagtcgtgcaaaatactatagaacttaaaaagggatagaaagttcatagggtcaagcggaaggaggaacaaaatcaaggaaacatcttgcaaactcgagaagtcgaattttagccgacaaaacacgaaagttacgcacttcaacattgaaggcccacaccgattacattctgttgtacacttgtttttgattcctttggttataaaaagcaaaacaacatagtaaaattaatgttcatcttcatctttaagctcatccttcttcgagaagaaagtcaagtgaaagatgaatatgagattaaagtgtatactccctccgtgcacatgatttgatcattttagtttgtcctaagtcgaactattttaattttgacaaatatatatatatatataatattaaattattttaaactacaaaaattacatattatgttagttcaagtcatcatgaatctagtagctttacttttatgaaataagatcttatgaaacatctgatataatcggtcaaagttgacagtgaccgacttaggacaaaaccaaaacgactaaatcatatggacggagggagtacatgaataaaatgtggacaaaactgtaattaaagtgcataagatatgaaagcaaggcatataaaaaatatttggtcatcattgcttactttctctaatcttttccattattaaattagatattacatttatacctttgactttactaagcttacaagacaaggggagagttacagcttcgaagacaaagctatttgctttctttctggtccaaaggcgtacaaatgcatgacactgtttctctaattataggtgtgggctacaacttcggtgaaatgacaactgtacctcaagcctgtacatttaaactatacaacatggtgagggtaatgatgcctttttctcttgacatcttggtgaacaaactcttgaagacttctttggcttcacccagcttggtcattcatacctttgcgctactgtcccgatgcttgtgtcttcgtttacggttgtttcatccgaaggtacttttggtttgagtacatgtaatacttaaaaataagccaggaattaactattatcttgatacaggctaaaccgtgctgagttaaattccgtgctagcgggcctgcgctagttgatttgtatcactaagtaccaaaaactgttccttagtctgctctactgaaagcggcaccacggccctgctaagatttggcccaactaaacttgagcccaactggcgaatcttttcttgtgtcttgtcttcatggacggctctctctcatccccacgagacacaaacacaacatgggaggagaggaggcggcctctgagtttctgactaaccttccttcccggtacatctgcatataaatccttccagcatcctgtccgtgtctctgttgatccatagtgtgcatatgtacgctcctctgtgttgttagtacgtgctaagttagttgtgttctgggta

SEQ ID NO: 3336 - DNA, 1415 bp, Zea mays
  misc_feature (1)..(100): optimal_loci_203199_G1, chr5:192157521..192158935, Cluster 20
ttttttcaagcttgtgagatggacgagacaatcttgacttattgcatgagtaagctgaatcgatctcgtctcgtctcgttttcacccttgctcgccacccctctagctccatatctagccgtcgccggccacccgagctcgatcatgccttcgcgcgatctacttgtccgtcttggtgtcagatctgccttcgcccgcatcgtccatggccaagatggtagcggtggagtacaacaacaaaaaaagttatgacaataaataaaacacacattgaaccaaaagaaaatttagtacaaaaacaacgttaagaagtacctcaaattaagaaaaaaattgtttggtacacaccaaatcagcaacttaattaaatataaattatcaaacaaagaggaaacataaattagcactgaaacacatggcttcaacaatattatgataagcttgaacccaaactatagaaaataaaccatgaggaatccaaactcaagacacataaagtcaattggtaaaagcaaaatgctagaatgagtgcaagattataactctgagtcaatggtatgtccttatgaaataataaccccgacaacagacctaaaaagatcacattgagggaaaataagagcagtgttcgaaactagagaagtagagacgcaagcaaatctcactagtgataaaaggacatgagttccgcacgggcacagagccatggagaaagtcaggggctcagggtggccgcttggggattttgttttcgtgagtttttagggtcgattcaagtggatggatacatgctaggacatctaaagaacatctatatcaactagttcgggtattcttttttcttgtgagcatgaagtttcgggattttgcccgttcttgaaaaaccctcgaacaaagatatgttttttcagatccctagagtttaattaataattaagttgatattttgggaatagttttctaaacatcgttaggaacatctccataaaatttgagcttagctagagttcttttgagcaactttgcacttttaggagagattttttggggtgatggaggaccacgttagctaggccgattttgaacctggtcaggtctgtctaaacttggctaggctgatcctgggccttagttagatacctgttttggtatattttcgagctatggtactacatttctcaattcgtttctttcctagggttttcgagatgcctaagaagttttctaagtcatcaaaccacccgttagtttaggtgatttgagtgtgcgctctttctttcctttggttgaagttgagggcatttcatcacttatgggttttagtgtgtttctttcctagggtttgaatcgttgatagggataacggacatttcagaagaaaatttgattgtgtcttcttcaccgtcctctcgtcg

SEQ ID NO: 3337 - DNA, 1770 bp, Zea mays
  misc_feature (1)..(100): optimal_loci_203803_G1, chr5:195439084..195440853, Cluster 20
tattacgaaacaaatagccacataattttatcaatacttttataataacaaaattattgcacatgtagagattaaagtacttatggatacaacatacacaagaatagctcaaaaaacaatgtagttattaataaatatttaataattgaatatatcaattaatcaaccaatattatatctatataaatatttatatgaaattataagttatataaaataagttacaccaataaataaataaactaaaatattaaaataataataaatatattaggtttaaactaaaacaaaaatattaaaaataacttaatatttatgaatcattaataatattaatttaatactaaatttatttttagatgtattaataaatggtttcaatgcctatggcggctcaccggcggcgccccggccaggccccacgttggtggcttcgttcatgtggcggcggcggcccgaccaggccccacgatgctggctccgtaccctgtgccccgcggtcgtggctgagccaaggacaggccccatggtggtggctgagtaggttgtgtgggcgacgccctggccaacttcgatggaggtggtgaccttcccatgaacggcgacgacagatggatttcctgaaccgataggaacacttcgctgcaagaggattcgatccatctcctgagtagcgtcctgttggatgttgttgtcttctccctccattgtgtccatctccaaggttgctgctcgaggaggagccgccgccaatcgtctacggaagaaaacaagagaaacagggaatacggaagagatcgtgggtgaagggttaccgtgtgtaactaatgacgggtaggtaacttttctgcaacttcgtgaggagttatgaaaatatggtttctaaaccatcctttgaggagcttcgaaaatttattgaaactggtctatagtttcaatatttttttgaaactagtttctagttttttttttttttgaaactagagctcatgaagctggacccattttgatagaaaaaaactacaacaaagctaaaaatgttgaagcgaagctctgccaaacagacaattagtaataataaaattaaataattggtcactcgttataaataaaaaccttttaaatagatttatgatagctttttccctttgcaaaacttatgttgttggatattatcgaatacagatcttgaattgaatagagaaaaatatttttaaaaaccagatgtattcatctagtatccatatcggaaatagatatgcacatggctattcatattattagtttgagctaattccgatattagataattcggatatgcatttcatccagtttcgttttctatccatagtgcgaaccgcgttgcaatcaggagaccatcggaagcggccagtatgcatggaggcggacgggtcttctcttccaagctcagcccagtggctgtggctgcaaacattgacagttgacgatcacgggcgtgagtgagtgcaaccggacaggaagaatagtgaaaagacagccagtcttggaagtggcgattccaagtccaacccggccgtgcggacgaaggcgtcgtcggctgggctgtttgacccacacattctctatctggatagaaaaggttgacttggtatacccagctgcaccgtacctgctgctctcggtgacctttttcagagtccttgccgctgagtggcaccatgcgcacgatggaaagaaaagattattgtcacggttgtggccaagtcaatgccacaacccttcgcgtcg

SEQ ID NO: 3338 - DNA, 1563 bp, Zea mays
  misc_feature (1)..(100): optimal_loci_204244_G1, chr5:197781125..197782687, Cluster 20
ggttcactagctaaccccttctaaacctctattagtagaggtttggaacaggtccttaatcgttgctcacgtgctcatgttcaataccaatcatcctacacgtagagttctcatacaagattgaatccacgtgtctatccccaatatgaaattctcaaatctcacatggtcgcgtcagattcccaatgtttaataaaaaaatcataatctttgtgcaacggatgagcatttatatattagagaatatttctgcgtgacacacaagcggcgacagcattttatttgtccagtttgcagcccatgattgccctggatggcataaaggactaggctttcagctggacctcttatggactcttgtccagggaccgagcttgtatcttgtatgttaggcccaacatgcaactcgctcaaaataggatgcaaaagccttcggaagtcatcgttaacagcccaatatcaagtataaggcctgttaagcatggaagctgatcgagatgcagcaggctacagcccatagtttggccattgcatattctgtagtactattgttcaagctgaccctttccactttctatgtttcatactttcatttcatatatatatatacttctggagaccctagcatgcatgtcgcaggatcacatattgggcacggaaaaatcaaagaaaatagtttttgatcattaatttatccttactatgtattgccaatacctaaataattaatatcatcttatggatacttcgaatacaaatctattaatacaaggtggcgtttggttgagtggttgtaatggtaacgataatgtaattaaataagagcggtatctattaccatggaaatggaaagcgccaaggaataagagccgtaaattgagcgataacgagatgaaatggggtggagctgactcccaccgtgacggatcatggaccataggaaacaaacaaaagcaacgacatcagattgcggtgggaatgattacgggccgaaataagcccaaccaaacagctcccaagttccatgtctgaaacatgtatgtaatttcaattgattgttgataaaaaaattatataagttgattttccttatacagaatatgattataattctagtatggcgagagtataattgtatgctcatgggtattaattttagggaaacaattgaaatcttcataggtgaaaacgaaatgcccactccaatttgaaaaatcaaaatcgtgtggacatcgtcaccagatgctgtgtcataggtgtggcaaaaaaaccattcaccagactcgtgaagaactttaaattgtggtagcactagcacaataggtgagacgacgagctgacctaaataaactatggcatgagacatgtagtgatagtgagaagtgacgtagctccacagcgaactaaacggactcttagttcagcttatgggccaagcaaattgagatggtaatgagtcgtttatgggccaagcaaattgagataagtaggaagtggatagtacaattagctggtaaccttgttagctagctttagccaagaatagaatgtgcatatagcaaa

SEQ ID NO: 3339 - DNA, 1948 bp, Zea mays
  misc_feature (1)..(100): optimal_loci_204578_G1, chr5:199882519..199884466, Cluster 20
gagacttgtaggcacagagggcgtagacggcgacgacagaccttatgactcagcattccatacggtacaagcaaatccgatcagagcacacctcgatgtgctaggtagtacaagctaggattttgggcactgtttatttatcccattagaatatgtattctaacatatgcaaggagcttcaaagttgcaacaacaaattaggttgtatccatttcatagttcatctataatttccttgagtctgctaattcaagacattagcttcaaactccataaaaagtagggtgggaaaagtaaaaggtggcacttactatgccatccaaacaaagttggtagaaagtttggatatcagctcaacagttgtgatgttcaaacttcatgttcttcatatataacatatatgagtcagcatacccattttgtagagttttgtcgagtccaaacatgtagacactattattcgcttatatggattctagtacaacatttgtttgcttactaatttcggttgaaggtttgtgtatcttaccatggggtcaatgctttagatgtacgaggacgaagagctactacatgatacgttataaaacaagcaacaaacaattgaggtatgatttgatagaatatgttaggtgtcctgtgcattgcaacaacatacaaaatattcaacaaaataacgtatagaatttgtaataaaaaatagacatacaaggcatgtgcaaattaccctttctatccttttttctatttattatcactccctttcttcatcatcttctaataaacaacacacaaaacattccatacattattctttgtacaaattaacatcgtgaataccatggtcatcttctagtgtcctctgtgttcatgttctcactaatctatatgcgtcaccaaaatatgcttaaaaataaatgaagaaagagacgtaagagcttatacatacaccccaaaagttacgtacaatcattttcatagtttttttggaattggaccacttaaattgttaataagccattaaaacatatccaagtagacaatagttacaactcacttatgtgaaaaacaaaaaggaaatgagaaagaaacatacatgaatgtgagacctcgaagactaacaacatctgttgggattggcctatacaagttattctgtgttgtaaacttaggaaacttttctgaaatcaactcacggataatttggtcgagtcaatttccctaatgaacttgggatatcaccaattcactcgttactaaaaaggttaagaactttcagattgatcagcttccctatatctggaagaatttcacctgatattaagttattctatagtgacctgagtcaaaccaataatatggttggatattgaacactggtactgtctcatttcacaaggatggatggtagtcataattagtgaaatccaaagtaaatacaatacaggttgattacagatattcactaacatggatgttcgtcaaaatagcaaaaacacaaaaatgtacaagccatgtatcacacccatgaaatggtaaaacctatgaaatgtggctttagcttcaaactacaagcaacaaaaatgtgcagattgggttcttcagtatttgcccattctttatggacttttcctcaacccgatacacctagttcttagattcatgtgcaatctaatcagatagctaaagcaaggtacggttagctaaatgaaaactcattcacacttctgcctatctccaggaaaagtgtcctattacacgtttctacctatcaccagggataaatgaaaaatccatcatatgcatgatgtccataatccatagagaaagatggagagcgctcacttgccctggtatgggtttagcaatgtgcaagtcatttagttttgtaagtctgcaatttacatttttttctcaccaacactatatgtctggaaacaatgacatc

SEQ ID NO: 3340 - DNA, 2374 bp, Zea mays
  misc_feature (1)..(100): optimal_loci_206654_G1, chr5:211211457..211213830, Cluster 20
attgtggtcattctttagtgaaccaattactgctgtgattttttagtgactacaattggggatgttgtgggcggtttggttctggtggctgctctattttagtgaataatctgatggactggatacaatgtttagtggttgctatttgttgtcatatacccttgtttttagttctatacatattccttacgcatgagcaaattgagggtattttttagtgaaccaattactgctgagggcattttttagtgaatcaattactgaactggtggctgctattgtttactgattaatctgatgaactggatacattgtttaatgggggctattattttggtggctgctattgttttaggttttagtgatgaatcagataatttgctccatgggattgcgtcgcttttgattgcaaaactgggagatcgttgatgtccatgccaattttttatccattatgtcaaatgcattcatgtattacattgatactgtttgtgttcagttatggtttagtctatacatggttctgcttcatgtaacagaaattcagtttattcattaatcagataattgatttaccgatgaaccatacatgattaggggctggtgttgttttagcagaacaattaaatctatacccttgttttttaggactgtatatactacctaatcatgagcacacgtgggcattttttagtgaatcattttttattgcaaaactggagtcgaggctgtccatttcaaattttttatccattatgtcaaatgcagtcatgtattatttcaacagctttgtgttcagttatggtttagtctatacatggttctgcttcatgtaacataaattcagtttactgattaattagataattgatttaccgatgaaccatacatgtttaggggctggtgttgttttagcagaaaaattaaatctatacccttgttttttaggactgtacatactacctgatcatgagcacatgggggcattttttattgaaccatttttattgcaaaactggagatcgaggctgtccatttcaaattttttatccattatatcaaatgcagtcatgtattatttcaacagctttgtgttcagttatggtttatttcatgatgtttgatatactgatgaaccatacatgtttaggggctggtgttatttatgccgagcaattaaatctatacccttgatttttaggacggtacatactacccgatcatgagcacatgggggcatttattagtgaagcatttttttcattttcctgtttcaacgtaatagaaatcctatagaaacaatgtgtcactaaattggttgtagtccgagatggtccttcatttggcttgaattttttatctattatgtcaaatgcactcatgtttttgtttgctttatcggtatatcttgcttacacttttgtgcattgaataattggttgggatttcaacgcttttgattgcaaaactgggagatcgttgctgtccatgtcaaattcgtaatccattatgtcaaatgcactcatgtattacgttgatgctctgacttcatgtaacagaaattcagtttactgaatttgttttagtgattaatctgtgaactggatacattgtttactggttgctattattttggtggctgctattgtttttaggttttagtgattaatcagataatttgctcatgggggcattttttagtgaagcaattactgatagaaacctgtatagttatggtggctgctatagtttttctaattaattagagaattgttttagtgattaaccatgtgtgtttagtggctggtattgttgtcatataccttgtttttaggtctgtacatactacctgtatatgaccacattagccttatgtttgaacgatttcacacatttacatttgtgaatgtgttgaccgcaagcatcatctttatttaaatcggaaacttggttttacaatgatgtctcattcccaatgtgacgccaatcatctgtactctttagtttttatctgttgccgcttctgtttagtgacctcgcttgtttgaaaaaaaatattatcattcgagattgctgccagcgttagaatctgatgttcctattgcgacacatattttttgggttgtctaggcgtgctgttttttataggatactaaaggagaaaacgtaaacaaatactggtcttagatcttcacagattagtgtacagttagcacgatgcattgcactttatggcaggagcataatatcaattggcagtcatagatgcattgcacttcatggcagttacgagctctaaaagtaaatagaaatgagtatcaaaatgaatcgcacttgtgtagaactgcagattgaacataaaacctacttgatc

SEQ ID NO: 3341 - DNA, 1777 bp, Zea mays
  misc_feature (1)..(100): optimal_loci_207289_G1, chr5:214105633..214107409, Cluster 20
tccgcttcaggctcagcctggcttgcatccatcgcccagtctccttggtagacattgggaacatctctgcaaagaacactatcgtttgttcaacatccagcctccttggtagccattgggacaagatatcatgtcaaactggctccacccaaaaaatacatcatctctaacgacaataccgagccaacacacgctcaaaaaacaacatgatttacggtttctggcttgttacaagcactgcacaataaaaaaggtaactataccatgtcaacctctatatgtttcagggaagccgcagtctgcaattctttatgggacatttgccattgaaaattcctaactttcttttccgtatcaaattagtaggtctactaatgaccgctccattagtcaaaaccatatatataaagattttctaaaggtccgagatttatcaatagcccatctgacatcattccttctaggtggactctgaagcgacattgacattttaaataaaaagaggagagtgaattagacagtctatttttataaaccacggctttcaaaaaaaactgtctagtcaaaatatatataataaataaactagctatatgcacctactgttttaactaaatatgttaatatctttttatcgcaaagtattatgcaatctatgttctaattctatgaactgccctaacaactaagttaggaaggtaaaactcgcagctaagatgcacaaaaaagagaagagcatttcaacttagaaccaaagaacctattattctgcatatatatttagccctcaaccttctacaccgcaggtcatttcacctctatcaatcttccagatctttttagtgaacagactggtccataatttctacgttaatgataactagtccaccatggattttatctttggatatagatactcatttttttattggtacttaatttgatcatctgcacttctccaaaagaaactaggccttaccgtatccatcttgctacggacccctttaggcaggtagtagaaacccatcacatacgtatgcaagctactcagacatatgttagtagtcaaaataagctttctcctgatgttatctatggggtctaaccttttaaccatttgttatcgttcccttcaaaaaaactccaatccctaacaccttgtgagagatacgaatgcctaagtatttcatggaaatattttaatatgcaagtgagcatattaccctttgattcattatgtttctaactatatccacaaataataactttatttttgtgaaaaaataattttcacacctgacaatcattcaaaacagtatagtgagatcttaaggttagtactggacgtatatatctgaaccatccaacatgatgtttatatcatctgcatactagatgtaataaacgccattaggaataagtgaagataaaccctcattgataaactatctgttaattgcttttatccaacatttcactgaaggagtcagccactgagtcaaacaatagataagatagacgatccccttaccttaattcactcaaaatttagaaatatggtcctcttgttcaatttacatatcttataacatgtcatatatgctcgttcatgatttttcattccattatattgcaaatggtttacccctttttatgtacataggtttaatcttactctcacatggtacatgtctatgaactttgattatacagacttacgctaaacatatcatgttttagcaataagaagttcatatgaactagtttccttttagag

SEQ ID NO: 3342 - DNA, 2066 bp, Zea mays
  misc_feature (1)..(100): optimal_loci_207333_G1, chr5:214339851..214341916, Cluster 20
atgtatattgtttcccccagacattttttttttgttttcaatagaggtacggtgtacttctgtaatagaacagacaaaggttgtccaatgaagctccagcaagctgcagtgcatagctagcctctgcattgcattgcatgacatgccatgtccttttttttaactcggtcaggtccctccaacatgtcctccatgaaaccttcgtttgttgttctaacgtcattgggatttgagaccacacacatgtcagctgcttcgttcggtaaattgcatgcgttggctacactctcgcctctccgcttcttcttactcctcctgcatgaggtcaggtccaccgtctacgtacgtatcatctcttgcattatagaacagccgcatagtggcgacaagctaagggcagccgcgccgagctagttcctggttatataaggaaggagatcaagagagacattgaaaaatgcatggcagcagcatataggttagagagagcaacaatatgcagtgtgtatgtgtagcctctcaactcttcaagtccatgccatgcctttccacagctttcttgaacttcttcttcttcttctctcttggaacggcagctttcttcgaatctgtctctctctctctcatctccgaagacgaaggtcaagaaagctgtgggaagaaatgacataacagggactctggaattatattctgtagctagtcagatgtgatgttaattggcggctctcttcctcacactatcgttctgtccgcaagcagcagcacacgggccggggccgatcttactcgttgagcaaggtgagcagctcatcagtcattcagttgcgcctcctccgtttcctccaggccattaattgttcatagttgcctgttcccctccgtgctggtagagagctccgtacgagctagcttcagcttgcgtccatgacggacgagcagcagcaagcctctccttccatcacacacctgcatgcatatgacaggtggacccatctgatataaagcacaaaaacatctatccaacaaattatcgccagcagataacagcagcacgaggtcacactctcattcactaatcgcgtttcattttctccccctgtgcatggttaattagcggccacacgtcgcacaatcaaaatatctctcccatataaactccgattccattgattcttcatcgatttatctgaaatcaaattatacccatcataatgtttcataatctttataacttatttaaatatatatatgaacaattatttgtgtttgtttgcatattttggtcattccgtgtttttaaagaacgaggacgtcgaggatcagtgctctcagaagtttgcctaggacgacatggacatgcatcgacgacggaggcaagtctaacattatccaccgtgatcatgttgatcctacgtatagacgcaacccgtagaagccatgttcaagatactgcataaagtgttttgctgcttagttccaaacatgtttagatatccattcttttgaattgatatgatgacctgatggttgcctaatgatggattattattacgatgtggagaaataattatctagtatgattaggattttgatgctcgttatgcataatgtcgaagaatattctaaattgattagacgtatcacgactttgcgagattgataaccgaaggtaaacgtagacatgaccgaactcttaatgcgagataatactctacatcatgtgtatgtgttggtggctattgcctatgatttgatgatcagccctcttgggacgtctcatcccttcttttttagtcaaggaggagagtggttacaagaaggttatccgatatcataccagataaggatacatatcgtactaatcgagtctatcaaaaactcttagttctatctttacatgcaagttttccttatcatgaggacactaccatattacatggacatcaacatttctattgatctgataagatgctacatcattattttctcagacgagtcatgccttttcctgtcacgtgggccgagtccctaaatagtgtagccaggttctcaaacgcacccgc

SEQ ID NO: 3343 - DNA, 1662 bp, Zea mays
  misc_feature (1)..(100): optimal_loci_2109_G1, chr1:10984939..10986600, Cluster 20
ttggttcttgcatatttgttcatgcatttcaacaaattgtataggaacatatttcaatgaataagagatttatgtctttaccatagcatgtatctattctaaattctaacacgtcttggaatcagagtatgcatcatggcaatatatacacgacacgtgtgctaacttgtatgagagtccaggtcacatgtgagagagaagagatgagaagtaaattatggcagatgcaagaatcctttatgttttaaatattagactagtacaatatgcacatttgtacaaataatatattaaatattagactagtacaatatgcacatttgtacaaataatatattacctccgttctcggatctaaatgagattggtcaaactttaaatcagataaatttttagatccacaataaatgttagtgcaataaagaagtaagtatgaaaaataaaagaaaattgactcaattaagtacattaaagctacaatggtactaatcgcttctatgaatttttgttggctataaacacaagaaattgttgacttggcaagtttaaataaagctatggcgaattggcgatcataatttttcaatgaattttcattggtgtgcaaagacattattgcgtatagcttgattaacttttgtgtacacgagtaatccctagcatagacattccatatggctccctagctttttagtatcgtcacaaaatgcaattgtaatgttgattgaaatctacacaattgtcgtatgtttccattactagtactattacataaagcaccatcagtttcagtggttccaccatcgtcgtaagtaactccttccctccccaacatttaaatggcaaagagttaaaaatatgcacaaatggggattcaaaccatagtcgtaggttccaaacctatattcacatccacctagctaatataacacacatctttatgttttatattctatactcaagcataaatagaaatcataacaatgtacatacactttgctagtatgaattatattggtcttcacttatttatttaaatataacttgataaatctagatcattactatttatatgatttttgttcttgtaataacctaaaaaacatttagttttcctacattgagctttccctcatttatattttggttaaaagttcagttacatccaattgaacacttatataccctagagtattgcctttctttttttaaatacagttataatgagaaaacgatatatgttttgcatcttgtattttacttgcatgtgtgattttctttagcatcttggttatttaaagaaatgtgaaggaccgagaaaagtgaatggatagaggtgaatgagaaccaaattcaaatttcttctgaaatagcaactgtccgaaaatcaccctccaaaattattaaactcacaacactgatgccctcaagctaactggtggctaaatgctgttgatgatggccaaatagagggacagtaaacaacaatagaaaaccaactaggacaataaaacgacgggtcataatgaagtcagactcaaaatctcctaacttaactagtgacttgaggactaagaaaacatattagtacacatggagcaaagcgaaatagataacaacaatagacacaacgaagcacaccaaaacgtccaaataggtgca

SEQ ID NO: 3344 - DNA, 1620 bp, Zea mays
  misc_feature (1)..(100): optimal_loci_211704_G1, chr6:24313149..24314768, Cluster 20
ttaaaatgttcacctctaattttgatcacagttctagaataaatgcactacgaagatatatttgttggtatacctacagtctctttttttttcttaaactcgcatattccacatttgcaacaccatatacaatttaaaataaacttgtaatactaatgcctactacattaccaaatatttccacgttgctttggaccaatccgatggactttattacgtgcaatatccacttatatttcacatgctctttactttagcgttgtccagtttttttttgcctaatttaaattgctttgatcttggacaaatttgcattcatacaaatatatattaagttgtacaagttctaacaaatacttattaaggcatatttagtaatgcgatggttttaatagaactaatttaatgatgtagatgttgatgtattttttttctattaaggcatatttagtaaaaaatgaatgaagcttgattcagataaaactgaggtcaactataatttaggtcctgtttgagagagctccacttcaagaatttcaagcctatttcagcttcttctatccaaacaggtctagctgcacgagctctagcttcaaaaaaattgaaactataggccaatttcatgaaatttttgaagctcctcaaagggtgcttcaaaaacattgttttcatgcattctcttgaagttacacaaaaattacccactatgccattggttgcatgacatattgattcaaatctctttcttcacccgtaaatcatcaagggtaattaagaaaactcacacaaattaattgtattatagaagctggagtatatgtgtgaagccaaacacttttgaactccgcttaattaatatgttgaagttgtttcgtagtgaagatggaaaactaaagctgcaatttttgaattcttgaagcgaagccctcctaaacagggtcttgatacccaaagaatactatatagatagatgcatcgaccgttccgtggggagatggctacattaattactgtatagtaggagctattcaagggacacgaaaggaggggggaaatagcgagagaatgggctaagccacaagtaatcaactcactggtggcccatcagggcccaaactccagcctactaaaacacactgccaagtttggatgggtgtaatgtaatgccgcagtgattaaccactgcgtcagtagtcgattatattacatatatatacattctctcgtgtccatcaaatttaaattaaaatacaaaaaacgaataaggaaaaaaaagcaatcgcatccttaaattgctacttacttgaaatctccgatttgtctatcgcagagtttaaaaggatatcctttactctatcaatgtaaagtcaccctgcctccaaacagattcaccatgcagctgctcaaagtaactgcacccgatatggacgccacgaaatcctccgattctaaacacagtatatttcatgctggatttaattcaaagatccaatccgtgtgttaattctttctattcttctgatgaggccatttctactcactctgcctataaatacttacccaccacagcaaatagcaaagaacgaagaaatcgatccaaattccaattcactcccccac

SEQ ID NO: 3345 - DNA, 2380 bp, Zea mays
  misc_feature (1)..(100): optimal_loci_219497_G1, chr6:76480982..76483361, Cluster 20
cgtccactcccatatgcccttgccctgctaccacgttgttcttctccggtatcaacatgctcaagtttggttggaggatggatgaggcatgtgtcgcgatgccgctggagctcaggtgaggagtgttgctgatctaagttcatcgatggttttggtttctttggtggatgtagattggatgggaatggctgacaaagccacaagtgacccacatgactgatcctaaatttggatgtgtcctaccaagatgccttgtcatctagatatcttttgcttccttagaggcttggaggcagaggtgattgttatttcttgttttttatgggttcctcaatgattctgttttatgattcatcttggaggcaaagctgatttcttgattgcattactgaccattttatttttgaaatctaaaagcactaactgatgattttcatgtgaattgtcttgcaaaaaacaagctattttgcatatgagaatttatagcatgattgtgtgataatggtttcaacgttctaatgattattcagttaatgaagtaaattttacaactaaagtagatttcattcttttttcaaacaaaatattcacatttatttttgtactggcgtgttgactgtcgtgcaaaaatgggtcctctacattgtatcggttgtgttgattgacacattgtccttgtgtatggtagctaggtattgttagttggtcaaatattattttgtagattattgaacatcattgttccttacttgtgtagtttgtgctagcctgaaaaacacttatgttatgaagcttattacgccttcatggttattccacagagtggatacaagttcagtgctttaatttagtttttgaattcttttgcccttcaattcatagtgagacattgagttatagttctagcaaactctctgtatgactgcacctaaacatttttattttaagattatttgatattcattttcggcttgcagtttagaaatgatcattggatcccctagtagccaaggttactaaagggtaatagaacatcttgaccagcagatttgtaatatttactctgtttggttgtcaatgtttacttgttgtttaagttttgtttgattgtcaactttttctcactgtttagggtttcactctacttgacacttcagttatctatgcgactaggcctgttgtttgacttgcggtacagggttttcagacttttactctgtttgacatatttacctcaacacaagttagttgcatgccattatattaagaagagaaaaggcggtaatagcccttaccaaggggtgagctgagtatcctttctatttgacattaaaatcattaatatctgcttcagtgatataaattccactcatgcaatctcgcttctcaacaacttccaagttttaaccaccattagtttgagattttctggtctatcttttgaataggaagcctggccaaataatatccaaattattcagatgagttcaactaaattcttatgctatctctataaactatttagtagtgccttcgcttacaagttgtcttatgcaggacttttgttgacaacttataccttgttcctgctcttttgttgctcatcggagacaactaggtgcttggtatacatcctcataaggtgcatcttcggtttgtcaatccacttctaccctccaacaaaattttcctgatctcaactaagttatgtatacacttgttatccttaatgtataatattcacattatttagatttatggtgtccttagcacgacttccgagtttaggataagaaataaagattatattttttgctctcactcgttattccgttctttttggtattagtttagttctatattagttcttgccaaagaatttgttagcttgagatcaataatatatatgatgttcgtttttatataatcgttgtgtactaacattttgttggatattttgcatgtcgttgcaatgcacgggcacccaactaatacattagaatatatgactactttcactacatcatcactgtcttattttgttgtgctgcatgtctaataacaataatgatttataattctctatttaaacattatgttaattgaattgtctagcttactcgtccttagtctagagcagcatgggagggctcgagccgtcgaattaagggcgagggtggtgctagctagagctggtggcgagcggctcaagtgggctggtggcactagagcgcatggtgggccggcgtagatgacaactcgagaagaaaaggaaatgaagagatgtgtgacccaaaaagacgaattatatgcatccattttactcaatcacctcaattattagataaaaagtactctcccattttaatttataatttat

SEQ ID NO: 3346 - DNA, 1641 bp, Zea mays
  misc_feature (1)..(100): optimal_loci_220274_G1, chr6:81694782..81696422, Cluster 20
tgcaaaaatggtgttaaagctactacttgcactagcactaattgaccatgtgaaagcctctaaatagttctagtagcttgtattttagtctatgttgataaaaatgggctactaatcaacaaggtaaaatacaactaacaagagttatcaatcaaatgcaattgccactacttacaatctacacaaggctagttaagcaaatatcattcaacaaaataagtgtagcgagcaaaccataaggggcaagacatggcacacaatatatccctaaggttttgtttgcttttcgcaacctactccttattttggcgagcctattctaggtggttcacatgttaattgacatcacatgctaagcctcaattagggtgtcataagaaccacactagttaggcgctccaacaagccacaattttatcggagttgctcttcacaaatctttcttagggaatggacaaagagcccctcataattgttgatcaaagctaacaacaatctctaatagccactcaatgaccccacaaactttgggtcgtctatgtaacgacaatcaccaatagtaaccatagtataactagccctagtcgctcaactaatcccataacatccaagaactatatgcactagaagctctctaatctcacccaaatgttgatctacaagatgtgagtggagtgtgtttccctagcctcaagaggtgttcacaagtatcttaactaagatcgaccaagaggtatatttatatagacccataataaaatccaactattatctcttggtgactagtatggtgcaccgttggttcctgtccctgacatattcaatttctttccaacaactatagttccaaaggttacaaactagatgttgccatctgtcacatatatggtacttatatcagacacgacattagacacatctagtgtgtgttagagctagagtacatatttacaagctcttcgagttctctacctggtgtgacatcagatgccgcatcggacacgaccgatgagtgttagagtgaatgtgccattttacatgttctatgaatccctgttcggtgtgccattcaatgttgcaccagacatttagataagggagacctagtgcacactggacttcactatgatcggctaaaactaaggagcgtgtgtgagcttgccttgtcgggtgcatatagaaaagctacactgagagcactttctcgtctcttaaacatactagagcacatttaattttttctaagtattttccacaaacacattaacttgcacttcgcatgtgtcattgagcctatatgcaatgcacataatttcaatatctagtggcactagatggctgaattatccaattaagcttccttcgtaatagtatgatcatctatcctagatcatgatcatgtgttccattgcatcttgattgacaaaacaaaatgtagttatatctttgtcttgagccattgcatttttatacccaatctttctatgttgggcacttgattatccttcgtggccatcaccattcttttcaaggttgctaatattgcttaaatttagatgtggacctaacctattcatgatactagagtaaatgttactccagtagttttctcaattaccaaaacctcatttcgaacattca

SEQ ID NO: 3347 - DNA, 1422 bp, Zea mays
  misc_feature (1)..(100): optimal_loci_2230_G1, chr1:11954311..11955732, Cluster 20
  modified_base (367)..(367): a, c, g, or t
  misc_feature (367)..(466): n is a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
actctatacttataaatagaaatcttaagcaaatttcaaatggaccatatatagagtcgaatgaccgactggactggagtcgcgtcctgaagcccagcgggcagcctagaatgggcggttgggctagttttgggggatttttttttttttggcgtgggagcccgtggggtagtcaggtgagcatggccgcggtggcgggggcgggggccgcggtgggagtgggctgggctgggctggtgttgcctgccgtttgacagtttgagagcgtccgatccggacgtccggtgaagcaagcacgcgatgagcggcagtaaccaccatgctcgtcgtgcgtgtgtgagcgtgactgtgaacttactgtatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtggtgagcgtgactgggaacttactgtatgtccgtcgtgaggtcgcctgaggccataggtacacgaacgcactagccatgtacccgtttgggtaggacacaccacaacctccattcaggacgtgccaaaagtgccaagcgccacgccacgccatgcgtatgtgctgtgtggatggggcagctgtctggcaccactcaaggcacaaggtggggtccacggcgacagtggcgacgcatgtccaccgctttggcgcatgcaagcgcgctggtggctgtggctggtgcagcccgtgggttgtattgtacccgcggcgcacgcgcacgtccatttcgtcccggacagacttgccaactttgccagtgcagcagcaggggccctttttgaacataaatataaataaagcgaccctcatacagtcgcctactagtctacttcaagattatattaacttaagacactaggccgatctgtaactgtaactgtaactgtatccatcctatgcatgataccacggtcctaccaaattaaaaccatatcgatgtgtcctaagttttaaagtttacagtattacttaaagtctccacgttatcatataaaattttatagtgtactatgatcctacaacaccgtacagtaattaatataaacgactttttaaataattgagctacaataaagtattatttaaaatttaagcagaactattacagtagtgtaaaattttacattttaatgtagaaacagtgggataaattaattacagacagaattatagcctttaatctatataatatattacagataaatatataaaactataaaatcacatggtattaggatactataaatctatgatacgatgctacatcctcacaactttgatccttttctaaccatgaaccattatttgatccaaacaacctgctctaacgaatcaagctgattcatgagc

SEQ ID NO: 3348 - DNA, 2041 bp, Zea mays
  misc_feature (1)..(100): optimal_loci_223716_G1, chr6:102417034..102419074, Cluster 20
ttcaaaaaaaaacatggcctccattcatgcatattctttctttcctatttgacaacacaggagatcgaagtgtaggaatgaagcacgaatcatctcatctccacagtttggtaaagctagcgtgcagtcaatgcagatgggcccagtacgtgtgagttagttggtcagtcatgaagtacgatcgtgccactgccagccaaaaatgaagggatcacaaacaacaggagatagcgtgcctgccattgacacatacagtaggatgagaggtctaggatgtgttgatgaaaacaacagttgatcaccatttatagtacacgaagagatagctagcatagcatctgattaagaccgtgttaagttcagtgatggttaccacaaaaaaaaaagcggtggctgtatatgtagcaaactcctgacaaattaaacatatgatatgcgcctcctcataattcagggaactgctgatcgagactggtgctcttaaattttggaaaaggccataccagtttttgcctagctagatatcttgtggtgcacaggtagtatatatactactagctggttaataaggagcctcccacgcatgttgcaaaagcatgcattgaataggtctagctagtaggatagctagctgtactggtccctcgtcgtcactaacttcgtgctaattttccttcagtcccgttcggattatgatgcatggtctcatcttaattaggttgcaaggcatagtaatgatatttttgcatgcccgccagttctacctaaacccctctagatctgcggtgatggttgatgtacatgccagtaaatggattaatgacgacgtttcctctccctaataattgatgagagatcctgagattagtcataaatatacttaaaggacagatgtgtagtggctcgatcagtcttaatcaacgcattttacagagagaaaggctggtctcggtttatctcttcttcttcagacctagctatttatatggaagctagcctccaacactactacaccttccgttttagtcataatatactttaaacaatacttcctccgtttgtttttatgtgacatcagccgtcaaattagaaagtgaacgtacacttgaagtaaacagtcttgaacggggaaattaaagtcaaactattttctcaacaatcgaattaataaatgcagtcttacaatccattttacaagccctaaccagcagatcatcctgggaatgaagatatatatgcatgccaaagaaatactgtaaggacagtatagcacatagcaacacatgtgtacaatatataatatccacattcattagattaattatccccgcaatactgcaagccactagctagctgtagcagagaccagccaatataaatcatccattgcataacgctagctagaaatatcaccgacagtgtatgatcgcactgcatgcccctggtcctagcctagctgttgatcattgagcgagtctgatgatgtgttttctcttcttttcctccttccatatttaatcttggttgtcgatcgataatgcgacgatgcatgctctttaagatttgttttgaagcaacctccgccgagaagagcaagaagccatggagttccccctcaatttcttcttgcgcttggtcaaccagtttgtttcaaacaagtgcatgccatacgtactgccacaacctgtcactctatcaggcttgttaccttcctcatttctgggaatacacaactcccaaagcacagtaacctgggcgggcatgataaagtgctggaaatagttgcatgcatgatgcatggcctgctatctcaaccccattattaatagagttgtataattattaatagagttgtatagatagatgcagaacactgtaaagctaagcactgttcagtgaaatcacaaaaaattcatgagaaacagaacttgccccctccgccaaatagggaaactatataatggaggttcgtgatcgcacaaaaatcatcttgagaaaccgcgaaagtgaaacatgttattgcacttgtcgatcaaataat

SEQ ID NO: 3349 - DNA, 1499 bp, Zea mays
  misc_feature (1)..(100): optimal_loci_225224_G1, chr6:109532676..109534174, Cluster 20
ctcatatgcatgcaacgcaggagccagggaggatcgagatcgacgacggcgatcgatcgagcatgcgcagagggttcaggcgtatgcaaatcctcgcaggagcgcacctgccgcaccaccatggaccacgccgatcgaggactcgcatcagcaagcaccatcctcctgacggtcttgcgaagaaatcaaaggcgccaaccactctttgcccccacagcaaactgttcttctcttttgtttagatgcgtacttaaagctggatcggaaaaaaggggagacgaagagatatgctagctatagtagctagcttttccattcgtttgctttgggcaaatgggctcctctgcgctgcggcgcatctgggcctgcgcgtctgcaatactagctcgaaaggtttgtgttgttattaataattgtttggatatagaactaaatacaacaaaaatggtgttttctactgcctaatatttcccgtcgtccgaacacgacaaataaatgaacaaaacggagggagtatgtttcttgatatagaagaaactacacgtatttacctacgatattttttaacatatatatacccctctgtgcatatgaatggcgggtgcacgtgtgcatatataaaattctagcctttaaaattagatataattattaaacggtgcacgataccataaagttttctacaaatgaacccgccatgcatgcatggatgaaaggtttcttttatttatttattatttataaaacacgcaccgttagatctgatcttgaaggtgcaccggccggcacttcatgtgcattacatatcatccctattttttcccctctaacaaaatagatgcctttacattgaaaactttgccactgcacccacgcccaagcttagtcatgttttagtttttagacacgtgacgtttgtttacatgcacacgtactacaattaacaattacgtatatgataaaccacactttgttactactagtactctgaccctgagtttttttgactaactttatacacttacaattattgtaggaacggaactagttggccaaacatttgttttttcttcttctacatacacttctccatctttccttcaacctcctgctcgtgctattgctttcttcttccttgtaatcaactttgcatcccatatccatgcataacgcagttgcttcttttgggttgcgttatgccttaagtaacccagctattgctctctccatctttgagaaggaagagttgggcgaactctttctcttctttttccacctctggtaataggatcactgtcagcaagttgttcgatcagcttctaaattttgagacccatgcaggcgttgtccctaatagcagatctgttagcgctatgagccgagaacatgatggtgctactcgacgataagggtgggatctacggacttctaggtggataattcaatctttattgcactacattatactttctttctcattaaggatcagaaaacaaaaa

SEQ ID NO: 3350 - DNA, 1591 bp, Zea mays
  misc_feature (1)..(100): optimal_loci_225909_G1, chr6:113043688..113045278, Cluster 20
  modified_base (1372)..(1372): a, c, g, or t
  misc_feature (1372)..(1471): n is a, c, g, or t
  modified_base (1373)..(1373): a, c, g, or t
  modified_base (1374)..(1374): a, c, g, or t
  modified_base (1375)..(1375): a, c, g, or t
  modified_base (1376)..(1376): a, c, g, or t
  modified_base (1377)..(1377): a, c, g, or t
  modified_base (1378)..(1378): a, c, g, or t
  modified_base (1379)..(1379): a, c, g, or t
  modified_base (1380)..(1380): a, c, g, or t
  modified_base (1381)..(1381): a, c, g, or t
  modified_base (1382)..(1382): a, c, g, or t
  modified_base (1383)..(1383): a, c, g, or t
  modified_base (1384)..(1384): a, c, g, or t
  modified_base (1385)..(1385): a, c, g, or t
  modified_base (1386)..(1386): a, c, g, or t
  modified_base (1387)..(1387): a, c, g, or t
  modified_base (1388)..(1388): a, c, g, or t
  modified_base (1389)..(1389): a, c, g, or t
  modified_base (1390)..(1390): a, c, g, or t
  modified_base (1391)..(1391): a, c, g, or t
  modified_base (1392)..(1392): a, c, g, or t
  modified_base (1393)..(1393): a, c, g, or t
  modified_base (1394)..(1394): a, c, g, or t
  modified_base (1395)..(1395): a, c, g, or t
  modified_base (1396)..(1396): a, c, g, or t
  modified_base (1397)..(1397): a, c, g, or t
  modified_base (1398)..(1398): a, c, g, or t
  modified_base (1399)..(1399): a, c, g, or t
  modified_base (1400)..(1400): a, c, g, or t
  modified_base (1401)..(1401): a, c, g, or t
  modified_base (1402)..(1402): a, c, g, or t
  modified_base (1403)..(1403): a, c, g, or t
  modified_base (1404)..(1404): a, c, g, or t
  modified_base (1405)..(1405): a, c, g, or t
  modified_base (1406)..(1406): a, c, g, or t
  modified_base (1407)..(1407): a, c, g, or t
  modified_base (1408)..(1408): a, c, g, or t
  modified_base (1409)..(1409): a, c, g, or t
  modified_base (1410)..(1410): a, c, g, or t
  modified_base (1411)..(1411): a, c, g, or t
  modified_base (1412)..(1412): a, c, g, or t
  modified_base (1413)..(1413): a, c, g, or t
  modified_base (1414)..(1414): a, c, g, or t
  modified_base (1415)..(1415): a, c, g, or t
  modified_base (1416)..(1416): a, c, g, or t
  modified_base (1417)..(1417): a, c, g, or t
  modified_base (1418)..(1418): a, c, g, or t
  modified_base (1419)..(1419): a, c, g, or t
  modified_base (1420)..(1420): a, c, g, or t
  modified_base (1421)..(1421): a, c, g, or t
  modified_base (1422)..(1422): a, c, g, or t
  modified_base (1423)..(1423): a, c, g, or t
  modified_base (1424)..(1424): a, c, g, or t
  modified_base (1425)..(1425): a, c, g, or t
  modified_base (1426)..(1426): a, c, g, or t
  modified_base (1427)..(1427): a, c, g, or t
  modified_base (1428)..(1428): a, c, g, or t
  modified_base (1429)..(1429): a, c, g, or t
  modified_base (1430)..(1430): a, c, g, or t
  modified_base (1431)..(1431): a, c, g, or t
  modified_base (1432)..(1432): a, c, g, or t
  modified_base (1433)..(1433): a, c, g, or t
  modified_base (1434)..(1434): a, c, g, or t
  modified_base (1435)..(1435): a, c, g, or t
  modified_base (1436)..(1436): a, c, g, or t
  modified_base (1437)..(1437): a, c, g, or t
  modified_base (1438)..(1438): a, c, g, or t
  modified_base (1439)..(1439): a, c, g, or t
  modified_base (1440)..(1440): a, c, g, or t
  modified_base (1441)..(1441): a, c, g, or t
  modified_base (1442)..(1442): a, c, g, or t
  modified_base (1443)..(1443): a, c, g, or t
  modified_base (1444)..(1444): a, c, g, or t
  modified_base (1445)..(1445): a, c, g, or t
  modified_base (1446)..(1446): a, c, g, or t
  modified_base (1447)..(1447): a, c, g, or t
  modified_base (1448)..(1448): a, c, g, or t
  modified_base (1449)..(1449): a, c, g, or t
  modified_base (1450)..(1450): a, c, g, or t
  modified_base (1451)..(1451): a, c, g, or t
  modified_base (1452)..(1452): a, c, g, or t
  modified_base (1453)..(1453): a, c, g, or t
  modified_base (1454)..(1454): a, c, g, or t
  modified_base (1455)..(1455): a, c, g, or t
  modified_base (1456)..(1456): a, c, g, or t
  modified_base (1457)..(1457): a, c, g, or t
  modified_base (1458)..(1458): a, c, g, or t
  modified_base (1459)..(1459): a, c, g, or t
  modified_base (1460)..(1460): a, c, g, or t
  modified_base (1461)..(1461): a, c, g, or t
  modified_base (1462)..(1462): a, c, g, or t
  modified_base (1463)..(1463): a, c, g, or t
  modified_base (1464)..(1464): a, c, g, or t
  modified_base (1465)..(1465): a, c, g, or t
  modified_base (1466)..(1466): a, c, g, or t
  modified_base (1467)..(1467): a, c, g, or t
  modified_base (1468)..(1468): a, c, g, or t
  modified_base (1469)..(1469): a, c, g, or t
  modified_base (1470)..(1470): a, c, g, or t
  modified_base (1471)..(1471): a, c, g, or t
cacattcagggccaccactgcaccgaccgcggcgagccgcactgctgcgggaaccgatagtttctttttcgcaattgactaacattccggcgagtcgagctgtgcagcgctggcttccaccgccatctcgccattgattagatgtttcatgtggcctccggtggcaagtgcgctgtaccagcacccagcaggctattattttgtcggcgcagtttctttcgagtcatagtggtgacgcacggcacaagggtcaatgcgggtgcgctgataatggaggcattctcatcagttgcaaacacgaagcgcggccatatcttacactcggttcgtgcttctcctgctatattgcatcttcatctcatttattccgtgctgatttggtggctcgtgtaacttttggttccacctcctattctcctttactgcgtgacacaaagagtaaactagacaatactactacgggctgctagcatgtgccaattcaagaaaagggggaacccacgaccacagaatgggctttaggttagacagaggttgagttccatacgaacatccaaccttctgatgatttttttgtgtgtctgcttgatagcttggtaatggacatggatggtgacctcagattacatcctatgatgagaagagcgccctgctggattatgttatctgtgatcctggttcagtaaaaattcatgctgacccagcaagaatcttgggcagtgaatcaacaatggtggggcccgttcaaagatttagtgggtttcaaagcaatgcctaccgatgcttgctgagtaggtgtgcatcaatggtcctttcgcattgacttttcctcatgaagttgcctgacaattatattggacttttgtgggtcagtcagtcatgttcaggatgaatcttgactcctcagatcaacttaaattgaatagtctgattaaccatcgctttgtacaaatccagctaaggttacaatgattgtggccgttattggaaacccgacctaccactgaaatcattctagaccagaatcaaagtacagcaacctcaagtgcactatgataacgttatagccttttgctatcactcagacttgtggctccctcagtttgtctttctgcattctctcttctcttttgcatgctatccaatttcatgaagtacaaagtatttaatgaaagtcacagtgtattgtcttggtaactgcatgtgcactcaattatcagtctagacattctggaagttactgtttatttctcagctttgatctatccactggacattgaaattagctttgatgttctatgttttctactaaatgttgtaagttcctttgtacagtaaaagttatttatgtttggacgaagggcgaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactacatacttatcatatattagagagaaaagaaagaaaagaaaaaagaaagtagttcgtgcaacgtaggaaccccaagataactcagacacttatagccaaaaacaacctatatactt

SEQ ID NO: 3351 - DNA, 1427 bp, Zea mays
  misc_feature (1)..(100): optimal_loci_226024_G1, chr6:113778611..113780037, Cluster 20
cggagtaggaggaagatgggtcagtaaagcatcattaacattacaatactgtcacacattgacaacgtcaaggtcgaaacaaaatctacgtcacatcagatatttaaataacaattgtaagtattaaatatagtctaattataaaactaattatactaaatggttagataaatctaataaacgaattaagactatatttaataagtactcgtaattgatatcggaacatttcggaactttagtcattaaacttctgacagtcctgagaagaaagctgccgagctcaaaccccaatacctgtacaatgatcacgacaacacgacagttttttttcaatgatgtccaatcctggcctctactcatgagtgatgagcggctgcatccgagaagaaacagtggtcgtgactaacaacagctttatctgatcagcgctagtacctctggacctgagacctgaagctttgtaggtcctgctggagccagccagcaagatttgaaactgaacaaatcattggggctcgtcaatttaggggttaagtacagatattattgatattgtatttatttattgttttttgtttgaatttgattcgaattcgaatagtattagctatattagaatattagataggatataaatatgagatttaactattcattcatatatgaatgtgtggtattagatattaaataatcaggctcatataagatgaatctaaactcttgtaaataaattcggactcacatataccatcagaaaatatacgtatgaacacggagacgaggatctctagagagaacaaaaacaatttgatattccacatctggttactaacagcacctgataacaaattatatcgatttggaacagcaagagaagtcaatttgattcacctctcagatgagatgagatccctatatggaatatggcgcatgcatgatacccgcccgctcatctgattgagtggagtcatttggtgcaggcacttcacaatgacttttgtgatataaaatcaaggagaaaggaggagaaacacactacatgagagagttccacgtcactaaaaagcactatccttcattatctcatcggaatacttactgtaccttgaaaactcttggttccaccgttccactcagcgtgggcaccgtgtagtccaccacgattggatgtcgatgcagaaaagagagatggtgatagagaccaaatggtcacgcttttccataaggacggagcatcaacagcagttcacttgacagtggtggtaagtggtatcttgatagagtcctcgctgccctatggaatattaggggtattctggtatttgtatctacgtgtatatgatttataggtcttatgacaaatttttctaaacctattgataataacggtaaatagcaaatctcgtaacaacactgaacaatga

SEQ ID NO: 3352 - DNA, 2643 bp, Zea mays
  misc_feature (1)..(100): optimal_loci_226783_G1, chr6:118502611..118505253, Cluster 20
gtatatagaagcgtagtctaagattagccgatagaataggttaggttaaatctagttgataaataaccttagagggaaataaccactccatcgcatttgtagtatatgatatatccatcctaaattaataaagtttattatcttttatctcaatgtcatcaaattgtctttgatttatataatgtttagcatgatagttcggtaaaatacaccaccatcaactcaatagtcaagacaaagatccaaatctaagttgaatagttcaaaatctcacccaatccgcctctcatttgactcaagcctcgtccattaaatccatgcacacaagcatcatagccttcctaactttaaactagaaacccaatccaccaaattttaacggtgcaaactaaaccctaagttggttttccaatttgaagtttaaatctaaacaaaggcaagcaacttcttgaagtggaagtacttggattaaatgtatcccttgaaactactattttacatgcattaatttcttcaccttctttaatagtcaccattaatattccacttctcattattttctatgaagagacacataataccatcaaattggattatgataattttgatgggtaaactattggagatagtcttagaactaagatgcttcaaatactcttatactataatcccttcaagtaccaagaaattgatctaacttcttgggttaactccttcggagcctaacccagtccttcttcagactaatgaaaatgatttgatttcataatctaatcctagatctttttccatgctgagtgagaatagttttatagatcccattggtagacttatcaagtgcacatcctatggtcaagccttatgtcgaatcccatgtagcaaactagaagataaaactgtagcaaagtggttcaaaattttctatgaagagacacctaataccataaaattggcttatgaaaattctgatgtttttgaagacccttcttccttcagactagacaacttattgagaatcctagaactagggacttacacattcatccttgttttgtacctatagcacaaatgcttccaatagagtcattaacattggctacaaatcatatcagtctgatatcatagctcgtcaatttggtcttggtcaactgtctctccatttccaaacccatcactacatagagtgcagagatgatctgaatgacccaaccttctgctctgggcatactatattttctctgagctatcaatccctatcccttataacctagattttaccgatatcactaaaggatacagagtttggtggcaaatgtggtaacaatgcattctaccatgaaataaatgtggcatacaatcttcataagatgcaataaataaatgtgatgccctaggagctctctaatctcaccaaaatgatgatcccaatgatacaagtgagtggactgtgtctctttaccctcaagaagtgtgcataagtgtatggggtggcaagcatatggccaaagtcgaccacatgtcaatttatagactccacaaatgcaactgttaccctcttcgtagaccaattatagaatcactagatataactgatgctccactagtgcctacaccagacatgtttggtgtgtttccaattgttattttccactggctaaaaactagccattgaggtatcttgggctcatggcgcttgtgtttgttacatctaaaatgctctatttttatgctcaattcctaggttgatgtggcgtatgatgctagtaccatacatgtcaattttgtcagtgacggaagatgcctaaaaatttaggtatggctgcggggaacttaaatgactgagctagttacaagaatataaacataactatcacatttttaccaagttcactggaaaacaagtaacaagattgaagtctgtattttttataatatcaatgatctggtatcgcaaggaaagttgaaatatacaattgcatagaagcaatgtataaatatttgatataccataagtagaaatctaactgcatatgatgtatgaacaaataatgcatgaacatgccaccgtacaatgtatggttcggcgagacacacactaatatttttgtttgccggtgtctgctaagagggagcggatggcggagcgccagcgactagaggtcagagcgtcaggcgcggtcatgcggatcaggtggcggagcgccgggtgcagtggcacacgactgtgagcgtgtggctcacgactgggatctaagagcctgaaaggaggcggtagcctcatagatgatgacagggggaagcgcgagcgagcaagcgaagctcgtagatggagacgacagtctgctcgaatgtgatacaaggaaacgttaggctttctcacttcccatgctggaccgagctgaaaaatctaggtatggcgcagaccacagtgcaccataatggacgttgtgccactggatttggttgtttattggtgtaccatctcaaaaaagaaatgtgaatcttatttttttagaagtcaataaatcttaaatttgattaaatttatagaaaatagtattaatatgtatacctccaaataggtttattataaaatatattatctagtacattataaataataatatttttatctatgtggtt

SEQ ID NO: 3353 - DNA, 1496 bp, Zea mays
  misc_feature (1)..(100): optimal_loci_227223_G1, chr6:121067781..121069276, Cluster 20
actctgggaacatctggatctcatgttcgttgtactttctaaatttatgtttaagttattcatttctggatagatttaatcaaattaggtgaatttagcatattgttgttgtgttggccaatctttgagaacttagtagattgtagttacatttagccaatctaggtgaacttagtagattttagttatagttagtaaatccaagtgaacttagtaaattatacctttagttttacaaatttaattagtgaaaccatactatgtgaattgtagttgaatgtactcagtcggaccaatctaatctatttcaactagtatattttagggatctgaagttaatatggcaaatcaatatcatacccatccatcagtgccacaaccagctacaaatgagattatttttcttatattttaataactatatctgtttggttacgtataatgttataaataatcttttattgtaggatgattaggctactcacttcatcaacaatatattcgcttttgatggtagcggacacaagtatacaactccaataatcctagtggctttagaagtttgtttcaactattttagactatatattagtttgttttgtatcgtattggattgttgatggacgtatggacctgttgaatgaatgaacttgttgaagttatgtgttggttgtgaatgatatatgtgcttgaagttgtatgtgatatgatattgtgtgtatgaaactgcatgcatgtggttatggtgatatgtatgtgatatattgtttgtatgtgaaatgaatgtaaaattggagcaaattttgatttcctgcatagaatattctttggtgtccagtttattttagacggcatatagaaagtcgttgaaagtgagaaatttttggcaaaaaaacatcgaaaattacaactgtattttttgcgaccaaaccagaggccgtcgaaaatcatgacagccaccaaaaataaacggcgtcggataactttcgctggtctaggtacaaccgccaaaaatagctaatttttatggtagccgtcgaaataagaattatccacgacgaaatagagtcacgtcaaaaacgtggaaaataaactattgtcgtcgaaaataagatattctcaaaggaaaagcacttattttgggtggctttggtcaccgaaaattacctgattttctgtagtggtagatcaatactaattgagttatctaacacccaatcaccccatcgttacatatttctctttttctaatctatttgttgtatccctgagatccaacaaatgtttaggtagccatgtttatcttataacaacaaccttcgatgtatatttctctgatggatcatttagattggtgttttgagctttaatgacaaaaacgatctttagattaactacttgacattagatttatttactgtgtgtgatagacatgttagcccttgtaggcacatgattcagaatctgttttagcgtctaacaccgagcctctgcat

SEQ ID NO: 3354 - DNA, 1547 bp, Zea mays
  misc_feature (1)..(100): optimal_loci_228587_G1, chr6:128059471..128061017, Cluster 20
tcagttaagcatgcattgcgagatctagtaccagtagtatggtttcgttcgtttgtccggccactcagcagctctaggttgtcgattacggtcatctgacgactgagatagatgtctgacgggcaagctgaaagctagatcccaaccaaacatgatctcaatatcgcacaagtattacgctgtgatgatgccattcctacttttgctaacgtacaatttgcgtgaatgtgaaaggtctatgatggtgcggtatgcgtctatgtgaggtccattgatcgtcattgtattttggttattttgtgaaaacctaaccaccgtacactacagaaaaggtttgactaggatggcaatagcaaccacagctctttaaacaaaaagtgccaaaattgggcggaacaatggctggtgaggtaaaagtggtgtgggtaattattcgaatctgaatttcaaggatataaaaaaaactaatattcatgtgggtaggcaaaatccaagtccaattatgtgtaggcacagataggatatgaagttgacaagacctggtggatatagattgtccgcaaatttatatgtgttatccgatgcatgattagaatagtcaatttgataatttctctccctaggctaaaaaacaaattaagaggaaccattgtttactgactacttccctctatgtatatggtggttttgctccaccttctaccctcattgggaaccatatagagggaggtcgaggatgtcccatagttaagaggaaaagtggacgttaaccggaaccaaatgtatagtataagagagtgatgtgacacaattaaaggtgtcgtttggttcgcgaaatgtaacgtaaatgataatggtaacgattcacactcgaataccggtgctaacaaatttgaataaggtggtatccatttgtagtataatatcgattacggttggacttaaacaaacatgatttaacgttatcagttacccattatgttaccaatatatgaaccaaacgccacctaattcaagagcaaatgatcataaattcaacaactgccacggtcatgcctcccaggtatttataggtcatacccgtggcaagaagaaattacagtggacaaactaagggccttcttacatagatatggggatactacagtcatttgacctctcgcccccaaccactcccagtaacactgtctagagctccgcttgaggatacaatggttctctatcttccaccaaacgacaactaagcatacgttgtgagggttctctctaactggcttggtatgcgtctatgtgtggtccattgatcgtcattgtattttggttattttgtgaaaacctaaccaccatacactacagaaaaggtttgactaggatggtaatagcaaccacagctctttaaacaaaaagtgccaaaattgggcggaacaatgactggtgaggtaaaagtggtgtgggtaattattcgaacctgaatttcaaggatatataaaaactaatatccatgtgggtaggcaaaatcaaagtccaattatgtgtaggcaggcaca

SEQ ID NO: 3355 - DNA, 1727 bp, Zea mays
  misc_feature (1)..(100): optimal_loci_229296_G1, chr6:130927196..130928922, Cluster 20
gcagtccaaggcgacgacctctcggtctcggaaactaaggccctttttagaaacaaagttcttgagaaccatagtttttgaaatattacattacactttaataatgacaatactacagttttaaaaaccaaagttgaaatctaattttagaatactctaaaatatctaagtacttgtattacttcagtttaaaacagagattttagctaccttattaccaaacaactttgtatatataatactgagtattctttcaaaactatgaaaaactttactcctaaacaccaccctaaacttcttccggaccacgttgaacagaccagacgggcaacaaatataatggttgtctgctccaagggggaaaaaatgacagggtccaagtagcaggaaccttcttttttcttgcctccgaatggaacattccaccacggctgagccaacacgcaacacgtgacgtgaatgactgaacgagagatcctctccggtcaaaagacaaacaaaaaaacacgtgaaggagatacaactacaaaagtgcaatggtcagcattggagtgacacaataagcgccgtcgtcgtcagtggataagcgtggaggaattcaaagcatcgaccgtttgccgaaagcgagcgaatacgaaacgtttactcgtagtatagtgaatttcgtcgggtttcatggcagggagcagagatagaactaaataccattattttacatatgttttctttagatatcgtgaataataacgacggaaagagactcgtgagtactagccccttaatcgagccacctcaccgaaagtgaagtctctaaaccttattaggttgccggattcgttcaagtactcgattttatctttaatttactgcatctaagacctgtttcaaacctctacaaataattattagtcgactaatgaattgttagcttgttttacctgaattagagcagctaacaactaatggctatttaacaattatctggttcattagctgatcggttctaaacctctcagttaattttaattgttcactattagttttataggtttagaacaggtcctaactattaccacatgatatcgttagtctccttgccttaaaatttaccaaatgatatcttctgtcggattgctttggcttcatcttcacctacgattttattaggctatgtccaatctatagtatcatacatatttaggacatgtcatataagcatttttgatgatgcggcaagagagttaggagaagagagaagaaagttgtatcttggtggagatactacttgagcacgaggttatatgcattgaaattttaatcattcaagtggtctccatctcatactcttgcctatactagcatttattattctatgtagcataaaaataatatatgatatcatgtattgaagtagttgtatcttatgtaatttcatatgatatgatatttttggatattttgacaagatataatagattggaaatagccttcgtatgtgcaaactttttaaaaggtacacgatgacatctcttctatctagaaagatttttaattttttaatctttttctaaattttatttttaaaatgatattacttatttttttaataaaaacaaaattggtagaattttagtaaaataagatttttaaaaagaataaaattaaaaactatagaaatgatgatccctcctcgatcaacgtcgccatcatctcatttcacacgaatt

SEQ ID NO: 3356 - DNA, 1988 bp, Zea mays
  misc_feature (1)..(100): optimal_loci_230743_G1, chr6:137883087..137885074, Cluster 20
gcaataatgcagttctcctgcatgttcgaaaaaagaaaaagtacatgcaaaaacctaagcatctttgcaaaaagtactctaaaacatgtatctgtacatatggaacaaaccaattaagttaacgaactgtataataacattttttgtaataaaataatactaataatgcaaagtagatgggtgggatgtagaacttttacataactttaatcaaggtatctttaaataaaaaaatatgatattgcagcaaaaatacactaacacgacacaaattccttcccaactacgaaattagaaacaattcttgctaatggatattcaaccaaaattaatacatatcaaagagatgacaacacacccatatagatagcgtaataggcacaccttcaacaacaaggcgttttgtcaaataagaggcttgaactgttgcttcatgtttgtctgagaagacattattcacataccacagcacaagagatgtttttccaactcgtcctacaacaaggggaaaatggcataacaaaacgagtaaagggcacatgattgttttgaaaaaaatagttaaacatgttgcactgtacaaaacaccaaagtatatagttaagcaagtgacctcatgccatttgtcctatatcctaagtttacattacattcatcaccaagaaaacattaactaagggtcaaattttgaacaatcctactggtggtgtgaactgaaaactggtggttcgatgagctagatcacagtgcaacagatcaagtgccatcgtcggatttgagcccaaacaaagctggaggtagtgaatgacttagtggcagcatgttgccctggttcatgaagcacccccaccccctccgcaggtccacagatgcaaccaaagttttatttgtttaagcagccttggttcataccaagctgaagcgttgaaccgaagaatcttctccccttgtcgatgctgatagtgtgtaaattgaactatatgactgtcacatagatttacaacactggagctactcgaacagcttatagggctagaagcttacaaaataagcattacgatttagcacatagcatatccagttaagaacatttctcctttttagtatgatcagtagtatctgatttgtttccaaatattatatacatatatacacacagctaggcctaaactactaacatcttgcaaccctgtctgttaatgtaatgccaatgcatcacacaacagtcacttctattcccatcatttattaacctccgtcttccattttttcaatcagaattcaatggatatatataattttatgcctataaagatcgttattcttggatttctcctccaacaggatgcaaactctgatgaatccaaacaaaaaaacattgcatgtagctagtacaataagaaacaacaccacttgtgctggtcagacgcatggtgcaaaatcataaaaaattattgcaaatagttgactaaaacatctacagatgtactgttacgacgcagcttatgatttttatccaagctcggctgtcaagcagctacgctattgtccgctctcttaaaactcttttgggaacaccattggtcctagaaaatgtagtgaccgtcatctagcagagtagttgcagctaataaattctcttttgcttcaagttttattttatcaacccaaaataagtaaatcaaattttgtgttatgagatctatcacacatattatatgtcagtaatttttgaaaggctattccttgttttatgtgtcagttactaagtttataaactgtggcttttgcttgtagattgcatgtgaataattttttaaagcatgccatttgcatgagaaatcagaagtcaagaaacaaataacgaagtaaaatagtagtctgcaacatgagtgtatttgaggtttaccttgggaaaaatgagcctgatccaattggccttctatgagcacttttcaaataacgagtcaagagtcccgtttcaggat

SEQ ID NO: 3357 - DNA, 1552 bp, Zea mays
  misc_feature (1)..(100): optimal_loci_232222_G1, chr6:144700575..144702126, Cluster 20
taaatcctttacggaatgaagaaaaaaaataatactcctaccataataccatatgattcctgtcatggttcaatacgaatatacggtactgtgtgggtgacggatcgttagatccgctgcgcgggcagtaaagaatgttaatgtcctcggtcataataatgtttgtcagtgagatagtttctttgtttcaattcaggaacatgtaaagtattttttttgtagtttttagataatatcataatttataataatatcataagatatttagttatattcctgaaaattgtatttttttctaaaaaaacatggcattctaatacaatagtatttttttagtgtttggaactgcctcgctccttgctctacaactctgccccataaacaattttaccaaacatattcgtctccaccatcaccactactaaaaacatactcctatggatttgaggccaactgcacatatttggtggagcgataaaataggtgctccataaatcattgtttcataccactttatgaagttgtggggaaattagctacattgccactgtttacacaatccctctcatgtgatcatgtcgtagaaaagaatcctctgcccacttcgcctcgcactgcctaccgccacccaggacctcgccgccgcctccacgtcgccgcccaagacatcgccaccggtcgagaagctcccccatgtcgtgcctcctccatgctacgggtggctcccccatcgcctcgcctcctccacgccggcggccagccctctcctcatcatatgcttcgatttttaaattttatagtataaaatttggagtataatatttcttaacgattagtttgagcccttagccaattgtagttcgaaaatgaacagaaatatagtttggtcctaatatgcttcgatttttaaattttatagtataaaatctagagtctattaccacccttaaggacaaccgtcatgtctgttgtatatctcgaagatctatttcaagcgcacacttagactctctagcaacttacccgttgtatctcatatctcatctcatattgtaaacttcaccttataaacaatacaatatatggtataaaacagtgttgttcaccaccatatgcacagtctattggagacagcctcagtaaataggacataacctggttagcaagtggctatcaatctctgacaagcgtcaacgttgccacaacacacaacactaaagtactagagatcgacgacaacgcggttccgcaaagcttcgtctggggtcaacaattggctccagattgtccccaaccaagcaaaaaatgcgccgccgagcactaaacgccaccctaacccacatggtcgatcccaacaatgcagaggcactgaaagtctgaaaccgtgtagagcacctggctgctgcatccatatgtgaggagacaaagagccgtagcttgcaggtaccgactgaccggccgacgtcgttttccttgggtttactgtctattccgctcactttagataacggaataaacgtcatctggagctcagacttcatcagagcaaaat

SEQ ID NO: 3358 - DNA, 1504 bp, Zea mays
  misc_feature (1)..(100): optimal_loci_233009_G1, chr6:148241950..148243453, Cluster 20
ataagctcgaccaatacatgaacaatatgaccgccaaaacggtcgaccatttttgacatttgtatccggtattgtctcgcgtcatctgagaacttctaaaggtataatctcacttctaagctcctgcctttatcacgcatgcatttctttgttcattcgtattcaaagcttataccgtcttaagggcttgtttgaactacaggagctaaaataaaataactaaagtttagtcacttggccaaaaaaatccaaacaacaaaagccaaaagtgactaaatagtaaaaaataattttagtttgctttagctcctagatccaaacatgttgatgtatactttttttttcccaatccattgcttgcttttccattttatgacgtacacttttctttcccgatccattgcttgctttcaagattactccgtattgagataatcataggaataaaatctcgtatactatttttccaatccattgcttgctttcaagattactccttcatattaagacaatcatgggaataaaatcgaaagttgattaccagacctgctagtcaacaaaagtagcaaaatacactttcactacctcctttgctctgaaatataacaggagagatgttgtcacgttgtggagggttcgcggctcttggtgcgaacaaccacgatattttttcctcgggtacatgggtgacgatctagtcttcggattgattgtcgctagcttgggaaagcgactgcggttatgtttgtttttttctttttccttttttcttttaggattggctatgtgcattagacataggccgaaagtttatgtaccaagactatgtatcatcttgatgtatcgctcttggtaaccttttaatataaggcttcctttatcgaaaatacaagaaatacatattaaaaatctataatggtacaagacaacagatggaaatacacacggaatatttggtgactttataaggattgtatagagataatgaaaaatataaatggtcagtgttaaaagatgaattgagtaaagatgagtaattttattagttgctactacctccgttccacatgattttgtcgttttggatttatcctaaattaatcactatcaactttgatgtttcataagatcttacatcataaacgtaaaattattagatttatcgtaacttaaacgattataatataaaactcttttagtttaaaataatttaatttaatatatatattgttgtcaaaatttaaatagtttgatttagaacaaacttataaacacaaactcatgtggacagagaactaagtttacctatgaaaattttaatacttgtgcaacgtaacatacagcacatgttgatgatagtcatgacaaataggaattggatcgttaaactactatgcttactataggctcgttgctgctacaagtaatggaattcggttcgtcatagaaaaaaataatcatttgtgctaccagcgagtcagtgtctacatactatcccccgaac

SEQ ID NO: 3359 - DNA, 1734 bp, Zea mays
  misc_feature (1)..(100): optimal_loci_233286_G1, chr6:149333116..149334849, Cluster 20
tctccctctcattgtcatatcctctacacgtgttcggctcatataacatgagatcttttggctgcatttttatgatttgtagatatttttgatgattttgattccaagttctagattttgtgttctaattttaataggatggcactaggtgtaaaaatcggtaccagaagaaaacgtattttaagcacatgcaaaaattagctaaggatgaggctaatgattgtgcacatgtatagaccatcaaaagaagttcaccgatgatcgtgtgaccaagaatttgtctcttttagttcgaagaaagccatgtttccattatagtttctctttgcaaaactccatggggaataagcacaagagcctcttacaatgattatcagagccaaatacaatcaccaaagccactcaacgatcctgaaccaccaagagaaacaagaatcacattgctcaatataatcaccagtgccactagatgcaacaactcaatgcaaatcactagagatcactcccaatctcactttggatgagtccatatcactagagatgagtggtagatgttttcttaggcttactagagtgtatgtcaagttaggaagctaggatatatatcccaaggacgaaaaaactctatttataaggtcccaataagtaattactagccattggtaccattattgtgcggaaaacaagagtgtcaaataatttaatgataactatcataccatcaacatgagtctgatgactcttgagcttgccacatgcactagatgtttgaatgttattgttgatgtctcaacaactatgactgcatatggtccaatgactagagttcaacgttagttgatccacaccatcttaggtctgatgccatgcagaagtgactagagtgccatggaaagcgtcacactggtctaacgccttttgtcggactaacactcaggttacaacatcttcgatgaatgcaaggctagggttatccattggactaacactatactagtatgatactcttagggttagggtctgatgccaactataggcaccttatagcccattttcttccattcttgatatgtgtgctaactacaactgtctcttacacttgtgtatgttaggtagcttaatttcgattgtgtctaaggtggagtttttattcactaggttcaatacatatgcatggagtcaatttacctagtggcactttagtagccattctaaactagttcacttctttatagtattgctattggcaaaaaaaatcctctaagtataccttagccttaagtttttgtattttgattttccccttcctcttttcatgttgagcacttgattatcctttatagctatcgccgtccttctcatggttgctaatcttgctcaatcttggatgtgtatttaatctatcccatttataacacttagagtagaagttagtccacaggtcgtctcaattacgaaatccgcacataaagctttcaatggtgtctgcgccaaacaaaggagaataattaggacacttgacattagaatagtgcatagatcaaactttcattcacttaaaaatcaagcacacaacacattaggaataatagatactaacaactctaaataatatcaaatcaagaacttgaaccaccatgagtgctactgttcaaatgctcaatactcaatcatcactattacgaaagacaagaaatggacacatagataaatcattcaatcattacatacaca

SEQ ID NO: 3360 - DNA, 1419 bp, Zea mays
  misc_feature (1)..(100): optimal_loci_234858_G1, chr6:156528939..156530357, Cluster 20
tagagcaagtgtaaactggatgttgagatagaggagaaataatagggagagagagagaggagggaaactgaccataaatttacagtcgatctagggggggaagaacaaaaaataagaaaactatgagagacaaatagacatatattaataataaagagctaacataagacgtcatcttaaatgattcgtatcttaaaaggtatcaaaagagtaagtgcaaaaaaacataaggaacgtcatcttggtgatgaaacgtctttagcacgattttctaagtctaagatacacttttacccgtacaacccacataaatgagtcgtgcctttagggtttctagtgaataagataccaggtatacgttaggttgtataaacaagtttcttaggtgtatctagtgtttggaaaaaccacaacatggtatctaggttttacatgtccttagtaggaactaacgtggctaatctcaaaggtagagcaacttatgaaattaatgcagaatttaagtcactattagtctattagggcatgtacggccctgagtctctggatcagttctccatgtataaaagaccgataagagattgtatgatactactctaagtcactagatcataaatatagttagataatatatatagagcgagtcgtgtagacatgaactctctgcgaatagctcgtctcttgtaacgtttttcatttagctccttaaaaacacctcaagagaccccatattaaatgggttgtacgtgcacttacgacacctctaagcacgtcaatattaaggcatgtacaaccacatttaatacccatcttttaaggggtctctaaagggttaaataaaaaaattaagagacaatcttttcgcgaagccctccatgcatattttctcttaattattatatttataatctgattgattttaaagacatctcatgatatcatgtaattttttagttgtattttgtgcttagaaaaccaatcaaggggctataaactacgcatgcccccgatttcggaggttagagcgtggtgttggatctttgttaggggtaatcatatagttttctctctctaccatcaatgagtttattgtcaccgtactgctacttcacattcgtcgctaccgccacttttatgtgtaaagtttcaatgatgatatcatgtagcgtaaatcgagctaggaattcgaagatcgacggtggtaggacctgataggttgtctttagtggatggtataaaataagggaatttgtagggtagattactgtttgtcaagtgaaatttaaaatagtatatgaaattagagatgtgacatgggagctgctgacttgctgagatagtatcattgggcctcccaataagcaaaccgcccaaaggaggacaagctggactagaaaggctaaatgatcagatattcag

SEQ ID NO: 3361 - DNA, 1434 bp, Zea mays
  misc_feature (1)..(100): optimal_loci_235467_G1, chr6:159428182..159429615, Cluster 20
gagatttgttccacgatagactgtatctttttagaagcaagttcagttttatataaataaacaacactacatcttggtcgcaagctatgtgaaaacagaaacatttgcataactcaaaatgatcaaacactaagcacacgtatatatgtattatgccccccgtctataaatgtttgtcgttatggtatttatgttggtcaaaccttttaaaatttggctagatttatagaatatgtcagtaacatttgtatcttcaactgcaaaactagatttaaagacatatctaatggtactaattaatggtattaattatgtactataaatattaatagtttcttatataaacatgatcgaagttaaaattggttgatactcaaaaagtgagaacgataaatatatgtggacaaagggagtttttttttggttagcggccaaggtcttttcgataaatgttttataagcaaaaactaaggaagcatcgaaactactaatagtgtgtttggtttgcgaaatttaactatactagacgagatggtctaccgtgagcctattttataaattttatagaaaatcacggtatatgagtagcttgcaaggaataaaatcatttctattttgcaaacaaaacataaaaagtggataataaaaagacgataggctaacttattaaatttattcatatacaactatagttattatatttattcatctggtcgttttaattacattacatatacaactatagttattatattttactcatcacatttgtatatacaatttacttttctaaggactaaaaatcatgtttttatagaaaacaaatgagtacatggatacttattacgcgaacttttatcgtgttagaaacaaaattatcaaataataatgagatctcttataaaaaatagtgtgttcctactttatcagatatataatataacagctctaaaaaagcatccaagttgctgtggtgtagtggttatcacgtcagtcttacacactgaaggtctccagttcgatcctgggcagcaacatttttaggaatattaatttttttcctcacgttttttgttatttttttttagttaatcacctgtgggtttttttttctcgtaacatgttcgcttagtcttctttctccccccatatttttttctcatttccaatcaacacattaacacatcttgggtgttttagttttcgattaaatctcggcattccgtggagcaacgtgataagcgtggacaatttcgccttaggttgcaacacgtccgattcttatcatttcggctttaactacgctacaaaatttacagtacaaggctgtgcactatagtatatttatacggtaaattacagagtcaagtttgaaagagaatgagataggtatttagggtttatgatgtttggtttctagagactaatttttag

SEQ ID NO: 3362 - DNA, 1895 bp, Zea mays
  misc_feature (1)..(100): optimal_loci_235977_G1, chr6:162301826..162303720, Cluster 20
gagtgctagtcgtggtggacaaactacaaaacaagattcatgtaacaaaactgaaataattagtcaaaccatgtattaacaaaactgtttgtaggcaatacagatcaacaaaacaagacatgatgatggttttttagatatatgccattataaaaaacaagtgttccaaactttgcgggttcatactagacaacataggattttgataacagtaagattttgggatggaaagaattctctcttatctcatagaaagggattcaacaactagttttatggtctcggattcaacaactagttttatctcatagaaagggattcaacaactaattttgcatggcggctatttttatttaaatttggaaagaaagaacacactcaataacatattaacaccctaaaacatatggagaggaatccaggcctccttccagactggcagactgtgaatataggtgccttcctactgaaagacatggcgactcagctgatcgtcagcaatcatggttgttcctactgaaagaaggaagaaaaaaaaataaaatctagctgaaggcatctcctgctgatgcaatcttgtttcttacgtaagcctatctacagcagcttactcatactcatattcatactacactctataaacagtacaatgtacaaggcaaaacgatgcaaaacagtgtttctggagacaatataggtgcaatgtacaacagttcactcatatggtcatcaaatacactgttctagatcgttttgtactatacattacactgtttgtagagtttagtttaaatatgggtatgagcgtgggtaagctgccggatatagtctaactccagcagcccacttcccaacaggaaaggtattaacaaaacgccacataaccttgttccttacataactccagcaacatagttttttatgcattggactgatcccataacatatttacatgttggtgactctaatcgtgtgaagttgcttggtgccttggtgcaaatatctgcacacaggagatggggttcctcaattccttggtgaaatgaaccctgaaaagaaaatactggcttcccttgctgctgaagagctcaacttccttggtatcttttcctaattcatgtcaatcaattctatatatcttatttttagggatacgagagagcgctctggctaattcatggattctacaaagggaatggcgggtgcggtcatgtgaagaaaccagatttcttgatgcagacggaaccacaagtctttgacccaagagaaccccaacctatgaaggaaacatcgcgctgccacgccatcacttcacattgccgtaactccaatccagaccaagttggtttttgattccggtcgaaacaaacagccagaaaagagacgaacaccgtaccgattgtttccgcccggaacaagggtcggaacaggtggaaccggccgaaccgaacggaggaaaatcatgcgcacaagttctacgtgaacgagaacgaaattacagttctcctttgtgatttcacagcctgattcgtccagaaaaattgtgtttatatgtagtgaagcgctaatctacttgtagctagacattcagcacacaaggcatcatgtgcagcactgtaggtgaccgagtcaaataagattaacatttatgttcgtgaaagcatgaccacacacagggatagttccccattctcgtccccacagaacccgatccgacgaggcctatatttttcccatttttgattgactaagttaccccatcctcgctcgtctactgataaaggattttctgcgggaattatggatcgggacccattgtcatctctaggtggtattatgtgggagcgacacactatgtgcgacttcctatcgtgttacactttgatgatttctta

SEQ ID NO: 3363 - DNA, 1526 bp, Zea mays
  misc_feature (1)..(100): optimal_loci_236698_G1, chr6:166184677..166186202, Cluster 20
caagtgaaggtgcgagaacttggtaattgaataatggaggacaagtggagacacacattaagatcatggagaaagcataatggatacgctactattgttcggtttcgcaattcagtcctcaaaatcgtgggcgagcggtttgtcgaatttgagcctacaaactcgaagtagatctcatggtgacacatggtatcatcgaagagcttgtatcgaggcaaaacatattgtcttgcaaaaacgtatcatcattcatttgtactgttacaccccctccctttattatgtaaattaaaacttgagaattcatgtggtacgtacatcaaacatgtgtattattttattggataaaacgattctgtattaatttgatatagtattttcagaattttaattaaaagcttttatcttttagtatcgaaaaaatgtgcataccctcgaccataaattaccggcgtaccgcgcgctgctagctatgcgacagaacaaaatacgaccaaatcaaaaaaaaactgaaagtttggcatatcgagctcgcattgttatccccacttgtaaaaagcctcgatccttggaacatgtgacgacgatgtgaccactgagcagtctgattcgatccatgtcttcatttgtttttcgaagagattctttggcaagttggagtgaagatacgttacgtaatcctaataaataattaaatcaggaagaacatagcatcagctaccgttatttgtcttggtgtatgaaaagtccaatgcaagcgctaaacaagaaaacacgtccatatatacgtacgtgttctcctacgaagcaaagtcgatctacgtactcaccggctcaccgctgcacgaatttttgtttttatcacggagaaagaggcctactctcagcgaccacacatgaaagaggttttcaaaagtgtcagtttttattaaaaaaaacggattaattcatcgtattgtgcagcgacactcacatctctcaaatatttatctcgaaggcacaattcattttctcctgtttgtaatgaaaataaatcgtttcgggcacaattcattctcatttcggaacgtgtggtaatgtttattctatttttaaacagaacataaaacttctgaattttgaaataaaaatgctactcttttctattaacaataggaaaaaaatactgttctcacgagcaaatgcaaaatttcggtctgaatgccttctctggtttgtagaacaaatgtaaacttctttttttgatgaaaaaattacttcacttcttacgagccaatgtaatctcctagacctttcaagaattgtttagtccacctaaggagcacatctaaattttttccccaagaaatccttactccatttttgcaggtccatttctagaagcaaatgtaaacatttcatttgcttttaggataacctaggaacaaattgaaattattgatgtgtttccaaattatattttgaaattttttagcctcctttaaagagcatgttatcagcctttgggtttaaagtggaagaaccat

SEQ ID NO: 3364 - DNA, 1582 bp, Zea mays
  misc_feature (1)..(100): optimal_loci_237799_G1, chr7:3485795..3487376, Cluster 20
tggacgcacttcttctattgttctgaaattgtgctatgtgtgtaatacaatagagagttgcttggtcgtcagaacgagccttgttctgggaaaagcaaattttagccacctaaacctcaagttcaacagttctgccatgctctcaaaatgttcatgtatccaatgcttgcttttggggaaattagtctgttgctgttatgtgtagtgctggtagtggtactaagtctcttgaattatttaatttgcttgatcctgggcgtcggatgttcaaccactactcccctacctgcagatttaatttgcttgaattatttaatttgcttgatcctggacgcacttcttctattgttctggaattgtgctatgtgtgtaatacaatagagagttgcatgatgggtaggacgagccttgttctgggaaaagcaaattatagccacctaaacctcgagttcaacagttctgccatgctctcaaaatgttcatgtatccaatgcttgcttttggggaaattagtctgttgctgttatgtgtagtgctggtagtggtaccctcggctgcaagccaagagttttttcttgctgcaagccaagagttttttcttgttttttttcagtgtgtccaggtgtcttcattctgagccacaattactttcttttccatgtcacacacaaaagactgtagcttcgtttgtatttaaagattttttgactatatagctctggaacaaactgtcctacttacaatgacatgaaagtaggacagtttgtggcaaggaacaaacaaccatggtttagggtttctattgttctgaaagtgtgctatgtgtgtaattcatttaaatccaagaacaaacttctgatgctccaataacttcttctgtttataatatgaatcaatttatttgtggcaaggaacaaacagccatggtttatattctattgttctgaaagtgtgctatgtgtgtaactcagttaaaccaagaacaaacttatgatgctccaaaataacttcttctgtttaatatgaataaatttatttgtggcaaggaacaaacagccatggtttatattatattgttctgaaagtgtgctgtgtgtaattcatttaaatccaagttcgctgttctgattagaaaattgcagtactaactgtgcttgctgttcaataacaaagttctgcatcagtaactgtgcatccattaaccatcactataattacagatagtaaccagtaccaaactgcacatactcaatagctttaaggattcagccatggtttatattatattgttctgaaagtgtgctgtgtgtaattcatttaaatccaagttcgctgttctgattagaaaattgcagtactaactgtgcttgctgttcaataacaaagttctgcatcagtaactgtgcatccattaaccatcactataattacagatagtaaccagtaccaaactgcacatactcaatagctttaaggatttatttctcatatctaacagttttcaaaccgaaatagtggaataagtaactgtgcatccagtttcagtttcaagacttgaaactgaaacaattttcttcttcat

SEQ ID NO: 3365 - DNA, 1564 bp, Zea mays
  misc_feature (1)..(100): optimal_loci_237975_G1, chr7:4256020..4257583, Cluster 20
atatttagttgtgatttgtaaccatctaacacttcatctcactactagtgggagtaaaccacatgttctattttgtcttaaaccaaaagacaaaaaagaagttagaatgaataccacacatctacaaaagttatattttaagaaggcccaagcaacaatatagagtttaattctaataacatattatagttggtaatgaccaatgaatagatcttagagctgtaaaatgtacatgtgtaaaaagttgtgcattctattggtgaaggtccatgctaacaaaaatcattgttcaaatatgcttttaggtatcaggcctaagcaaaagttaaagtctagaataaagcacgttcgggataaggaataaaggccaaagctttgtactaattaataaagaagtttattgaaaagttgaagagaagattaatatcaagcacgacaaggtagaaccaaagccaaaaggagagatgaagtctgattgccttcgaagctacactcaaaagatgaggcaaaagaggattcttaggaagaagaaaagacatatgtgatacatctttgctgtaaaaatgcattgattgtacctccctagttatgaagaactagtgtgtaatgtggaggacattcttgtaattttgtacagaaatgtatatgggcttggccctataaatggataaacgatgttactgcaatagggggatcaacttgttgtttataatcttatgtctgcaatatcttctcctagagaggctcagaaggtataatgagaacgaagctttgttgttgttgcattatgtttcgtaatatgttaagtgtatttgctatgttacaaaaaaggacatgcaccatctattgaagtgttaaatgggcattaatcctcgattaaacgtatatttgtattttcattggtgctaaccttcggcttatcatgtctattccgaattgtaatgcgccttatacttgtcattctcttcgacaacaccttccaaggggagaaggatataacttaaccatgttgtcttgttgtcttcatctctagaatcttgacaggttccaaacacattatatcgcttcaagatgtaaatatatgtaacaagttatgcattccattgcaatgcaaagttatgtttgcaaatcatactaaattgacacccttggatctatatgcattataactctttaaattgaatgttctcttttatgatcataactttatagttataagcaatataataggcatgtttagttgtttacccataaaatataagatgaaattatcagctaggccaggtttgcttcttcttgctgatctgaccgtgcttaaacaatgctaatatattattttttataatggaaaacagccttacatgtaaaagttacaactccacaaacaactatgagatgataaaaaaatatctgtttggaaccataaacaaattaggcagccataattctaacattggatcgttatccatggcttgtgaagatcttcatggacaccatctctagggattaacatatattgagagattcttggtgtgattcttccttctgcagtaggctccgaaat

SEQ ID NO: 3366 - DNA, 1836 bp, Zea mays
  misc_feature (1)..(100): optimal_loci_238071_G1, chr7:4831428..4833263, Cluster 20
ttaatggacaaattaagcatgttctttgtgcaagtaaaacaagcgtgctcatttattccattggattagttgatgcacttagttggacatataacgagaatatgtaattctcatttccgatagattatatatcctagcaggggaacaagttaatccattctttattcgctactagattaattggatcatgaaccagcagcagtgatacgatgagtatcactaacagtctaagccatgacccgtcaatggcactcgtgataccactaccagatcagtgcacaccaaagaatgaattgttgagtgccaactgtagtaccacgtccaataattctcatttctctcacacaccagacaattctcatcgttgtttcatttctcataaggtatataatacatcatgtatacctataaaggataaattaacataataggtagcaagataatcaagttcctacaaaccaacaatatatgactcgttatccttagtctcttacactgatattaaactatattatacaaaccaaagtcatgatgagtgcacacaccctactcgatctaattagtcactttcatctcacaatactcttagcctcaactttaatagtccatgccgtgatcatctcttattgtgaagtggaactacttatgtatatcaacaaatgagaattagtgcatatatatgctctcttgcctcaaaggaacgggcacacaatctaccatagattgaaccagctagctataggcactccaaattggcaatcgcctatagtagaatattcacgtaacccgcgaccattttgtcgtggtccttgaacctacatactaccagcgacgatatctgattttctccgccacttgagttagaatggaatggaagagctacattacgtaatgtaatgtgaaatcataaaacagaaactacaagtggtatcatacaataaatagaatgtgatgttcaatgaaaaaaatgattatatacacatgtgagcatcacttctactatatataccacaatctacattgttgtccctagccgtctgctcattgactgctgccttgtcgtctaaaagatttgcaccttgcgcgtatgagaaagccaggaattatgtatccattgatgccaaagctcattcatgcatgcatattccggcaacttctcagctccaagcagttctctttcatccaacgccacgccgtcgtccccacaatgcaaatttctacgatctcttcaagctcatgccatcttgaagcgttaatagtgggaagctgtccacaatgggccacgaccaccaagaaaccagagtgtatcttcgagacatctaatcatctcaataatcatctaagataaattatataggtctagtagggagagatccaagtgcctgggatcgatgaagttctttggcagtgataccgggtttagctaggtcggacagtgatgggctaatcccgcgtagtgtctgcttgataaatgccaacaaaaccttgtccgtaaactaaaaaaattgttttaccacaaaggtttttttactgagatagtactgtctagcttgtgctacctgatcgagttttgtgagttctgtacgcttaaacaaactaagcctactgtttatggctttattggtgactcgtggacactgcagtgtgagatcatccaataaactttgctgggggtcagcctcaagatgaggacccagtgccagtggtcccggaggatggtcagcagctccctcttgagttttttggtttgggtcaacctgtgccggctgtgggctgagatcttaatttcccgccagaaggcaatgtccaagctcaaccagcagacaacattcaagg

SEQ ID NO: 3367 - DNA, 2169 bp, Zea mays
  misc_feature (1)..(100): optimal_loci_238171_G1, chr7:5268801..5270969, Cluster 20
atcctagagatagactgggacatgagaaacgaaaaaattattaactttgtaaaatacatctagaagcttccgctgattagatctataagaggagattaatatctagaagattctggaaaaaaaacaaaagccaaagtacattataatcaatgtctgaatgtgttagcaaaaatgaggtgcaacatatagtaacactagttgcaacttgtttttattgtgatttttttacatcgatcaaagtgtttcagggatattcttgatttttttcatttttatagctagatctagtttatagaagcctctacatacattttaatgagctccacatatgttattctgattttccatgtcgccatctatctctatgatttttccttaagatcttagatgtttagagattttttcacggtttaagatcttcatctgatctttattgatttcttattagaaagttgatgaagtgtatgtttggttcacctttctgaaccagattcactgccaaaaatctgaaattctaaccaaactggtacgacagtagaatagattcctgaaaatttgcatgttcctttagttcaatttagaatcacatcctacgctatatttttctagatttctaccatctatgttacctacctatcatgctcttacagaatctatagtttatagttgtttcaaccaaatatattttagcttttcctcaaccgtcacttcacaatagttttctcacaactcatggctagaatcagattttctagaatttacagctaaaccaaacaaagctgaagtcatctagaggaccacttctagctaggataaaacatagagaaatttttattcagacttttctctcccctttatgggaggtcctatttccccttatatagttgagggagcaggtagcgttagttatagagaaaaatctatgtggtgagccttttatgcctatgggtcataggtcgtgttctatgcttccgacgacctattgttactggctcatatggcttctaaggccttgtcacttctgagttgggttttgcaaatgggcgtttggagtttttttgtaaggaggcatctctaaggaatttgtatggtagttggcctcaaagttcctttcctctcctcatgtcttatttgggggcgcttgatcaccttatgcctatgacaaggcccattgtggtcttccatcgttgtgaatggtccttgttgtccttcaaagagtcgagtggttggacttggacgtctttaacatccttcaaaatgtaactgtctcatttagtgaacacctagtcgggcgtgtgcgccaagaagtcacggagccatatatgtgttagccctgcacataaattcatagggcctccagatcatggcactggagagtcttattaggttagtacgatctaagatgatttagcttagagcagttaggcgaggccaacttggtcaggatgactaggcaaagggtcgctcgaggtaacctggattggttttgacttgcgtgcatttatgtggttacaggcccatcacatgcactatttagcagcctcaagtgcactatagtctatcttataagtcagtcctataaagtcactcatcaggcacttaatatgttgtactcgagacttatccattaagttaccactttaggacagtcttgaagacatttaggcatggggcccttgacttggcactagactaccactagtggccccgtcacatccttcaaccctaagatagggcttagactgtcacttaaagtccctgattcatcagggcgatctagcccttggagtatatatcatcatgtgtccccaagatgcgataggccctatgggtttatgtcgttacgtgccacaagacacaagaagcctagggtcttatacaggaggtgccctatggcataagggccttggaggcttatatggttagatgccctatgacatgatgggccctaatggttaatatcgataggtgccttaggacatgagcgaccccgagggcttacatcgacatgtgcctcaaggtgtaagggggccgaggctaataccgtcaggtgctctagagcacgaggggccctaaggtaaatgccctaggacgcaaggggctccgagggcttattctaatatgccatgttatatggtctagtaggcctagttaggagcacccttgtat

SEQ ID NO: 3368 - DNA, 1904 bp, Zea mays
  misc_feature (1)..(100): optimal_loci_238758_G1, chr7:8933056..8934959, Cluster 20
acgagcagccgcgaggtcacccttttcaacgacatctacaactgattgcccgtgtggctcaggcgagcatatcaaataatgctatgctgctcaaagtggtaaaggagagcttttgcaataggcctgtgaactaactctaagctggagcacatgtaatgtgatcttcgccatcgcccaagtgctatgcatgagacagtgatgacaactccagtgatgcaagcaaacgatcccatctcaatgtggaggacgactatagcttcacatcactggacaatgtcggactaacacaccataatgcccatgatagggcaagagcgcaacataaaaggtaagaggtcgacaacgagtagtatcgagtcccctgccacgcaaaagagaatggtgaacaagctctacaagaccaacgagaagataagtcaatcaaaattgtacgagcacttcactgctgacatgaatgatgatgtaaaaggcccacaaattagctgtaaaaatgagcaagcaatattaaaactagatgaggaacaaaatgcataagaaatggacaatgatgagcattttatcgtctttttatgaactatgtagttttttgcatttttttactttgtttcagttatgtattttatgtattgatgattgttttcaaatgaaatatcatgatctatttcaaataatagttcataaaaagaaaagttgatgtgacgctaaggtggttgtaggccgacggtaaaggctatgtactagagtgttatggtagatataataactaacgatgatcggtagttgatgtggcatacggtaaggacttctagcactggatctaccctaacgccattacccgtttgtggtaatatgtgttacggtgttcgtgatccacctttcatgtgtgccaccgatgaccataacattagtacctcgtttggatgtagatattggtgcacataattgggaattggaatcagctttcctaaattttgttgtttggttgcacatggaactaatatttggaatctgagagccaattccatggtattggactataactagaaactccctctcccaattcagagtgtcatgcctctatattgtgtgaaattagaccacccaattccaaactccaatacagtgaaatccaaacaatagaattggaattgcatctcattttattgccataactgatttagtattgaaaccaattcaaattcatgccctccaattctgacatccaaatggtgcatagtagtctatgggatgcatcgacatccttgattcaactgtcatggcgtcgtcaacgaccatgatgctactagtcaataaggatgcctagttgattgtaattcaattatagggtgtcaataatctatagattacgtgatgacgggatctagtaggtgtcatggtgtcaccaaaaaacgtaaaggtcactagtatatggatccataatgttttatatatcgttaaactctataattttgatataaaatttaccttaattctatgtaatatggaaaattatgagttttttgtgtaaaacaattatcattgttgattcaagtgataaacaaacaaccataatacacaacctatcattgtcagttgaagccacaaattggcagtgatagtccatctatcactaatggttgttttatcaccaccgattgaatccacgaaccaacagtaataaaatattactaattccaaaacaaccaacaatgacagtttgatagtgatttaagttctatagtagcggatagccattgttgatggtcaataaacgttaaatctgaaacgattgtggcgtctaagagggagggttaattaggtaacttaaagcctacttctcatagtatggccacaataatgttaaataaggtccccgagccccaggggcccacgagtcagaaaga

SEQ ID NO: 3369 - DNA, 3408 bp, Zea mays
  misc_feature (1)..(100): optimal_loci_238948_G1, chr7:10159715..10163122, Cluster 20
ataagcatggcaacgagacctcgtgcgaaggcgggtgtctcaaattcgtacacgtattccacgttaaaaaaacacatgattagcttgttatataggacaagcacctgtagtgcttcgctagtatgcttgccctaggacatttttagaagaaattgcatttttaatttcagaaacagctttctagaggcggtcaacttagatcttggaaaactactatatatacaaggtaggatagaaaatgtctaaagataattttcacctacttctataaaataattattgcaatgtaatgtttccggctttttagtgccacccatcgtctgacttcaatttgacgcaacctacatacttactgcctcccattccaatttataattattttgacttttattttaagtttaaccatgtcttataaaaatcataattataattattttttattataatatcgtccagctttaatatggctttaaatttttttattttttacaaaaaataaataagacgacttgatcaaacttaataaaaaagccaaacgaaatataaattgggacggagtgagtatataagacatttgtagatgtcttaactcaagttacacttcacctattaatgtgtacaagttcgtaccgccttaaaacatgttggttcttatcatctgatccacgagatggtatataaatgttatatataggaggctaagaaatggataagaagttaaaagaaaacaaatagattttatgatgtggtgccatggttgcattgttttagaaaaatcgtgtgttgtgtttgaacttcacaagaaaagggaacatactataaacagagttagggttgggaggcaacatggagagattttgttatgccatgttttggaaaaggctagcctttaacatgtagttgctcttgatcttaagagcacgctccaggaaacgatagccactggtctgtcccatcaacttctgttgtagcattatctcgattgcattcatatgctagtttagtttggacataagttatcgcccactgaatatactggttagcatgtttcaatatcatgctcaatacattcaagtgaagggtacgggcagctaacatgcatgttctataccaagatcattgtacaatgaggttgctagagtatatccgttttgtcgtatcccgaattcactttctttgaaaccaggatttcatgtataattctatctattttctctgtttgttttatatgcattcaattcatattccagatagtgtagcaactcatctttatttcagacaacccctcttccccctcctctattcagaatcgaactgattatatcattggtatatatgcaaatcaattgaaaccaagtataacaaatcaaaaggttctattatgcggttaaaacatatccaatggacatccttcctccatatacagtgcttccatcgagttaaaacacatctcatgcatgagtgtttagtagggaattattcatactattctgcggtggacatccaattcctcttgttgtatccttgttaaagaaatattgaaaactttaaaagatgcaagtatttgttgtccaccacatctccatataatatgcatggctcttgattcttgttcactgaatagatcaaatcattcgatgggtggtgacgatgttgatcgtttgttagttgcatgcttatataattatactagttaggtgcttgtgcattgcaacggtttatatatatcattctttctaagacaaatcgtggatgcaaaaaatttgttggtgttgcattgttgtcgtattccatctaagtcagaatgtgcgcgaacatatgtactgtctttcatatttattattcaaaacatgttgacctaatatgaacaaaaaataactatttttaacatatcacaatatcattctttctaactcatagtttataagacatatcgtgtctgcaaaacttttgttggtgttgcactgttgtcgtattcaatctaaatcagaatgtgcgcgaacatatagcatgtctttcacatttcttactccacaacattatgtaaattcataatatcaaggatacgaaacacaagcttatttcttgatatcaaggatatgaaacacaagcttatttcctgcagcacatgaaagtctttataatacctcattatcagaaatttaacgaattccatggtagcattacgtttcaagtattctatagtgtccatagaggcaactggcctaggttttttatctgatttctaaagttgttgtgttgtacttcgacagcttcacacttttgtttcaaaccctcaacttgttgaagatataatactttaacaaagtagctaaacgtgacaaattagatagtacaatacgacatcgtacttgcctgagattgcaactttagaatttcttgattcaactactcatttgacttctgcaagtgttcaacaccatcaaaatatagctaaaaatagttaatctaaagctagctatttagaaccttgctttgcgtgttttctactaaaaattgtattgttgaaaacatttatcatggacaatagaaagttataatatgagctgaaatctctttggaacatgtttgtgttcaaatgattaaaagactaacaaaaaattgttgaaagtaaaggaagcataccgctaggttgtgcacttttgcctacataaaattaagccatacatgatattataaaccacataaatggcatgaaacgagactcatagaaaattgactaaatataaaaaatatcaggatcacaactgaagtctattgttagtatgttacatttggcttgatagtatttactgtttccagtgcatgaaagatcaacaatattctaaacctgcatgtcaaaattaaataggcaatgtgagcaattgttacaagtttgtgaatgaactaacccaatgtcaatatgccattgtgacagcgtatggatctttcccagcgatttcaaatattaatggcaatgcagtctgactaacttggtcataaaattcaatcatgtagttatatcaagtcaaatgagaagaaaatgaatatgaaagggtatgttcatacatatgtaattttttatagacaaaatgattgttttttcatagaacaggtagatgattgataattactcatcttgatagatagttgaatacagaaacatgacatatcataagaagaaaggaattaaaatcattaactggttcaaaagtcacgacaatattgtttttcacatttataaagaaaaccaaagacaagaaatcataaataatgcttcaatccctttatagaatagttgagaacttgaaaaataaacaaggtccagaatacagggtagtaaaagtattttacaaacacattaagtctagactcacccttggtcataaaatgcttgatcacccttgc

SEQ ID NO: 3370 - DNA, 2785 bp, Zea mays
  misc_feature (1)..(100): optimal_loci_239613_G1, chr7:13962948..13965732, Cluster 20
tatagattgcggcaaagtatacaatataatcctctttcaaatataaaatatagcagtattccacaactaaatggccacatgatcaacaaatttcatattttaaccatccatgttccaatccatacaagctttagacatttctgtttgattctcacttcattggcggacttgtggcacgaagctgtatttgtaccaaagtcattcggtaaggttattgcaatctctctcctttcaactgcagaggctggctcaagatcccaactacgccgtagctagggctgcatcaagagccattaatgaactcaagaagcagtgggaacttgaagaaggtgacagtctgaggtttgtgatgaatcagaatctggcctccggggatactgatgatgacaattcagtagcagatgatgcctcatgagtcgtaaacaagaagaaagattccagtttcagtggcaatggatcaaagcataaggaatcaccatgggcagcacataagcattcccattttacttttaggactcaaaatcagataaatgtgttctggaacttgggtaaatgggggaattctgaaaacagtgtaaatagaagtctgctccctttggatattgttcatgcatgaagcaaaatgttatatctgctgccatatgtctcactacagataaaggctctgcataaatcgcaggctctgcaaaaccctaaacaacgtggtagcagaaggccatatggctcactacagataaaggcaaacaaaaaagaaaaatatagattgcggcaaagtatacaatataatcctctttcaaatataaaatatagcagtatacctaaccaaaatgctgctaatgatataaccgaaatgcatgcaaaagtaatataatgctgctaatgatcatttcagtactgatttctataaatgtttactaatcgaaactgttagtaagtggtatggtatactgctataatatacagtgtttgataattattttctgcaagttatgtatgcaaaaattattttctgcaagttatgtatactacactgcacagatcattgcaacaggacaagtcattcgacccacatactggtcaacgccagcacacagtacacctgtttaaaccaacaaacattaacccttgcaatttattttgagaacatgaatcaattagacctcaatttttttcacatatcctacattgagttaaagattatttcaaacgggaacaaaggaaaccgagcgaaacttactatacaaacagtagcaacacaagggagcagaatcgtagactgtaagaatgacaagcagaacaacaaaaagcatcgatatgaagcatgtgggctgataggtattataggcatgataggtggaagaatgacttgtacaatgcctcgacctttacagctgtttttaagcactaatcaagtgaataagaacaacaaaaacaactgtttttaagcacatctaacagaagcaaatcaagtgaataagaacaacaaaaacaactgtttttaagcacatctaacagaagcagcgatatgaagcatgtttattttatttgggatgaacaattatatgaaccttaaataagaatgaatgaataaagaaatacaaaataataaataaaattatttgcccgttgatccttaactaagaatgagtagatatgcatgcctagaccatctttgataaagaaattacagatctagtttatgggtgagctctctcatatctcctcacagtttgatagtgtaagtatcttgtagtggttcctatagtttatctgttttacttatctgtccttaaaagttcagaccatcattattttccttgtattagatgtttggccatgtatgacagtcagaatatcatgctgtacattctaggaatgctgcttagttatgcaaatttgctcagatattttgaagctgtaatacaattcctacgcctataataatacttctgtcagatgtgctttaaaacagctgcttctgctctgttattcatgagtcatcccaaataaagcccacaatcatgaaggtgttgccgatcttcttgaacaacctgtacaatgcctcgaccttgttcatgctgactgcaagaatgacaagcagatgcaacccaaccaggcaggaaaaggatgaccaaaatcacaaacaaagttattagtgtgagccaaaaaaccagcaataatcaaatgcacagttttttaggactcatgttgaagcaagtgctagtcagcagaatcaaattggaattaacaagtgaagacaatgtatacgatatgatgctctaggtgattaccgaaaagtatcaaatcatgtattaagataaacatattactcaccaagataacagatatgcatgtttggaagtagtagatctgtttagacttgaaactttgatcaaatctgtttatacttgaaactttgatcaagtcaaagtgaaaccgcattgtacacaagaaacataattgtattaatttgttaaaccattaattgaaaatgcgtagaaaaatagcaagcattacttcatagcacagaactgtagatcactataagcagaagaacatgcaatagaacaaagcattttgaaaataaaacacaatttaaagatctcatgcagtccattcttcatcagtgacatatttctatctagctgttagaagtatgactcatgaattcaagggccacagttggaacaaatttatggttgcaatagctttccatctatcaaggatattataatcgatagagatgacaattcaggctatcagatgatataataagaaggcaaaa

SEQ ID NO: 3371 - DNA, 1940 bp, Zea mays
  misc_feature (1)..(100): optimal_loci_240396_G1, chr7:17693356..17695295, Cluster 20
tgggcatttagttaaatgctctatgaaagtgaagtcacacagctgaacaatacaattagtaagtactaagtagtagtaacaggacgaccaatgcatagagctaggtgctggcaagaaaaggataaccgctgagaattgaaggctcgttcaatgcagccgaagctgatggccaatttgctgatgaccatctggtgaccaatttgcagaaccttttttttcctcgctgtggtgaccaatttgctgatgaaatggcatttaatttttcagctagaattttctgggtgtagcaacattttctgctgtctcatagagcaagatacccagtcccagtcgctaaaatggacaaagatgtagaccactcctggactcctccatcacccacactcgacgccatccgagcttgcgtcttcttcaaacttcatagcacgactcgagcggccacctgctttcctcgccatgacccgcacaacccactcgacgccggctcgatcgtggctgcctcgctcgctcctccgtgcgtgcgtcgaggctcctgcgcagactggtgcagcaactccttccatggcaagtgttgcccgtgactcatactcacacagcgacggcatcgctccatcgcacgcgccagcatcaatggcacgacgagcccacggcacacacacgcctcgaacacatacgcgcgtaaacttacaacacatatatacggggaaaatcaactttttttgtcattacgagggagagtagcatacaaaatgctatatgagtgactcagctaaccagtgattaaagaccatcagtaaagatggcaaaaaaattaaataccccatccatcagtgacttagcaaagggacaatctagtcttttgtcatcttacggggtgattgacagacttgatgcatgttaatgactcaactggttggtgagtgaccagtggtaaaagaaatttaaatgcccacagctgagcgatcaagatctgaacagagaaatggtggtagtcataccagtggcagtggtggtccataatagtgggtgacatgctgtttcattaccgctaagactcagtctcctgatgtatcacattcctagcgggagccattgatctgttagttactgcataaattgttgccattcgttgatttctcaatttatccttctgacggcgtagggtggctttatatatataggcgtatatcttatatcaatgctagctatccgttgtttccccaccaaatatctgcattcagacaactagacaagaacgctagctatataaaaagaaacttgacatgcctaaaacaaattgcttgttgtatcgatgacactttctttatagatgatgacaaggggaaaagttcgattcacgcttttttttattatcggttaacaatatataggtacaagtagaaataaattatcggtaatggttgtgtaaatgtgtctttaccaacgattttctcaaaagtcatcgccactacaaaaaaaaccatgtgtttgtattgttggttttgttaaaaacgttattaaaaatcggatttttttactcacggttttcataacaaaatcactagtgtacatacatgcttagagtatgatacttatgttcaatggtttacaattatgtttgtcactaccatattcgttgtaggcatattatattattatatccacgtgtgcatcttatattgccactatttgtttaatatgaatttttagattaaattataactgaaaaagtctatctttataactgtaacagtcatcccgatcgatttaaggtacttcatcgaaattttgcgccaagtggagttaccgttgttggtgagtgttaaaaccagcagtgcatgcacttctttcctactcgctattttaatatgcacaggaagcaatttttgatagggtaaaacccgtagttatatctttttttctaatgcatcttgttagga

SEQ ID NO: 3372 - DNA, 1478 bp, Zea mays
  misc_feature (1)..(100): optimal_loci_240399_G1, chr7:17714769..17716246, Cluster 20
tagtgatgacatcatactctttttgctacagatttcttctaaattaggatcaacttttgggctaatatgaggaatctgtttcctcttgttaggatttggggagggttctaaaacctcaacattactggaagaatcaatctcattgtcttgtatacttttaacagacattcctttctcttgtttaaatccgaaggcaacaaaataacagccaattttggtctaaagttttttatatcggtctgccaagtaagaaaaatacatggtgtggtattagagatatcattggatatctaccaataactgtagattttgataaggttttttgctatatctgtgtaaaattgactgatagttcgactcctatgtagtactctatatagttaagtaggaaaaacgtttgtaatcagtgtttttacaacgacaacgtttgagtttactatattataaaactttgttgtcctctgtttcgtgttcctgtgttctcatcaccaattccaagaaatttttttttgctctttactccatcctcgcgcacatgtaaccatgtttttttcaacccattttaattcaaaatctcaactatgtttgcagcaaaccataatgagccaagcatcaaattcacttgtgactgcttttttttttgtctttgttactgtaaaagatgatgagtcatccattaaaatctaggtcacattagactctagttaggtgcgactggtctgcaagaacataggagaatttgaaggcgatagattagaaatttatagtacttctgcccgaaactaaagatgtttagcaacttgttttgctgtcaaacagagtcttgaacaaattgctctggcgctctgcttggcaaaaaaaaactattttgacaatgcatatgtagtgtatggtacagtttctatgtttcaaagaaacgaaatgaaccgtattatcattgattcacatgtatacatcactttgtgaaggtaaatgaactcaaatgtttcatctttttttttattcctggccggtaaccatgcatgcactcaatgtacctaacttatcaactccacggttccaagttaatctttatagcatgcaattctctcacatacactaaggcatcatttggttccttagaatgatgccacgtaaccatacctaccaagaatgtttgtttaatttatataatttttgatgagttgaaatagttcgtggctacattcagctaaccgcttgcatttcccacattttcaaactcttgtccctatctttccgtccacttttgtggttctactcgagtagaacgtacaaggcactggaaaggcgcgaagttggctcttgctgctaatatatgttttcccgatacctctaaatcctgatgtgtcaacatgaaatagaacacaaaaaaaaaattgatgattttctgccatgatttttgtttcactgtactgctctatgattcctataattgatgctcatggtcccggagaaag

SEQ ID NO: 3373 - DNA, 1631 bp, Zea mays
  misc_feature (1)..(100): optimal_loci_259947_G1, chr7:139597154..139598784, Cluster 20
aggacaatacttcacttttattttctatagatttttgtggcgagtcactatagaggaagagcagcaagtcatcatgagctagagcatgatgacaatttaaatacagaagttggggttaatgatgataatatgagtgaacataatttaattacagatgttgatgtcgatgtcaatgaggataatgctgcacagaaaaaatatgcatccttcacctgatatgaaaaatccaaatggcgctaaattatctatctttgatcctataacttgggataatcttgataagaggaaaagggacatgttaattgaaaaaaggctagtaagagaattgaatatggagttccctatggatgccattggtagacatttttcatatgcttactactctagaacgttaactaatggtgaggtttataatagaaagtggttggtttactctaagcatatggacaaagtgtattgtttttactacaggttgttccaatcaaatcagagcaagtctttgttggcatccaatgaaatgagggattggaaacgtcttagtcaaagactcaaagaacatgagagtagtattgagcatttaacacacatgagcacatggaatgaacttagtccaaggctaagaaaaaaatcaaacaattaatgatgatttgcagtgagaaattgcaaagagacaagttttggtaaggatagttgatgtcgtgaagtttctagcaaaacataatctggctattcgaggatcaaatgagaagttgtatcaagttagtaatgggcataattgaaataattgttgagtttgatcatgtaacgcaagaaaacattaggcgcattcagaataatgaagtacgccatcattattttggacacaatattcagaatgagttaatttctcttcttgccaagtatttctctattttttattgcacccctgatgtgagccatgaagaacaaatgaccttgattgtgtgttgtgttaatatgtctagtaacaatccaagggtggaggagtttttcctatagttcttaaaggttgatgacagattaggagcaggactttttaatgtgttgatcaatacattgggctctcttgatttgaatattgctgaagtgagaggatagtgttatgacaatggatctaatatgaagggaaaacaccaagacattcaaaagtgtctactagaaattaacctcaaagcattatatatgccatatgcatgtcctagaccaaaccccactcttcatgacatggcaaaatcttgcacacaagttatttcattcttcggtgttatacaaagaatatatgcattgttttaatggtctactaaatagtggaatattttgtgccaaaatgctacaaacttaatatgaaacctttatctagtacgtgttgggagagtcgaataaaaagtgtgcaacctatcatgcatcaagctcctcaaaccaggggagctttgcgagaagtggagaaggcttctaatgatgacctagatatagtaagcgatgctcaatctttactcaaatcacttgagaattttgaatttttagtgggtatgattgtctgacatgatatactattttctgtcaatatggtgagcaaaaagttacagccaaaaattgtttgcatatatgctact

SEQ ID NO: 3374 - DNA, 2732 bp, Zea mays
  misc_feature (1)..(100): optimal_loci_260799_G1, chr7:144537056..144539787, Cluster 20
aaattgcccgaaatacaacctctctacaacttcggtctgatgccgcaccagactgggtccttgtacaccggaccggtccgacgctctcttctgttgaaaaccagttgcatccctctttgcgcactcagtctggtgcaccaccaaaccggtccactgagtagcacatcctctaaatcatttcgtgtcatttttagataacaaaggattaagaatttcattatttattgattgactattttcagaatgtcacctcatgcacacataaaaagccaggtgattaaacacatagtacatctttctagcatgcatcggcgaccacacatttaattactagtcaaacttttgttggcatgcaatacatgcattgttcatctgcctacacgatattttggttgccggccggccgtgtttgcctcgtatatatacgttgtggtgttattgccgagcgcgatgagtgtgcgtaaagactaatcttggatagatggtagcagtgaataaggtcggtcagatgtttggaaagtatttctcctttgccggccgcagaattcaagcccacacacgtactgactgcagcatccgtagtcgctttcagagcacatcgtctgcatgctgccctttgacatccttgtatggtgttgcagcatgcacatcccctcgaccaattcaagtccaaatcacatccatatcgccttggactactaaaagctatgtaccaagatacatcaacgacaccgtgtattgtacacacatatgtgacatttcatttcatcatgcatggtataggtatctagacacccatgcctgtgaatgtgatacatatgcattggaatgacagggataagacttgatatctaataagtcaaccaccagcttagtgaagacatgcatgcatcaaacctaggttgactattacttaaatctgcatgcatggaagacagagaaattctgctggttaataaacaaacaaacaaacaaaaaactagcatttaatctgtttaacctgtgtcagctggtagcaaataatataccaggtgcttaatgctttatgttttttctcaccataaataaaatgtatttgcactctagcagtctagctagtagacttttttgagaaataatttaatattttacgaccgtatgtagtagaactgagttgacaccctgacgccgaaattagcgggcgacacaaataaatgggacaacagcaaaggagatcgatcgaggaagacggctttacaagacttactcgaaaacgcgtctgaaattattgggggggacatgatgacaagcaaagcaatagatgtcaaggttgaaatcccttgtcgttaaggttgaagccaccaccaccacaacaagaaaagcagcatgcatgcttcagctcgcttgcatatgcctttttctcctgcatctctcatactccactatctagccttgctgaggccgcccataggcggaggtcaaaacttagttaggtaaagattcaatttttgaataatgactgggttttatttgcatgcttgacccgagtaaatccatatatatacccgaatggctatcgtgctcggtgatgcggaccaccaccaccaattgttttggcaaggtaaaggggggggagcgaaaaagatagatatgctgactagctagctgctgaaggagatgtctacacatgttgatgtggacgaggacgaccaaaggtaactcacatgtactacaagccatgattgtctttgggaacaacttgtgcactctactactcctctagagcatacacactacgggaaacgtacgtacctctctttattagcgagtgtcaaccactctgcaaagaattatttgttgaatgttactctcagtgaagaataacactaggcaacacgtaactttcttcaccgagtgccaaccactcggcatactctgttccggtagtagagttactccatgatgtcactgtaattgaaggtactcacttcacctttgttaattttttggcataataaaccagataattaagttatatatacgcatgcatcggcccaactcggacgatgacgtcgttaaatgatttgtaattaacgaatattattaattattagaacctatatattgcttcaattcgttcgggcagacaggcacctgtatatatgtgcataatgtggcatgcgcgtgccatcgtgggtgttgcaatgatgccacaacaatttcaatctgcaggatcactgcgcggagcgtgtgtgagaaattcctgagttcatggtgggctcagatgagatagagaatccagcgataacgatggagccagggcatgctacaaatcataatctgaaggcatcctatgcacgttcggttccaccttaatttaacttcgcttagggtacgtacggtacggtccgtcgcacttagcttaggtgcagctgtttgttcacaaaatataacataaattacaatgataatgatttacactcaaataccagtggtatcaaaatttaaatagtccaatattagttctaagtgtgatatctgattacggttggttctaaacaaacatgatttaacgttattaattacccattacgttataaatatgtaaaccaaatggcaccttaattggatttcagtgatggcacagatagagagtgtttttagtttgtttaactgcgtatccaatagttcacaatccaattgttcatctagcatgtgcatggttggtgggacgatggagaatggcatgggcc

SEQ ID NO: 3375 - DNA, 1449 bp, Zea mays
  misc_feature (1)..(100): optimal_loci_263206_G1, chr7:157507184..157508632, Cluster 20
aggcagacagtcccatagagagaggtcagacagccaccctaccttccacatacattacattactattgaagtgacatccactgttcgtccaccactctaataattaacaatcgacaataatatatatcactatcgattgtttaaaaacccggatagataatacatccctgcaagtctagaaccatcaatgatatttggatcaccacgaccagttcacattactcctaattctagccccaaactgcccgtgataatatcattactgtttctaggcttgatccaacacacatagactacacgaaaaaacttgataactttcttatttgggagcaattgcatggctgtcccagctcacgactctaactttattttactcatgttttatgaactttgaatcattgcccctcttttttaaaaaaaagtcaggtggcccttatttcgttataagcacataacaatgttaactcaaaccataaaaatacatccataccattataatattgtccctcttattatcgactgtttggaaaattggccacactttgatataacaacttagtgtttagtataagtatgacataaatccaaccattaattttaaagtcagttatttcaaattcaaaattttcaaatgcttcgaatttaataaaaataaattaatttaacattaatttgtttaataaaaaactaattataattttgacatgatggatatggtccaactacataatataattttagcaacaccttaattacataatatagttttataaaataatttccaatttagggcctattcgttttcttgtcagtctatgctggaattgagtggatttaaattccaaataaatcagaatctttcatattttttcaatttcatttaatccacatgaaatatgaataattgaacaagacattagtcgacacatgatgtaagatatgtcctcactattatttaggcatctaatgcctcccgttcctcccctcggtggctcggtgattcttggtgcctctaactttgtagccatcagatcgtttctcgactatccaattttccttaaccataataaaaatcttctcgctcatggtactcatgaagcgggtgatagttacttgttctctctttttaaattataaaaatattttaaaatttctagatacatcatttttattatttgatatataaatgtatcgtataatttgacgaataataggactagtataggtcacgtagagagaagagcaatatggcataaagattttcaatttattaagtctgcttgatctaacatttgtaatagtgctctacagttacctaatggttaacttaattatccttgatacttaaaaaacgatttgatggatcgcacaaagtgttttacctcgttaaatagctcgtcgcagtcgttgtgtatttttttgtgtcaacctgtaaagtatagactctaa

SEQ ID NO: 3376 - DNA, 1778 bp, Zea mays
  misc_feature (1)..(100): optimal_loci_263584_G1, chr7:159417421..159419198, Cluster 20
cttcattcactaacaagagcttttcggttgttccttatctcgttacgtttacgtgatttagtgggtttcagtacgcagaaataaatattttgtgaaataagtgaaagatcaaacctaaaaaggagtaaaagatactaagaaaaaaaatgaacgtccacgagattcgccaatggagcaatgatgacgacgacgaggctcattggctctttgcttcaaacctgggaaatgaggctgaagatgattatctcacgggatcttacttttagaaagttggaccaacctaactgtctctgctctccctctttttttactcgacattagactacctgtattcaaagcagagatcttttggccaagtcaaaaatgttttatattaacttataagaatacaagtacttccttctttaaattatagattattctgggttttatgtgtgtgtgtatagctttatgaatggttttttaaacaattttctagacttttgtatttttagcttgggtttgtgattaaaaaagtactatttagaaaatgattgcagtgtcccagagacggttaaacaatttggtctacctgaccctggctgattatttgtggggcaagcaattgatatatagatgtgaaaatcccactcgctaaccacgcatactcataagatcgcatcgatcgaacacacttagcacagatcgccatatctgttggatgaatacatttttctggttagattattgcccatctagtgctactcagctgcatcctattgggcgagcgagggagcaggggctgtaaaagactgaaaaggctgaacacatgataattaggcccaagaaaagagatgcccaaagcttgaaaggctctttgcttgtccagttcagttccttttatctagtaaactaatgctgtggtaggcaactcgatgtgaattggttctaatctctgtgttctttgtgcattagtatattgggcccaagctaagctaagggttatattatacctgggaccatgtgttttctaacccaagcccccacattgacacatggacaagcaacccaaatgctgctgccacgcctccactagagcttcaatatcctcacaatagcttggcgccatacaaataaataaaacctctcaatattctacacctgcctgtgatgcatgcatgtgatatagtaatcattttttgtgtttaccactaggtacaaaatacttggtggtaggcccaattatttagggcaagtgcaaggctggacctttgtttgaccactacaattatagctaccatgaacacacatctggacctttgtataatgcttctttatgcaccaaggttatcctcatcgttaaacaattgctcggctccctgctgcccaacttgcgattacttacaacaagtacgtgttagtggctatcgtatagacgtactcataactcatgcatatggtagttgcaatggtttgacagggaccaaattggagtctggagcagttaacaggagctgcgtcatgagtggcaggaaagaggaaagagtgatccggactgactttgtcattagtgtctaacaacgtcttaaattttaataacatcactagtttacttccagagagagagagagagagagagagtagttgctaagttattatatcatctgcggaccatgactgcgagattatatatgtgtaaaatatatctggcatgttaccccccccccccagaataccaacatttcaaagcggcaaaacaataaatactataaaggatgaggttgaaacagctcacgtac

SEQ ID NO: 3377 - DNA, 1560 bp, Zea mays
  misc_feature (1)..(100): optimal_loci_264641_G1, chr7:165240063..165241622, Cluster 20
catcgtaaaaaattattccataattgatcaaatgatactaatttggtgtcctacgtgttgatgttgtctactacaatttgatcaaaccttccatggcttgacttaggacaaacctaaaaggctaggctagaattactcggacagagtgagtggttctttcattatatccattgttttgttgtatttgctaatcagctagttacaatggtttttgataatggcttaccttttttatgagcagtcaacacacatggcatcccaacagatcccaaaagatgtcgaactttgcacacgaaatcccatgccaaaagctattaagcagatagttttttgctattaaatgaaccattttcaaccaacttcaattgtatacttggttaccgtatgtctgtatgatccttttgatagtttaggattcgttgtctaaatctatatttccatacctatttagatatatcttacatgaagatgagagaagggctggccttggttgatatcatatgggaggctatagagaagctactcaaatttttcctctggtcattcattaggcataaattcagaagtacatacttcattatttgaatagatcaaataacagaaccatattccagagagttacataaaagtatagtttgctttatttatatgtgttcgtgtttatttctacacttgtcacacacgcttcagctgttttaaatcagtagaatataccaagagaaggtgctataatactaataggtcacatgttgaaattcaaaatacacatttcaattttagttattttgaaattactaaagctacaatcatcacttagtagtcttaaagattgttattttgatgtttgttccaagatgctagattctaagttttgctatataaaaacaaccccataatgctggattcttgtttatgcttataggttgttgagttagggttaacaactttggtgaaattggattgtgatgaacatgaatgtgatgtaatatctttttttgcagatggaggatctgaatagtttttatgctctttctagaagaagtctatctattcgcttagtagcctacactctgttcaagaccataagctggtgaggataatagctatattttttctcccatgtaaagtagtctagatttatcttgcaaaagtaaagtttttttggtgccccgtgatgaatttgggttcgaagcgcaaccaaacccacgaaattgcaccaactatgataaatgcaaatcgttgttaaagattgtggaactgagttcagatgttcgcagttcaattcggataagatcttatgcttatcacgaagtgattgacttatagaagccatctattgatgtggtggatgctattggttgctctatccttgccaatcttgccaaccaaaatggcaagtctcaagatgtttcaccagaggacacctcccttgcacaatcagttgtgtagagattggaacacatcgaaagcgtgttgatgttatcttgtatgacattttataactgttccgattgttacatgcatgtttttcgttgcgactttaatccatcggcttctgct

SEQ ID NO: 3378 - DNA, 1932 bp, Zea mays
  misc_feature (1)..(100): optimal_loci_264643_G1, chr7:165254474..165256405, Cluster 20
ggcacaaaaacaaatggcagagccgttgaaaaccgtggccgagagccggagacaagataaagcaaagaaatctacatgaaagccctgcatcgaacagaagcgacagcagaaacagtgtattaagctgcactatcactttttcagcctacaacaagcttgcttctcgaaaaacaaccaaaaaaaacttagttattagggtctgtttggaacatagtaacaataccatgatatttaagcataccatggtattttagaataaacggtgtttgggagcacatctaaaaactttgtattttaaattaagattctcaataccatggtatttttaggggttaagaaaacttgaccaaagttttttgtttgcactaaggtgtcgtcttcacttctccgacactacaactaaaatattgtatctttaaataggtgttatattgtactgatgtaaaatataccatagttatgccaatgacatacaataactgtgatattataactgtggttttgagaaacagagttctctaataggtccttagttttcgcgaaccgggctaaactttacattttctttccttcttgtccgccttttttttccaaaaggaagaaaagagtgtgatatcactccgcagaatttttgtcacagttcacaatggagcgctaacaaccattatcggcgttaataaacctgtgtttggttggcatcgtcttgtctaccagtctatgaagtctagaactcaaggcgcaccacctaccatgacctacgtgaggttgttgttgaatgttgacatgcagtgtacaggaagttgggagcagacgcagctgatccgatcgatgtcgcgtgaaaaaaaaagataataatcaaggcacaaaagcacgcgttgacatgaaaaagttcacgctaactattggtaatgactatgtatgccaaaggacgttgctgctagagtgctagctaatggaggtaggttacttgtatgcatatatttaaaacataaagcctctgcttttggcaacataaagaagaagatcagctatgattcaatcaacagggtagaataaccggtgtagaactagtctagaaggaaatacgtgcatcttttttttttctttggttcaaatccagatgtcaagtaagctgtctattaattgcagaagcgagtatatatcatccccattcaagaatcaaaagaaacggtcggcactcagttcagtgtatatatacatgctggttgaccaaatcaatcaagccgaatgaagataatatatatagttgtctaatctgaaaataatccggcaagctagctatcgtagagcctttgtttgcttgctcgtagccgacagactgaaatgcaacagatcaactaagagatgcccgcgccgactaatcaccagcagcatctgtgacacgtatcgagctgcgtgcgtatctacaggggacatggaataatcatcaacataaagaatcctgatgcagaatatatatgtgctcacgtcggagagaatggatgatccatgcatattaaaaccgcaaggattttcgctcaacaaaaccaagagccctagctactagacacattttttttgtcccctatgctttgttctcatatcaagggccatgcattgatctagaatgtttagctgaaaatgacagatactataagggttcccctagatcatatcttatcctaaccctgtggctgtgtgactgccagcgtgtttatctgctaattaggacagaaaactaatcggaaaagaagaagaagaagagaggtgcacgggaagctcgatcggctcgaccatgtaacacacgcgtatgtgactatagcagttggtaacgggtcgtcttgtgtgacatctgagctcttcatggaaaaagatggcgaacctaccccgtatctctccctcttcctctcgctctcacttgacgagggcaac

SEQ ID NO: 3379 - DNA, 1592 bp, Zea mays
  misc_feature (1)..(100): optimal_loci_265104_G1, chr7:167706550..167708141, Cluster 20
catgcatgcgaaacccatgcatcaaatggtgagtaaagacaacgatttggtcagcttcaagcattgggtaggattccttacctaggatttttttcccgttgaattatattcttctggagcagacctactatcaccagagtccttaggtcttttgcctcgaccatggaggtttcaaattcgtgtggatgagaggttaccattggtgcaatctctcgatctggtgatgatgagggaaagctagggtttatatagagtttgggaattgaactgacaaccgtaaggaactagtggaaggctagaatactgaggatggtacgatgaagcccaaaagttttagggcattattattttatcctattacaaaggatgaagtgtcatggagctatggaagtcgaagcactacaaagccttattctaaagctaaaaaggaagtcaaagcgatttgatttttcataacatgtagtgccagtccagtaaactgactgagtcttgaacagtaaaatcccgagttcaagagctcgggggctatggtgtgatgatggggactcgaccaaaaggcagaacaatcagaccaaaaaagaatccaaccacatcaagatcaagctatgtttgaagagtcaagtgaatagtcttacatcgtctgagttaacgacccagccaaataaggctcaagagctactgttaaagacatacaccaaaggtatcctccaatcatcccccttggcacgatgagtagcctagggactcaaaccacatctccgatgaagatcttcatgcaagaaagctcctataagattacaatggcaaagaccttatcaaattaagagatagcttatgaatgtggcaaatcatgtaccgataaggatatgatccctagtaaattaggagaggctctgccaaggctggttattgtccatatcctctaagcgatctagattcatattatacaaccaacataaacatgtaattgtcgctctccttggactataaaaggatgaccgggacgctccaagagggtagatcatctaatcatatggcatagacaatagccaacaccacacatgatgcatgatattatctcacattaagagacatgacttatctaaattatcatgtccctttgtccctttaccttcatttctctatctttcgtgatccatcccatgaactcgctaccaaaaaatcctcgacaaatagatgatgtaaaatctttaccaaaacataggttttgtgtatgatataaagaaaccattaaaacaatgcagtatatattgctatttattttttaaacaaatggttatttaagtaacttaaattcaggcgagtcttgaattgagatatggaaaatattatgaagtcaatatgaatctccaattgcatgtagtgttttctttatattggataggagatggaaaattaatgctaacttcattgtggcacaataatgattattaaggctattttcagcagcttactcattttgatctctaattttaaactacacagtaaaattataaaccccgctctataaacagtatgatctacaatataaaatagtgatttgtactgcctaagaaacaaagtattctaag

SEQ ID NO: 3380 - DNA, 2265 bp, Zea mays
  misc_feature (1)..(100): optimal_loci_265262_G1, chr7:168588755..168591019, Cluster 20
agactcctctaaatactttctctgttgtcctaatttataattcgtttgactttttctaatttaggctaacttatgattcgtttgattttgtttaccaaatttagccagctcgtcttattaaaaaaatttaagaaaaaaattcaaagccgtactaaaggtatagtatatgctaaacgatgttatagaaaaaaattattattattatgagttaatcaaatataaattttaaaaaagtttaaacgaaatataaattgcaacggatggagcttacaatggcacgactgaaccgttggtgcgtcatttctctaggatggcacaaaatctcaaacggcagcataggagccaggagaatagaaggttctattctactactctacatccagccccagcacgtgagcgtcacgtggcagtgaccgacaaaactcgtgtacaggcagtggatgagctgagatgttgtcagcaaccgaagctgcttggctgccttgcccttgcctgctgtaaaatgaaatgcagcctgagcccgtgacactgcctgaatttggctactgcttattttgcttgattggctgcggctgggacacctgaattgacgtatatataaagtggattggatggcactgaactactgaacagagacgcttctccgtcacggttcttgtccgacatatcagtgcgcaagtgacctctcaggaattgccgacgcttcgcttcctgtcgatctcactgacctcccatctggggatcgatgcaacagccaacaggtgatggaaatatggacagggatggccgggacggggtcagcttctccctgccagcgtcagcaagcagggtccgccttgcaagtcgcgattcatgccgccaccgcaccaaggagcggctgtttgtccgcgaaccgtctggaagcgagctgaacttggcgtgactgtcatctgcccctcgatgaactaactaacagcttgcatattgcctgacaccgatgctttccgaaggaggaccatcaatggatgcatcattaagcaggacgaagctctgccagtcttgcgttgcgcccacggagcgttgaaggccttgacagtctcaggtcttctggtgtcccatcccaagcgactctcatgccgtgaagcaatcccagccgccgcacgatcactcagactgtccgtgacaatcctggtggcttcttcccctgagaagcaaaatgacttatcattgatgtccaatcctctttaattcacccataactgaacaagccctatggtagtattcagtttcgtagctagttgggatagagcggcatataccagagattatagggaaaccgaatgatgtagcatttgagtataattttcttttttatgagccactttatcctgcatagaacaaatctaaacaacaataaattggaaactgatcactaccaatctaaacaacaaacacaacctaaaatgtttgtccctcatgctgaattgttgggatgtagctcttctgattcgggtgacacgcttgaaggtgcaaaaaaaaaaaaaaaatcatgttggcgtcaccctctttgaaggacctgaactgtgcttgatgtcaggcaattcatctggacaaggccgagggttggcagcttgagttcactacactacacagttcaatttccccttgcgagagttgcctgtgttgcttatgaaaggaacttgtttggtttcggaaagcaagaccgtctccaataacaaggaacaagtgaacaacacatacgtgtgacctacagaattttgtttctccaatagataatgcatatgcaaatttatgtattggaggagagcaaatccaaaagactctttatattctccctaatagatatgaataaagattttaaatatatttttaaaaaattcctgtcatgtttttagaacctataaaactatatggctattcgatctattccgtttttcatatattttttaaaattactaggaagcaaatagatcgaactaatatatctgagtaattttagtgtttcaaaaagtatggactaaactgtggtctacatttcttattttggaacctttaaaatccaaatagatcgaactaatatatcagagtaattttgaggtttcaaaaagtatggactaaactttggtctatatattttttttattctggaattttttaaaacctaaataaatcgaaaaaaattctagtgtcattgaagagatcggtatagattttaatggcattagagggatttgctttaaatggaactaacgacgttagcttcaa

SEQ ID NO: 3381 - DNA, 1875 bp, Zea mays
  misc_feature (1)..(100): optimal_loci_266481_G1, chr7:174439052..174440926, Cluster 20
gtgactcaaaaacaagagattgatatgtatgacatgttaattaagtagaagaaattgtcataagaatgagtaaaaagaagagtagtgtatgaggcggctatgaacataacaaagccatttttgtcgtcgttgggcaaagaatgctgggagagaggtccaccgtaccttatgtgttcatggtgtcgtcattcattgaggaccctatatatataccgttgctagatatatagggttagtggcagcatgcatagatcctacatatgcacacatttttttgttctatatagtgcactgtactgttgagtcatcctctccttcccctctcctttgatttcccgtgctagctagctcgatctatgaaaatatataaatctaaaaccgttttttttgtgtgtgtgtgtgtgaaaactggcgagactatatatacccgatgatggaaaatgttaatagtggtcgattatgttgcttaaattaaaagaggttctctcagatcttttttttattattccacaagtgggtagaacagcaccctagctagcaatcatgcattgtagtatgcatggcacattatactattctgtttagtacgtgtggaaatatcaccactgtaggattatgacgacatacatatatatatcactacaggattatgatgacatagcaggaataatgtcatctcttccttgttaccgacaggattagtaaagtggtcgaggttcctcaaggcgtatccaatcttcagccctaaaaaaaaggagttgggactgctacatcgtccacagtgatatataagaggctgggtcttttttatatttctgaaagacagcaaattaacctatatatatatattgtcgtaaacgatgagagatatccatgcactgaaaaaaaaatgcgacgactcgacgcaagatcaatggtcctgtttggtgtaccttttggtttggatctttgtgaaatagcagcatctatcatacacagtctgctgctccctctccggtcgctttctcagctcgctttgctttgctgcttcctcctctccttttgcctgtccatggatcgtcactgtaaggcgaggagagccatccaaagtgcaagtggatcattacatgcgtgttcatgctggctggccggccgacccttggaagccattggaagacaggcaccaaaagagctgaagcaaatacgaaaaggttcttgacctcctgtccagtacagtgtacaggaattgggcaaccatctatgcgttgtgatgagagtcagagtcagacttgttgcagccgttggctggctcatgctcctccgcccgttccagaataaaatcgcagctagcaacgtgagaagccaactaacttcaagattagctagattgtcctgtttgggagtgcttcatttgaagaattacatatttgattttccagcttcactataaaacaacttcaataaattggtaaagcagtattcaagagtgtttagtttgtatatagactccagcttctgtaatacaaatattttatgcgagtttccttaattaaccttgatgattagcgaatgcagaaagagacatgaatcggtaggtcatataaccaatgtcatgttggataatttttgtgtaacttaatggggaggtgcgaaagctatgtttttaggcatcctttgaggagtttcgaaaatttcatgaaacagacctctagctttagtttttttaagttagagctcgtggaactagaactatttggattgaagaagctgaattttttgaagcgaaactctcctaaacagggagagtggtatggatattcgtatctctctaaattaatcggaaatatatatgtcatgatgatgattagtacaatatatgatgttgttccgacattg

SEQ ID NO: 3382 - DNA, 1816 bp, Zea mays
  misc_feature (1)..(100): optimal_loci_270588_G1, chr8:20680906..20682721, Cluster 20
agatatcttggacccatttatcaaatcagcatcactcagagtcctatacaacaatagagaactgactaatggatctgagctcaggccatcgcaagtagcttatgaaccaaggattgagattgctggatatgacatgaggaccctttacactttggtgagtccataaccacatgctacctcattgcagcgtgctaattttaaataagagtaaattgggctttgcaccacgtaaaatgtcttcattatgataattagtttggagtaagcattttcattaatggcatttaatccatatcacaattgacaaaaggaaaagaacatcctgtgaacagttatagccaaaggttcttgaaatacataaatctcaacatatatacagtaggcacctagaagtaaatatcaaataagggccagcatttaaatctcgagactattattatgagagatacaagattataattgttacatgaaaaagcaaacattttgctcatatactttaaaaaccatcaaatgctgaagaaaagtaaaggaatctaaacaataccctatcatagcagggaaaatggagttgttgttaagttcatcctgaagcattaatacataacgtctactaacataacattgatttagttttgcaaataatttaggatgtccacgaagaacaaatggactcgtgaagaatagagctatataaaatgcattgctataaaataaagatcggtgattccgactatactatgtatttatgcagcactaatagaaacaaaaaaaaaagaaaagagagcaatgtgcaaaagtacagataaagggagatcatccccgaagtaaaacatgtttattatatggatttatagattcattataacattgcccaaaaattgttataatttcactacaccagaggaagtaaaacagaaagagttttggttccttttgaaatagtttgttttattagagaaattgatatgctcacagatctgaggcttgtttaaatgtagaaatcaaaagcagtacgctctttttctttgataacctataacaattttttgtagaatagtagggaaatatttatgtagaaaagttacattatctcctaaaaatggtacagtttcactacaccagagaaagtaaaatagaaacggttttgcttccttttgaaacagtatttttgcttggatggaaactgatatgctcacagatccgaggcttgttaatgtagaaatcaataacagttcattcttctttgctaacctaatttttttgtggaagaatagtagggaaatatttatgtacaaaagttaccttgtctgcacaattgctgatggtgcatccaggactttagacctattgatgaaaatcaataaaaattttcgtgcacaaactaagaagagcatgtggtaaaaaaactatgtaataactttagggatataatgcagtacagtgtaatttcttctcgtgttggatattcgagttttttgccaacctgtaatgtatgagaaaatgtaaatatttatagaacatgtggaatcatctacacatggattaaaagtgtaaagaaatatcttacgcctgcagatattgttgttgataatttctccatagcagtagaaggtgattcttgcagcaatttaagagtagatactttgtttggtgtaggaccatgagctaatattctgaattccttttggcaaagattgttgtattcaacactacattatgttgggccttggggtgtaacatcgagcatctcgcgcgcgtgcaccaagtcgctggcaaccttgacaacatattcttccacgtgccagcctaggcggag

SEQ ID NO: 3383 - DNA, 1697 bp, Zea mays
  misc_feature (1)..(100): optimal_loci_271933_G1, chr8:29734464..29736160, Cluster 20
agatcgattttaatgctttcacaatttttaatgagttactcactggtttagagtgttttgggggtttctaaactatcgagtccaagacattctttggcaactattaaggccactaagatgtatatagggtgagacaatatttttctagctagtttcttaccacaaacaatatgttctttggattttcctacacctatatgtggagctcaaataaccaatgtcatgagtttcttttttgctattttatgtttattatctctaggctttttggttgttgtggcacttagtcacatgttgtttttcttgggccaaatttcttttgtacatttttatggtccatgctatcagaccagttctcacgtttcaccattttgtgaactatagcaggtgttttgggggtcctagaactactgaacccaaacattcttaggcaactcgtagtgccacttgtatgtgtctatgatgcgtcaacattttgtagctagttgatcacaaatgacgagttctctagattttgtacacccatgaggagctcaaatacccagggtcatgagtttgtttcactatgctcaaatgacgagttcttggtattctagtttttttattcctgggatttttgtttgttttggcactttccacatgctctgtttttcttagacttgttttcttttatagattttttacgacccgtgctcacaaatatattctcacattttcacaatatttcatgagctataacgcactagtttcatgtgtttgggggtcctagaactattgagcccttatcattcttaagccactgctaagtatcatggatgagataacatttttctagctagtttctagtcacaaataacaagttctttggattttctacacctatgaggagctcaaatggtcagggtcatgagtttttatcactattttgggtttttgattccttggattgttgtttgttctgacatgtcaaacatgtataagagcgcaatcacatgatgctttccttgggaccattttatcgtgtaatttttcatgtcccgtgcactcagaccgattttaatgttttcaccattttttgtgagttatagctcactagttttaggcgtttgggggttcttgatctatagagtcctagacatttttatgcaactattaattccactaagatgtatctagggttagacaacaattttctagctagttttacttataaacaactgagttatttgaattttctacacccatgaggagctcaactgctcgggtcatgtgtttctttgctattttgagctttttattccttggatttttgtttgtttagacatatcaaacatggcaatctaagcactcaaccacatcttgtttttcttatgaccatttacttatgcagatttttcacgtcccatgcactcagatcgattttaatatgctttcacaatttttcatgagttataactcattagtttaggtgtattggaggtttcaaaactatcaagtccaagacattttttggcaataggtcactaagatgtatctagggtgagacaacatttttgtagcaagtttctgatcacaaacaacatgttgtttggattttctacacctatgtggagctcaaataaccagggtcatgagttttgttgctcttttatgtttattatccccaggatttttgttgttctagcacttagccacat

SEQ ID NO: 3384 - DNA, 1669 bp, Zea mays
  misc_feature (1)..(100): optimal_loci_285246_G1, chr8:116028606..116030274, Cluster 20
tgcaattgagatccagagatgttttattatagatatttttatatgtgtatctttaatcacggtggttcatggtaaactaaagtccactcttatgtatctttaatgactttaagttcttgtcttgaattttccttccacaactcttctattttgatcttttgtgtgatcttttgaatttgagttcatggggacatttgggttggatagaaatgtgcaagaactcttaggatcattgccaccaagtggtttgatctgattcaactgcagtacagaattccaacccattaaccaatttttgagaaaaccccaatatgcatttgcatttttttaatcttagactgaatttgatatatttttagctcaaattttatagatgcttttgaaattcactttgtgaatgtgtgtgcaaaacttcagctcaaacatagttcatatggttgattttgccttttggagctttgatttagggtggtgagaataggttgaacgatctactaggcaagaagtgttgggctctgctcattagtttttcacaagaagcaacactatcgcactaatctgggtaggtcactattttggccactttcataattttaggtgtctgcttccttgggcttgtgtgtgctctaggaagttttcaaaagcatccaatcagtagttggttgtgttgtttgtggtttaagcatcttctttgttttcgttgaagtaaagagctcgagtttcgtaatttttggggagttttcccccatgaactggtttttggtcaatctgagtacttcactgtgttcatcgatcatcatcgagaatatcaaaccatttcttagcatttaagtatatcttttgatacttttggtgttttgtacgattgggtgaaactttgggatgcaaaccaagattgcctttgagaaaaaaaatttattggctcccattcacccaccccactagtcgcttgattaaatccttaacacatgaacacaatttacaatacatgaaaacatgacatcctagtcgctaccaccttcaaagagaaactccttgttctggtcgtagtcctcaccatcaggcaaaatcacattcttgtggctcaacttagcttccttggaccaatattcttttgcgtgaagtaagtggtctccacatcatcaatgacctaagaaattagacatgaatgtatcttcctcctattacgtcttttgcatgtattagtttatttcgctagattgatgaaatcacaaagtttagcagtgtcctcctcatattccccaccctcatcgacctccaaaatttgagttaacacgaggcgagtagctttgtttttcttctcttttgtctttcttttttcaaacctgtcctatgctgccttaggggcataatcacagctacatggttttcctgcatggatgcatacaaaaaagctagccaactcaaaaagtaattaatggacaatgaaactattacaataccaatgcacttactagtatatctaggcaagacaaaaataaggtccataatgatatatttgaactttttgatctcccttgacatttccttctctttcttttttgcggtagtcatcctccttttgtctccacgagcaaaccattcaagcgtattgggatgtattaggtgacatagacccatttgtttggtgtaatgatgttgctccttc

SEQ ID NO: 3385 - DNA, 1535 bp, Zea mays
  misc_feature (1)..(100): optimal_loci_286525_G1, chr8:123473427..123474961, Cluster 20
tatctgcattccgtcgcgttggaagagtttggaacaaacgtggggccgagccgagcggagcggaaaggcgaaaggaaaccaggttggagttggactggagggctcccggttttgtggaaatcgtacagcgaagcgacggcccctgtttccgctgcttctgtgggcgggagccaataccgtgggcgggttatggatttggtcccctcccaccgtctctctccagtcgccaccaccccgggccggcggcacccgcacacccgcacccgcacgttgacgttgacgttgtccagcgggactccgggagccggcagccgggaaagacagatgagtggcgtcaacggaccttgctactagcctactaatgactggatatccaatctttcaccaggcatgaattcagtataattaagtttatataaatatcattagtaattatgataatgtacatggtatgagtctactccgtgactaattcaataatacttattttttatatcataaaatacttatttttgtcttagaattgataaagttttagttctcatttttttgttttctatttttttattctaaaaatgtcctgtagaaggttcgccatggttgtgcgcttttctaaaataggctgctaattcccttttattcaaaaaatatttccaaatcggacatgtctttttagttagatcaacaaatagaaaattctatttttcttcgttcataaaaatcattcatttcatatattgtcgccaaaatcattcatttcatatatttcataaaagtataatttagcctataaaatatactatgattttttataattattttgataggttagtgattggataatataataactttactggtacgtaactaaaaataaatagatgatgaaaaaattgaacatatttttctaacataaaatacgatctcctcaactacctcagaaaatgtaaactcaaaatccaacttctacatgaagaaacaaataagacaaatattattagaaggctttgtatttttttctctatgtacaagttgaattttaagttcatattttatgaggtgattgaaaacatcataatttatgttataaaatatgttaagatttttttattgaaattccatatttagttttgtaccattaaattattatattatctgattcctaacctattaaaataatttttaaaattataatatatttttctaagctaattatatgattcattttacgtttttgtcatagattttagaagatctcggactttaagagaaaaagataaaagccaacaaaaagaaaaaggctcacatgggctcaatctgtcccattagcgagaacatggcccagcactagagcggcctgtacatggttttggcctggcccgtggctcaacgtagtttgatagaaggcacgtcacattgtttttttatacggtctgattggttgtacgtacgcggaagtcactggctcccatatgtggatgccaaacaaaaaaaattgagaccatttatctgcaccctcaatcctcagatacatc

SEQ ID NO: 3386 - DNA, 3222 bp, Zea mays
  misc_feature (1)..(100): optimal_loci_286901_G1, chr8:125385842..125389063, Cluster 20
tatcatgttctaaattttgtttcaaagaatgagagaaaatgaattattttaatggctaattttggtcacaacacaagtggtccaaattgtagagattgatattagtcattgcaactggaacaaaaggtagaaatagatactgcagtaaacatagaaggtataaaaaattattgcaactaataatactgtagagattgaaattgcactaataacagtgaacatatttattatgtcacatagagctcacaccgttttgtacatagaggtaaccattttaaggtcaaacacacgaccagtacaaatagatcataaatcattattactaaatttttcctgaaatataataaacaaagtctctacaagctaaaacacatgtctcaatctagtatcatgttgacaaataagtcaatctattctttagaaatctgttgatgaaacaattccttggtttttgaatcaatgagcgttgaattgttgcaatataaaacatgatttgtaagaatatgattattttaaattattattattaactatgttattgtaataaccactcacttttcatctagtgtgtagtgtgatgatctgggttgaaatgaaaagtgttgtagtcgtaacttttcgagaatgatattgttatagtatggaattaataaatataaaaattaagtacatattaaaagattttagacaagtaataaattactgtgtatcttgttatgccgcatcatagttctaataattatactcttgatagctttagataacgaacatcgtataacatttctttgcaatgggtcagtccatgtctccataatgattagatttcaccaataaataaaacattaattgtttgaataaaatctatcaaatatttaatgatttaaaaataatataattatgaattagtgtgatctgaaatccattagtatggcctctcgtatgaccttccagcaatatgttctaatggtgcaaaatgaagaactatggtaataatgtctgagtcattcacatgtgattagttaaatatgaataatttgtagattttagtcggtataattataaactatatacaaggaagggtcgttacatatgaacgttttattaggttgttgcaccacctcatgaaatgacataagatgctttggatatggagaaaattgaaatgacatgttgaatggctacacaatagtttgtgttgtcaatgtcaactctagattatgtctaatatttcgaaattgaatcgcacatagtttagacagaacgctattctatgcaatgtatatgtgcatccttgtttgagtaagacgtcaaatcgttggatatttttgtggtatgaaattgttcaattttggatgaagtgaatatgttgactttattttaatgattgatgaagtgactcacagtgatatactataggaggaaggacattttattacgatattatggttgaacagggaacttaacaactattctcgcaacatcactctttatttgtggtaagccaatgacatcttcaacgtcgtcaaataacacaaactacattaataataaattttagcttattttttcattcatataggtgtgacaagtgaactatgtaaggattaagctaaaattcgtgatttatttagtttcgtgttatttgacgatgttgaagatatcattggcttgtcacaaataaagagtgtcgttgtgaggataattgttaagttccctgttcaactacaatatcgtgataagttgtactctattttacatgacgtcagtatgagtcacttcattaagcattgaaattatgttaatataataattttctaacccatgtgccatgtattctcaaatatctagagattcaaaattgaatcgattttagactacgaaaattcccaacgttttgacgttttactcaatcaagaatgtatttatacattacataaaatgatgttctatctaaactagaggggttcaattttggaatattagtcataatctctgacattaaaatcaaatactattgtggagccattcattatgtcaattcaatttcctccaaatccaaagcatcttacctcatttcatgagatggtccaataacctaataagacgttcaaaggtaacaatcattctttctatatatttatactttataccgaccgaagtctataaattattcaaatttaaaaaatgcatatgaatgactcagatgtttggcatagttctttattttgcgctattagagcatgtcgacgaaataccatatagagaagtcacactaatggatttcaggtcacactaattcataactatattcttttttaaaacattaaacatttgatatgttttgttcgaacaattaagattttatttatatgtgaaatttaatcatcatgtggacatggattggccttttataaagaaatgctttatgataggcattagctaaagctaacaagagcgtaattattggaaatatgatggggtgtaacaagatacatattaatttattatctacctaaaatctttcaatatgtactcgtttttcatgtttgttaattcactataacaatagggtgatcagaaagttctaaccagaacactgttcattttaatccagaccatcacattacacaccgattggagagcgagtggttcttacaatatatttaaaaaaataaaattataataattttaaataaatatattcttacaaatcatgttttaaattagtgcacttcaacgttttttgatttaaaaatcaaggaactattttcatcaacagatttctagagaatataattgtttatttgacatgtgataccaggttgagacatgtgttttagactgttacagtatggtatttgtttcttatgtattaggaaaagcttagtaataatgatttgtggtctatttgtatttgttatgtgtttgatctcaaaatggttctctctctataaaactgtgatatctgatctctatgtgaactaattaataagttcatcgttattagcgcaataccaatctctacaattttttttaattgcgatgatttttgtatctcctatgtttaatgtattgttaatttctaccttttgtttcagttgcagcgattagtactgtcaatctaccaaaattagccattgaaaccattcattttcctcccattctttaaaacaaaatttagaacatgatattagaacaaaatttcctctcatatgccagcaa

SEQ ID NO: 3387 - DNA, 2659 bp, Zea mays
  misc_feature (1)..(100): optimal_loci_28700_G1, chr1:175632498..175635156, Cluster 20
agcattcagacttaacaggggtagacacactgtagtaacgaaagttattttcgaacgtacatgattacatataaaaacgaaatctttgattagttcctacggagtcgtaaaaaatatataaaaacaaagcttgctgcttgctttctgtcacgattattttaagaccagcagcacctagttatatatagtatatatactagtgtattgcgcgcgcccatgcacgcgtattgagtcattttttcatatatataagtatgtcttagtgcaaggaaagtgtatatgaacatagataaaagtggttatgagccacataagtacatgggaacaagataaggcatatgcaaaatgtgttgttttacatttttttcctttgataagcatgttgtagtacaaggaaattgtacatgaatatggagaatagtcgttatggggcacataaatatttgagaacaagatcagaagcaaacaaattatgttgctttgcagcagctgttgatgaattttaagcgagaattttggcactaaccgaagctgtagtgcgaaatgagattacaaaaattaataagtagttctttagtggcaatggtagttcatgtttagtgagttgatctgtgtatacctgtgatcaataggataaatattgttatctaactttggtagtccaaagtggagatcattattctactaaggaatttgcatgtgtttaaatgggaaaacagttttcaccaattgttatcgaggcattaacattaaacaaatttgtatttcgattaaaatatagaagtatgtaagtaaatcgaatttacctctgtactttatgacacatcaaaatatactagaacgcgtcgagcctattaaatatatttcattaggttgtatatctagaagatgctttgttaaagttgctaacattatcaaataagaagctttgtaccgtgtttgattcataaatttgtattggtagagtattagtctgaggtagttaactgtgaacacaaggttacagaggattcatttttaaataatgtcttcgaatacttacttctttggtggcaatggtagttcgtgcttggtgagctgatctatgtatttgttgacgacctgtgatcaataggataaatattgttatctaacattggtagttcaaagtgggagatcattattctacaaaggaattttcctgtgtttaactgggaaaacaaatttcaccatttgttatcgaggcattaacagtaaatagatttgtattttcattaaaaatatataagttaaatatgtaaataagtcgaatttacctctgtactttgtgaacacataaaatatgctagaacgcgtcgaggctgtcaaatatatttcattaggttgtatatctagaagatgctttgttaaagctgctaacattatcaaataagaagctttgtattgtgtttgattcataattttatattggtagagtctgaggtagttaactgtgaacacaagattacagaggagcaggtgtacagaggagaaaaatgaaaactagggagtgtttaaaagttgtgtcgtttccgtcctgctttaataataaggaaacacctaagacatgatactcccagacaccaccaagaaaacactaaaaacttagtggcacatccactgatgtataaagtgttcccatctttgtctcagtttctttattgtattttggtaatttgacaatacttctattgtgctttgatgtcaaatggttggccttgaaacatgatgaatttgttggtgtattatatcgaaaaatcaaattttgtgtgtgtatttcaggtggcctactttccttttgatgatcataaatgtcctccactacaacttgtcatttcattttgacatagtgcctactcatggttgaaggaggaattaaacaatgtggttgttgttcattgcaaagctggtaaggcaaggacaagattgatgatctcaagtcttctactatttataaaggtaaggttagcatgcattgtatctataaaccattaagaagatagttactgcaaaatcttcaccaaatatcttacaattggagttaggaaagatgtgtagatggaaaatggcttattctaccaagtcagattgtgagtgaccctcattgttgtggaagttgatcatataacttttgtctttatattattttgaactttctaggctaattgcagagatatgtgaagtatttcgagcacatcttaacttgcttcaatggtgaaatcagccaccttggaggtaattataccttttcaaccatggtatcgaaatgatatgcatgtgtattttgctttagtaattaatcatgttgttacactttccaggtgtatgcttagaggaatcgatgggatgcaaataaaatgggggagggtggacgtgttaattaaacatacctactgtcctcaaagtcaaaagtgctaggaattagagttcttttggtgctgggagtcgacctgcagaatccattagaaattaggcgaccaaggggttattaatctcagtaaacacatctgcaaaggaaaatttacaccctaaagatattttcattactctcagttcttcaactggtgccctatggcctgtggttagtgtccggacttctcatgaaaaacatgcagccataagggataaggttgaggacccc

SEQ ID NO: 3388 - DNA, 2890 bp, Zea mays
  misc_feature (1)..(100): optimal_loci_292873_G1, chr8:157661711..157664600, Cluster 20
cctgttgtgaaagtaaaagattgtgatctagcatatactaacacaatccatatttaaaaaaatcatattggcatgtagagatacactattttgaatttgggcgattcagctcacttgaactacaaagtggttacctgatggttctactaagtattaagtggctcccttccatacactgtgattcattcatatatgaacttgatcaagagtcgctaagaatatctggcactcattatcaaaatgttttaaattattgaaatccaccatggcaaaggagattgcaggtctaggaataagagacctaaataaagttggtagagcattttaactacagtgtctacagcaggactgggtggaccaaacgaaaatttgggctggaatcgacgttcactattttttgtgtgaagcgaacagatcaacagtgaaaggacatatgctacaatataggtagaacaatgtaacaggaaatttaatagtcttgtacatgttgatgtctgttctagggtagagatagtagcagttcatgtaagaagagcatgtattcataaaattcgtagaaaaaaatgaaacattatttctgaacttacctactgaagaagtggacagtacaattagaagttttgaaaatgaatgggtgcagctccgcgtaaattgttggtatatccataaatataaaaatatattagtgcccatataatttactgagttgacataacgatgaatatggaactacacatttgaccatgcaatttaatatgtacttgcataagggtgtactgatgaattttgtagtgttcataacagcccgtcgagcagaagctgcaatgtgaactaatctcaatgttgatgagctggttgagcgagctgcaaaattagaattagtatgcattgttagtaagctacaacatttaatctgtgtggatctatataatatgtaaggtgaatgatgtaacatttagcgagacaatctaaatctattgcagtagtgtatgcatcaagcaaactctgtaatggtgttaactaaaaaatctatttgggatgtttaaataacaacaaatgtggatgtacattatggaaaactataactttctgtgcacaacaattaaggtttaataatctgcattgcaacaacatcatttgtaattaaaaaataatacaataactaagctttaacaatcgacatcatagttgacataaaagcaaaacatgaggttaaatgtcgtctacggagttgaaatatgggctgcaaaatttaacatgtgtgcaagggattgctgcttatgacaaataagaatagtggactatcaacgggaatacatgtatgcaaatttttctgagcttacctacagaagaagtggacagtacaattagaagcttgaaaatgaataggcgtaggtcctcgcaaatggttggttttatcataaataaaaaaatatgtgggtgcccatatagtcagctgatttcaatatgaaagtacacattggaccatgcaatttaatatgtacttgttgtataagattgtattgataaattttgtatttcggataacggcccaccatacagaagttgttgcaatgtcaaccaatcacaatcttgatgaggttaatgagcgagctgtaaaattacaattagtacatattgttagtaatatgcaacatttaatctgtgtggataaatatgatatgcatgtaaggtgaatgatgtaacaattagcaagatagtccaaatctattgcagtaacgtggctgatgggcacattgactttcagttaaatgtggctacctgttatgaacagaggaatggttttaaagagaagttccaggataagaactgtgctgaaaaactgaactttagattgaacattcgtgattaaagtgctcaaagcattgacttttcaagtcctgtatcattcgcgtcaatctccatccaattcttctggcttatacaatagaagatggtgcacaaataatactaagaatacaaaaaaaaattatatgttttgatagttaagaacacaaaatatggttaagctgaactaaacgtatctctatagcttctgcagttctggtacaatataattcagcacatgaacacatctgaattcagcacatgaacacatctgaattcagtaaaaaaaaggaggaagaatttatgcataccaaagaatttcctatgatgcaatacctggatgaggaggctggtccatcttgtgcgcctttagttaagccagcagattctaatgttccattccggcgaaggaaatacagttcactaaggccatttagcacaatagcaactaagtcaaacatatttggaagtacttcaaattctaatgctgatgttccagtttgtcagcttgagagattcacacccattgtactaaataagaatgtgcagcgtgtgcaagctgctaaggaattcatagaaaatagtgctggagctgaaaatttggaagatttctctgcagtttggaagcagacatattatcctcaggatggcagtgaggatcaaatcagggagctacaggtcccacgggaagtctttccgccaacagagaatttggttgttaaacagcaccttaaaagaaaaaagggtccaattttcagaagcaaagcgtagtagcagaagaaccaagaacaatagaaggatcctgactaaatcaagattcagtcgtaagtttttctttgttagtgctcagtattttgaaggatatactctgatatatctgcaaaaaatattagtttcttctggtaatcctcacaggttatataaaggcctagaaatacagaagaggtcacaaaagatactcaatttaccttgtatacggatcttggaagcccaagttcatccaccgtcctggtttgacagcgggcaactcaacattaactga

SEQ ID NO: 3389 - DNA, 2764 bp, Zea mays
  misc_feature (1)..(100): optimal_loci_293480_G1, chr8:160291699..160294462, Cluster 20
tgtgtaattatttttttgcatcacttgaagtcttgaaccatgatttcagttttctacttttttctaaacgttggaagtagaaaggtgtttcatagttgttttgaagaagatagagagagggagggtaggtttgatggtcagatggtggttcataccgaacaacttatagtttttagcacatagctaacgatagttttttcacaactcctacctcatggatactatttcattgttcatgattgaaataaataagccattatgttgtgtgtgacatatgaggatgcttatgcaatgttccattgatcatttgttattttcaatttatatcacgaccacacatacttaccaaagcacatttcacatgttgtaacaacactactttaagttcttttttagttatcatacaatgcattagctttttggaaatatttttcacagactagtctatctaagactgctatctttataatggtttctaccacaatcgccattggcaatggcccaacgcggggatttccttgcatatcttttgtattgtatgtatggttttttagggctagaaaaggtaacctagctatgggacccgcttttcctagatttatgagtaggatatggcttcaaattttaaatagttgtttaactatgaccaaatgatatgatgtacaattatttccattgtgcagtacaatgtgacatgttgtctcactatttttattgtatttttataaaataaagttatatgttttcaaattttatagcaaatgtatgattataatcagaaaacagagcgggcattcaaatttgtcatgtgtataacacgttaacacagtggagttgtcaacttttagctgacatcttctatagtaaacattcatttgatggtcacatataagtatccctcctgtcacccaccttataccaacctagaacaactaggtaagttgtcgcaacaagcaagttgtgatagttcaatgcaataaaagatttagtgtgtttagttctatagccagttagcatcaaaagcttgccagcatgagaagatgttggcaaagcttgcccgcatgtacatagagaaatagctagttggctattcaaacatgtttgtagctttaatttctcactaaataaggtcggatggttttgttagaaaacaaatttgcctctatttaggagtttttaggttatgtttggttgaacttctggaaagtgtttctgctaagttgaacaccaaccaaatgggtgaaatctaaacctgctttccataagatgttattttgtgtagtaaaattttcatatatcttgaacactgcttttgattttctactttttccaaatggtgggatggaaagatgtttgatagttgttttgaaggagatagagagaggagtaggtttgatggtggtttcaacataacaacttatagtttttagcacatagctaacaacatttttttcacaactcccaactcactgataccttccatttttcatgactgaaccaaatgaactattaaattgtatgtgacatatgaggatgcttatgcaatttaccgtttgttgttttaagtttatagcatgaccacacacacttattagatcacatttagcatgttgtaacaacactgctttaagttcctttttagctatcatataatgcacgaggtttttggaaatgtttttcacaaactactctacccaaaatagttatctttacaatggtttctaccattagtacatgagtaggtatcctcacctatctgaccaccttgcacatcatcatactcctcatgcaaactatcaagagatcaagtaatcgggtgtggtagctaatgtgcattaacattacaagggttctagtgaaaactcgacacatcaccctctggcatgtgagccctccttaaaagtgttgctaaagaaatacttgttatgtccactttgttgggtcctaagcaatgcaactctctttcttcgctacttcttaacacgagacctcgcaaaagacttttactcattgcagagtcaagaggtaataatattttgcgatgtgtttaatagatggacatggagtaacatatcaatgttgtgtactgaaatgtagtggtagatgaaggttgacatggtcgatacacatcagtcgatagctggtgtgacagtgaatatagccctgaagggatgaaatgagcctaagagtcggcgacgtattttactgtaaccatgatgttgagtagacaatgcctagcacattaagtatattctatacgtttgatgaatagtgtttttcacatgtgaaataatatacacaatattttttgagatcgagaaacattttttataacacgaaaaatgttcttttcccactctacaatgttctcatgctagcaaagcgctaaatatgttacagtcttgagttactttttaataaaacttacagtgttgagttggtgactcaatgtcatgtcgttgatggctagttataacctgtaaaatcaagtttggttggcaatccgcctgcttgaaagtttaagctttcgaacacgaacagtgtagaaaatgcaaaatgaaaaaaaaatcgcgtgtaataaaaaattacagtgttacagtcttgagctactttttaataaaaattacagtgttgagttgatgacttaatgtcatgtcgttgatggctagttataacctgtaaaatcacgtttggtgggtaatcagcctgcttgaatagtgtagaatcacgtttggtgggtaatctttcgaacacgaacagtgta

SEQ ID NO: 3390 - DNA, 1559 bp, Zea mays
  misc_feature (1)..(100): optimal_loci_295852_G1, chr8:171587625..171589183, Cluster 20
gtaagtattttttggagtttatttgtcgttttaatctctcatgttcctagaaagactgcatgatttggctgtgttccttctttatgtttgcttctctctatcttccatcatctagtttaatctatgtttagggcttctccggttcttttggatctctgttttttcaaccgttctttacggacggttgtttctctgtttgttgccttgggtacggtgaggccatcgtggttgcgcggcgctccgtgtcgcagtagacgctctcgcccaacgacgatatttttcaggcgaatgttttttttttgtttcaaccaatgaattaaccatgctaactgaatggacatctgattgatttgtcatctgagctaatttgtaaattgtgatctaattattgaggaaagatgttctctagagtagtaaataataataataaattgtcggactttgggcttctttcatttctcgagcttcagcaccctgcaatttcccatcgtgttagcactgaatctatgtgaaatacgacttgacttttgctattgtttcggttttcaatttacaacggcaaataaagtaaaaaagattggagcctacgcattgggtaaggagttgctggtgaaagcttaactggactcatcggcttccatgaaaatatgatgacactttcattaatattatcctaaatatatctataaaactctcacgaaacatctattaagaatttaagattgggctaagtaacctgattaagatagttgtcaagatgttatgaatactagttgtttccaatgggctttggctcttacttaaatactcaatgacgtaggaatagttgtttccaatgggggttgggactctctttaaatgctcaatgacgtgtcattcattctcttttgaagagttcaccttttttccttttgaccgtctcttgacacgtttttccattaaaaggaaatatagaaatttacaagcatcaagacggtaatcatcggataaccaaacactcagcaaagtctcgctaggtccgctagtttgtggatagtttcggggttcagccatctcgggtcgctactgaagctttcatgattagggatctaagaccttggtgctggcatttttgccatctaatagcatataagcactgtaatcgaatgtcccacttaaaattttatagattatatatgtcctagctaataaataaattaaattatacaaatgtcagctttatctctcctagtaaggtgtcaaaaactaacaatacaaagtgaatagacattaacaatcgtggcaaaaataatgggataacgaggggacccaaaaaatcgtgagtcgtgacacctatgtcactgatgttattgttagctaaaataacaatagaataactatttctatcagttaaggacctttacaaattatcacctataactttacatgaactataccttttatgttacagtagcaacattatacatgtgattttgtctcatagctgatagtataccaatagacgggtaaaaaaagcaaataatttgacagaatattacccttcgtttgacatccgtatc

SEQ ID NO: 3391 - DNA, 1513 bp, Zea mays
  misc_feature (1)..(100): optimal_loci_296080_G1, chr8:173011120..173012632, Cluster 20
atataagtatcgaatatcgaaccaaagcagcattaaagtagcatgcaccaagagctagtaagagtgtgtttctaggcgttgcgtcaatatatacagatatagaaatagtcgaatagctggtttatatttacacaaaaaagtcttctgtccagtagtgatgctactcttgatgagtgggcaaaaaccaaatatctacatgtatacatgggaaaatatcagttatggtaaaagtgtttgtcaaacattttgttgttgtatacgtggttcaagtaatagtgaaagataatatgttgactatgtataaaatatgtcatgtgtagacgttttgaacaggctttcatatatatagtaaaatatatagtaaatggcgtgagtgagacccatattctattataacgtgcatgcatatttgacactaacaaaaaaggaacagttagtagcaaggtcagcatactagagatacagcaataattccctcaaaatatacaatgattggttcactaccgaaaacaattgaaaattttgaactgtttgtgcttatgtacagcatgtctcaagttgttaaagtcctgaccgagcgaagcagccaaataaactaatctgatcatttccaaccaagaaatttctatatttattaattgaggtgctaactaaacaaaaaaatgatgctgtattaaaattaaaggagagagagagagactgagagaaaggataacataatttcatagatgagaaaccatataatgtatgtaattgaatacaaaattattctatacaaactatatattatttgataatatagcttagtgtctatataatttgaaaatattttgtagtctgttttgagaccgtactgaggtggccttttggctcaggggaacagtcttacggaagcgatttaaaccgataaaaatatgagcataaaaaaaataaaggtcccaccgagatttgaactcgggttactggattcagagtccaatgtcctaaccactagaccatgggaccgttgatgttactgtatataaattaaaattattaaagtacatacgtgttgctagctgtatttgttgtctcttaagttcagggcttcaggctatttgacccgaaacggtcgatgagtccacccaacaagccttgattgcaatctcgcacccatcagcgcgaagaggcgtagcagcgtatcaccgtatcactccagccgtccagtgtgagtcgcacaccacggagagagccgcgtgcatctccgcatccaaagcggactggatatatggattctgcttctaaattaattcttccagtatagagtgtaatacggagtatcgctcagcgactcagcgttacaactcgacccaacgctaggcatttcacatcaacgacgccaacataacaaccgattaatgattagtccagctacatcgtcaccacccgagccccatgccgaggtttcatgacgtgacaaatagtagtacaagttaacagcacgcgtgcaaaagcgtatcttgtgaaattcgtt

SEQ ID NO: 3392 - DNA, 1856 bp, Zea mays
  misc_feature (1)..(100): optimal_loci_296432_G1, chr8:174430477..174432332, Cluster 20
gatataggccacacgaccaagcacatgtctcttctacaaacatagaacaaagtaccacacctcggtacccaagaaaattgcttatgagaacagtcgataaatccccgtatgtttaaatgacaccttatgaatttaagttgcaggccgaacaatgaaacaatctaccacctgatatcatatcaggtcaaaattacaaacttccaaccggaaaatagagacttcatgttgatttcaaccataatctgatgcatgactacttattgacagaaatatgattgaatttcatgctttggtaaacatccaagttacaaagaggatttaaacgccctcccccacccacccacccttcccttgtgagagccgagaggcatgattatgatgatgtcattccaaacaaagggcaaaatcttctgagcaggaattcgtctctgcatccttttcaattcatagggttctatagcaagttttttgtatccatttattcatgaggccttgttcggttgcgcagggatcggagattgacaagatgagtaacacacctttccgaagtttatgtcaccatgtgtttgggcatgcagttcagctctcatgataacaagttcagtattgttgggagctttacttgttgcacagtcagtggcattggacttaaactgggaattgttgatgattgacatcggcttcttgactaccagcaaggaagtgcagtatagtgctaattgcttgagcttgacatattccttgtctcatgagcttcttggtacttcaatgttgatcagtatggcagaaaagggaagcctagagtcctagagatagcatattagcatttggctttgataaatcaataatcatatgggatctaggagccaaacttatgtcatttttgcacagcaattcatttgatttcttcaagatttgttacagtcaaaatttatagatggcaactaagaaatactaattgtggcaaccgcaatgtatggtgcacatgcttgtcttcacttatgcagcaccaacatggagttttggtatcagcttggcacattcaggtgtattacagccactactggttgaaacatatggacataggtgtgccatttgtgaagctaatagtatggcctatgatgcaatttgtattggtgccactggatgttggattactaaaacattgctgttggttgagagcaaaaaatttgtcgtcatatatatatattgatatgaagactttgttggaactcaatttgacatcagtggttgtcttcatgctaacattaacaatgagttggttgagacaatgttttgttgccagctagctgcttgttcttgatcgtgcagtggtagccaaagttcaaactggagatcatgtctggtaaagctaagcagccgcgagggtcatcaaggcaagctaaatggcccttgcccctgttcttctcgcttccttcaggatggatccgacaaagttggatttttagccaaaaccaaaaccatagaactttcctctttcctaattctttctgattcatagccgcctgcctcccacactgcgtggagacatgtagcagccacaacaatctccaacacgcttacacgcatgcgcagacaacctgagctgatggccagagacaagttggtcgtattatcagttcgaaattgactgcaaaatcaacatatagctccgaatattatgcttggttcaaagatgacattatgcttgttcctcggtcacctactgcaaatccagtaactagtattgtcgtgtaattaacacatggtggtgttcatatatttcttgtaattatgttgctaaatacaataaaatgatagcatagtctcagaggaaccggtggcagaggtcgtga

SEQ ID NO: 3393 - DNA, 1597 bp, Zea mays
  misc_feature (1)..(100): optimal_loci_296433_G1, chr8:174433722..174435318, Cluster 20
cctgatgtataatatgttaccaccattagttgctacttcaagctcctatagatgatagccacctttagaggtttttacttatacaagagtgcctttgctttgtgaaaacttgagtgtaatcagtgtgacaaagaaccctttacactccgaaaccaaataaattggtgcacttccacttactgaaagaacactatgtaaattgcaacattaatctttgtcatgtacacacccaaaatcagcttgcatcaagccactttttctcacttgcaggaaaagtttggtgtttgcttcacttttcaaacgacaaagctttggatcttgtacataaatttttatttgggtatttgtagcatgtatattttagtttagtttttcatatgtatataactaagaataagcttatgatgtagtacatgatggtgcttggacaagctcaggctcactttaattatttaacaacatatcgataaattaaacttgttttataacttgtgagcaagattaataactaatgaaacttgaatgtgtatcaagatctaacaacagaaagccaaccatactgagttttgagacatggtctagccaactttggagaaccgagataaacaatcactcctactttagagacccatcttgaccgactttgatgggcggcctagccgactctggtttatattgcatttttttattccgaacatttttgtgtgtctaacactgcataaacatctttatatgctaactcgtaattaatgtaatcaacaagcatttaaatgaggtgaagagtttaaccttaatcattaggaaacatacttaaggtagcaaacatctcaacatttttatggtgttttatggctattttattcataaccctaagttatacattaatcaaacaagataattattcaaaacatggatatgggtgcttcatgaaactataaaatgatgctcatactgcttgaggggcatatcttaagaggaataaaatgtaaaggtgtgcgacattcatcccctaaattacactttttcaccatccttttaaagattccattcccctaaatcctagctcccacggtggttccctataaatccatccccatatacacaatacatcatattcctaatatattttaaattagtttattttatatatgtatttgttatagtctaaaatggtacatacatattaattttgtgtttaatttgtagtttatattataaaaaatagggagaaaaggaggacaccttaggtgttgtttggtacgcatatttgtaatgtaatgtgtaactaataatgttaaatcatgtttgtttaagtccaaccgtaatcagataccacactagaaagtgatatcggtctattcaaacttatgactgttggtacttgagtgtgaatcagtaccattatcatttatgttacatttcatgaactaaacgacaccttaaatttaggggcagtagaacttatcccctaaatttaggatgttctttagggataattattgtgactttaggacacctctaaaggtttagagggtgctttaaagggcacctctgcagagagcctgaggctgatgaccagagacaaggaagtcatatt

SEQ ID NO: 3394 - DNA, 1604 bp, Zea mays
  misc_feature (1)..(100): optimal_loci_297045_G1, chr9:1582560..1584163, Cluster 20
agtgcatggatgtgaaaaagagggaaggcgtggggttcgagtggagaatcgaggggattttcctcaacgcttgctcgagccagattccaatttcatgtgcaaatcacgcgaggaagggaagcgccagaaagcatggggtgacgaaagcactacatttggcatcgtttgctagtttttttgctagaacaggacaaaagttgttgcaaatatgtcctaggagtgttgccatgtatgagtgagcctttaatatttcttctggattttattttaagtaatttggtcaagcctaataaaatccaacacctgttagtgcaaagaatgagcatgcgacgacgagctagctaatgacctagagaagaagcttagggaggatgagctctctaacaatggaagagaggggaggcatgaggttcaagtggggaattgggggcattttttctcgagccggattctaatttcatgtgtaaaccacatggggaaatgaagcgtgtgaaagcatggggtgatagaagcactgcatttggtgtcgtttgccattttttgccagaagcagaacaaaagttgttccaaacatgtcctatgattattactataaataatgccatgtatctactcataatgtattcgactttggtgcttcactctctgcaataggatcattcggaattttagatgaagtgtagtgtagtgtagcacatgactggaatgattggactacataatactctcaagtgagcgaatgatatgtcacttttgcaggaatagttgagttgtccctacttgctactccccatgcaattgtacatgtctcaccaggtgtgtactcccaagatttcttatgctatgtgttcccaacggcatctaccctagcaacaccgatgacaagtgttgtttaaggctgactccaatgattccctctcctaaattcctctgtttgtttctattcttattaaatatccccctcaaagattcttccctttatttcacctcctctccaaccattccccatattcagctcctctttactctttaactgagctatttgactaatctacatcagtttttggagctttaaaaatactacaatatttgtagtgccatcatacacattgttatcaggtaattatactagaaaaatattaatttcatagctaaaagtaccgattaacgaatggggggattaagacttccccatgcacgacgtgatttccctgctaccccatggagagggcacccgaggggaaccgttgggcacacccagggtgtgctcgtacatgctagccggcggggagagccgttgtaggctgtctaattgctacaaaagggtaaagcggtgcacgtgtcggttagatttactctcatggtctgattttgggaagtgatcgacataaaagtgtggaaaagacaaaccacccatatcaagtgtagccaaaacttaaacgtttagaatagaaaggtactatcatccctcactaattcgagttctagacttgtcaagtgtagtcacataaagttgaaatcaatttaagtaaaacaaaaacatgcacgcacaggttaagcaagcaaacatgcatgcaaggtttgtgtcaatgggtgtgaaacat

SEQ ID NO: 3395 - DNA, 4316 bp, Zea mays
  misc_feature (1)..(100): optimal_loci_298920_G1, chr9:8965106..8969421, Cluster 20
gaaggagcttagtctccgtcgccatttgatgacaaccattattctctacttgttatataacacgaatggtaaccgataacgttaaatcatatttggttaagtccaaccgtaacgagataccacaccagaaattgatatcggcctattcgagcttgttaccaccggcaaatcatgattacgttacatttccatttcgtgaaaccgaacgggacctcagtgaaaggtttcgaaggctagatctagaatttatgataacaatgttaatcaatagaatcaaacccttttccaccgtttgtggcccactaaatctaatgagccgcgcggggcctagtcgcttgcggggttggcttgggcagcctactacaccagtggtatactcgctccccggccccctggggccaggcgcctctgctgcagcactgggccagcgccacgtgtgcgtgactgagatgcgttgtgaggtggtcctacctccaggactccgatcgtgggctagtgctggtaccgagcgagtgacgaaattcaacgggtaattcctgttgactttgcgtgcagtgtgctctctctgtaaaaaataaaaataaaataaacgtttttttttccataaattctgaacttgaaacaaaaaatggctgcgagtgtcgcactgccagctccttttaccgtgaaggacctagaacatccagtccagtccgatcggataataggtccagcctttcttttttcatggctcttttgcgaacctatccagtccactgcaactgctacatcgtgtcgtgtattatcctgggctacgagccaaaggcgtcttttaccgctgccggcagcagagggcttgcaaggtcggcacagcggggagcgcggcaggaaaagcgagtgcgcgtcgtccgcttcggcggtgtggacaagcgtcatttctccagcggccgcgccgatttgccgaacctatgttttagttttgtcgtgcaatgacatattcgcaccacacttaacgctaaaagtaactaaaaaatatagtaaaatttatctcttgagattaaaacagagccttaatcaaatgatacctttttgattaatatataaaggacatatgcatggtttatttcctcacttcctataggagactttgctcatttgtcaataacttattacccagagttcaattaatataatagccatacgtacgggagtttaggtacaggagcactagcagatcaaagtagatggaaggagagaaacattattgtcacaatcctctttgcttatattttgcgttgacaacatcttttttttagtaatacgcagacaccaaattaaagttgttttggggttttgggcaatcatctatcgtcttatccatcgtctacctcaaatgaaaaaaaaaaaataaaacaaactaaactagggtgatggatctaaattaggaggctggctggatattgaaaggactctctttttaggacacaacacaattatcaaacataaatcactttttttttgagaatttcatatggaatcaagttcaaatcttcatgatgataacgtatggactacatatatgagtaaagtctcttacgatcaaattttaaccccatattttttattttttaatcactaattctaattttcactaacaatgttaaggggaaggcaatcgatggcttccttttcaaaaaaagaggagtaaaatcacaaagttgaaaaagaggagtaaaatcacaattgcccctaaattttatcattatacacatacaatttttcataatagtgctcaagtaaatatgctactgagtacgcattgagatatagtaccacatttaatatgctaacatctacgtgtaaatatgatcctttattatgttctactcttgtctgatatcaaaatcaagatttccattttaagttggtaacacaattagcagatacttaatgccatattaaatgtttgccaatttctataacacagaaaactttagtaccatgtatttctcgagagtcatatgtgacgaaaagagaaaaaggaatcaaatctgacaattttgttcgtaaattcaagcatcctcatatgtttgtatccaaatccaacatagtcaattccaactattcttttagaattttgctcgattggatagtagctagacacccatttcctataattatattttgtagaatatgtaaattccaatgttcatggtcaagaaccaatagcatggattatgtacttttcccaatccataaaacttaaacaattatcaagtatatcacacattgacaatttattaaaataatttaaaacaaaataaattgatctacttttgtattggaaatgcttgataaccaaatgcatattaaaatgtcgtctcagcatcaaatgtgtacatagtgctagctagctttgtgagatgttgcgaatccgaaagaaattttgaagccacaaggatcatccatgtttaagacatggccatactaattatgacatttcttacaaagtgtaatgggtttagttatgaactaggtgtatttaacttttcataataaaaatataactaaacttaataaattgtttgcacatagctgaatccaataatatacatcgatgcatatatacaaatcacaatcatccattatgtgagcataatatagtgcacactttattagattatcaataactctaacataggaaattcaatcaactgtgacttggagttcagaaacaaggaacaagagcactgaattataacatcattgattgttgcttttatttttgtcatcctttgttaggaaaaacaaacaatcatattgaccatcaactaccacatagatgtattattgttaacatttttttacatttacattcatgtatggttattttgactgcacaaattaaaatggtcgatattgtaacataatagttgaattgcaactttatgggggcatgctatctaggataaaatatatgtacctaagacctattttacaaagaataaaaacgaaaacaagatttaaatttgtattgatcaatatataagttttatgatttaacttgattacaactaaatttaatgactacatcttaaactagatgaatgcattatgacccatcgtatcatcacacctaacacgttcttggtcgtctcaatgcttacattaatatgctagttgctaggcatgcaatgataatgccaccaattatacacaactttctaactttgagtacatatatgatggtatattggctatttcctctctagtatgaaattcaagattctcatattaggatagtatcaaagtaggaaaaacttaatgctatattaaatacttactaaaccatggaaaactttattagcaagacatgcatggaatggtttttggatacaaagagaaaaaaccaaacccgataaacctggtcaaagtatctccatctattcgcactcaaatctaaaataatcaattctaaccattttaataattatattgattatatcattgattgtgttgagttagggttatatagtttctcttgtactataatttgctaaaaaattaaccataaatgttttaaatataaatcaaattatattatttgcatgcaatgagttttttagcatgtccacggtaatttttcttagttttgaaaaaaaataccaagttgattgctggttaaatatacaaggtttgactcagaacgataacaaaataccaacatttaacaatttgaatatattttatttgatgtgcatgttataccttgaaactagtatggtccttttagaatgtaataacccaataatgtgcgctggcagccatcttgcacaatgaatatagtgatataaagaaattgtgccgaaagataagtcatgctacatttctatataattcatagttctagctcattgttttgaatttttaagttgagatacttaaatgacataataaataaaaagctagaactttaaattactaaggttaattgccactcaaatatatatccatgcaaatagaaataaagaacaataatgcattggtctagtaattgtatcatgtaagaaaagctttgagtgattataggactatacattacttaaagaacattagataaagtggcatagagatggaaatgaatggcgtttattgttaatatcatatctccaatctttcattaatccacacaccatgcaaatgcatggtagttagtaacaatgataggaatagacatatgggtgcaatgtaaataactacgatattactttcaggaatacatctctaatccttgcgctataaatttcggggtgtatgtgtgaacgcgaatgtcacct

SEQ ID NO: 3396 - DNA, 1543 bp, Zea mays
  misc_feature (1)..(100): optimal_loci_299564_G1, chr9:11238551..11240093, Cluster 20
tgatgggctcatttgaggtatcctatttccgaggaccaatcactactacactgtttacttataattcgaataatctagtcacttaattctaaacttaagctctgagttttttccttcttcgttgaggaggcttcatgttgttgtgagagcgagctaagtcatccctgtctattttgactttgtctatcaagaaagtattcatataggcattaccgtttgaacatcgacgaagaggattaaatgactttgtatattattctttgtcttcgtgatcttgtgaagtggttcttccatctatgatgttattttgatgttagaacacgatcaaagtaatctctgtaagtagataataaagaagttgttaatcaactttaaaacattagggactgtttatccggacgctcgtgggtaaaggcctgctccttgataaagggcaccattgatatcataatcaacacatagcgaggtatattttagtggtaaaagtgtgattcattcttttaataactgaatttgaagtgatatacttaaggcacacataagttttttatatccatgttttgataaaactttacttcatttaatccttttcctctcaatagcatattaaggaagaatacacattcttgtgattagtatccaaagactaaatgaatttgtgatgcctgacacaagcctatatgtatatgtatatgtataatcgattgaaatactccaatactccacaattgtgatatattaaatatatcacattcgattggtatcatattcatggaatacaattcacttcaagatgcctttatcgtgagatggtagtcatgagcatggaggtttgagtcctcttcaagacataatacagtcagtgctcattaaatgagcataaaggtataaatcacacaaaatcatgattttgaacaatggtaaaccatcatccctaagcttcaaacttggccattggatgttaaaaggtgaacaatttcaatttgaaatttataacagtcaagtttgatcaaagtcgagtatgcaaggaatggaaaatgagcatacacttttgaccgaaaccgcctatatatactatatttatgggccacagttcaatacctttcagaaaaaagagaggtcttgttgtttgttttttacaaaacaaagttttttgtgaagcatgtttgttaagctgtctgtgggccttgtgaataagttttctccttgttacttgtgagccttgctaaggtaattttctaacttgtcactttgtttttgtttgttgtatttatgggtttttactcctttttgtattagatgtctggtgttgaagagattccccatgtgactttacctgatattaagaatgatttagcagatgtcgaagtctttgagttagaatttgttgatgatgaaaccaaatgattgaggtttggcaagtcccatacggatgaggcatgtcgtgctccatggaatgagataattttaaagcttgaagcagatgaatgtgttatctttagacaattcttcactgtagggctttgttgtcctatttaggggt

SEQ ID NO: 3397 - DNA, 2460 bp, Zea mays
  misc_feature (1)..(100): optimal_loci_299986_G1, chr9:13429649..13432108, Cluster 20
agccacgccaattcaaggagagccctacgtttctttctggtggtatgtgttacgaataaacactatgctgctattaaacacatactattccttgatatttaattttcagctgactgtatcactgtaattcttatggatctatcctttccatgaatggtgcttttgatggtttttgaaggcacactacatccctatcagcttgaagggttaaactttttgcgatattcgtggtttcataacaaacgcgtaatccttggtgatgagatgggtcttggtaagagatgcttgtattgtaaggacaaagttttttgttcaaatgttgttttgggatttgagaaaatgatgacaattgcagggaaaacgatacaaagtattgcttttcttgcctcactctttgaagacaagtttggtccgcatctggtcgttgctcccctctcaaccctgcggaattgggagcgtgaatttgcaacttgggcacctcaaatgaatgttgtatgtggatcaaactattttgagaccaaaattgtgtgtaatttggacagacttatatccccttaatactttttccttattgtggacaggtaatgtattttggagctgctgcttctcgtgacattattaggaagtacgagttttactacccaaaagagaaactgaagaagctgaagaaaaagaaatcttctccatctaatgaagataagaagcagtcaaggataagatttgatgtcttattgacgtcttatgagatgatcaacatggactcgtctattctaaaaaatatagaatgggagtgcttggtacttctattttgtttcagcatcatatctctgtccagttgtccatacatagcatgttttaagatttaattaacctgtttccaaaatgtatattgtgtcaggttgtggatgaggggcatcggttgaaaaacaaagattccaagttgtttggtcaacttaaagattataataccaaacatcgtgttctattaacggggaccccagtccaggttacttcttcatatacattgtcatgcggtcatgcctgagtttttttttggaaaaactatacatttaactttaccaatacctacctgccaaattggaagtattcctactactgtactacaatatttgcttagaaattcaacagtgtcttgtaccttctagctctcattgttggcatttttttgcttgttaagtttttgttttacttgctaatttcggaatccgggtattcaagtaatgttcatactatcttcctcgtcaaacagatcaggacacaacaatctaattagtatatttgttgaatccacaatatgcttatgtgaaataagaaacgacacttttacacaactggtgtattttggatgctatttatgaatcatgtctgcaaattaagctcagcaacttcacatgagtgttgatcctatactaggtgacgtcatcattttatttgagaccacatttgttagttattcttattcaattcatttgttattaataatatggtcattgtctagtttcgtttcactattcttactatgctgttcgttgtactagtgtttgttgcatcccgaagatttttttgcaagtgttttaacttgatgttctattttcctttttttcagaataatcttgatgagcttttcatgcttatgcacttccttgagggtgaaagtgtaagatttcctacttcttggatgctcaaaattttatttcgtttagttcatgacactctgttgtcacttgtttgttagtgatgatctcctttctgtggcttctgtggccttcttctttcttataaatatgtcatggttacacgtgctagtggatgctgatgtggacactttgcatggcgagatagattgctagtggggattgaaaatggacatttcattttttgccatccttacggatggcaccaaatatcactagtcactgaccagtggggccagctgagtcactgacattctctccgtaacaatggcaaaagattagaatgtccgattgaaaaatgtaagatatatagatatatattgcttctgaagggcctaggcctaggataggaatggctgtttgtgtaaacctcaccataatttcttgttctgatatgctttcatacaaggagttgttgtcattacattaattgcttacttgctgtttatcattcgtcctggtgatttataatgctgtttccactatattatatgagcctaccatgttcttaactgtcagatggcttggtaaatatgcttgcaaaaaaaaaaggctggctaaatgccataaggtgcttttgtgaaaccccccataaaattgaagtctctgttggcattgaatttcagaactgtattaatggagtacttaaggaaaccttttttctgcaagtacaaggaaaaataggattagataaggtttaagatggtgaaatactgtatatataactgaaccatcgtaatttact

SEQ ID NO: 3398 - DNA, 1636 bp, Zea mays
  misc_feature (1)..(100): optimal_loci_313089_G1, chr9:96445752..96447387, Cluster 20
ctatagcctatttggaattcagtaaatcaaagcatactttttacaacaccattatttcttcgaagccaactgaacaccattgtgtaaagagacagaacatagtataactcacttgcaagttgcaatgtctcctttctaagctcaccgcatacctgaatattgaggaacaacaccaagtcagcaaatggccaaatacacaaaactccagagatactatgtatcccagagatggggcattgagatagaacaaacttaacacatcgacatcagtcacagcacaatcaaataacacctacgtatggatgaaattcgggtttaccgttgtggaaaggatgaaggactagaggaaaaataaaacagctgttgaaactttgctcatctgaatatccacaagatgtaagctttcaacgattctgtacactgggagatatggactgtaaagaagagatgatgaaaaaaagaagagcaaccttacagcaactctgatatcgctaactaataaaaaaggtctcgaattgtttccagagtagtaaggtgtaaggataaccattacagctaagataacactcttaggaacctcaataatagttggaactgaatgacacaaacgctaaaacaagggttataatgcataatggatttcagcatcctccggtgaagtcaacaataatagatttttttaaataaaaaaagtgctacatgcaactgagcttacattgttctaggttttcactggaccagttgaattaaagaatgcattatatgccgcttatgtctttaggtagcctctgtaactcttcagtactgcacaaaaagattcgatttaaaagatagcaccatataacaaggttgtcaacttctgtcaaacgatgcatcatcaggaaaattaatattgtgcaaatagacatgttgtcatcaacatatacaattagaagcgcagcacaacaaatcagctgtgcataaacagtccttccaaaattctatagctagtgtcaagtttcatagaagcagacaagcagtccaactctacatttccccctacaagctgcctggccctggtcgttcaggtttgccttaccataaagattttctaggcttacatgggtctatccaaagatgagaaggccttaccggcggccccttgcgtgaaggtgtgtcgcctcttctcactcgaacattgaccatttagtttttcaaatatgttctatctacaccattggctcgataaaaaggtaagattttatctataaatctgtatgtatgaaatttatttatagttagaacaatttttaggtggaggtgacggggcggatttaggatcctggctgccacctaggctaggggctagggcataggatatgacctaaatttttttaacgtccttaaaatataaaaaaaaatacatgattaatctaccttgtttcaatggtatttatatagcttatgttcttcttaatttatattgtctttatttaacattttattattattattgtattaggttgattgatgaagaagaattaatatattgtttttataatggcgtttttcgtatgttatatatttatctttatgttacgttgtcatcaaacttgtgagctatattcgttagcgtgcttttgtcagttgtcataag

SEQ ID NO: 3399 - DNA, 1511 bp, Zea mays
  misc_feature (1)..(100): optimal_loci_316091_G1, chr9:112327725..112329235, Cluster 20
tgtgtgtgtgtactcccgtgctaaactcggaggtgcagactactgtcactctaccagatatcttcaggtaccgctaccggcaataatgatggattagcattagctaaccgagggctccacctgcttgtttaaacgagcaggcagaagaaccagagacatgtgaagaaagagaagggcatcatcccaatcccaaagcagggccgcagacggtggtagggcgaccagggtatccgacggtccctgcacgagaggcgccttttgcggagtgagatggggatagaacctatttaaaaaaaaaattcgtttctgctctgcctctgcctctgcctctgcctcaccttgcatctttgaactccatggaaaacctgaaaaaaaaaatagggagcaaagctgtgctatcagtggttgcattgtcggtagactagcaggagctccttttattttatttttggagagagagagagaggctgcaggctgcggcattattggaggcaggaaaaagaatgatgtacactctagcatagccggagcgggcggcgaagcaatggtggcggtgggtggcaaaaccgatatgaatgatggtgcaggtgcgcaacccaaccgtttgtgtactactactggtgtatacgattgacaccaacaaacaaacaaacaaatacttcgagcgttggagataacagttggaactagctaagctacaaatccagtggatgatcttacaaattatatatggctcttgtaatccatttcttcataaactccaatatatacaatgatttatacttaagttgtggaacatttatttaaaatttaaatatatggtacatcgtttttttagcatagctaaatgtctatttttatatgcaattcatgatacgtacatatgcttaaattcacatataagggggtgtttgagagtaaagtttttttatagttttggaagaatactgcaatattatatacacaaagatatttggcaaggtagctaaaatctctgtttttaaaactaaagtattgcaccttcttagtgtaccatgtatactaatctcattcctacttagtacttatcatgggcctttaatttttttgaccaactgctagataaactatatactaagtccaactaatcaacattggcaattgtttagagttgcatgtgcttgaattgtcggaattcaatcgacttgagttcgtggagttgtatgcgctcgcgttgatcaaagttatgtccatttgagtttgagagaggtagacactaacaacatgatgtaccagtcaatatttggcgtaggggatagatgttttgtgtacacaaagtatttatcattgcatatttgaatcttgttttattctaaagcaaagatccaatcacttattcaacttaatagagaaacaaatagaatattcctctttgctaaatggagatatgggtaatttaccagcaccacagtataaggatactttattttgtttttttaaatagttggtatttttccgaccttttgagagtt

SEQ ID NO: 3400 - DNA, 1603 bp, Zea mays
  misc_feature (1)..(100): optimal_loci_321841_G1, chr9:142749043..142750645, Cluster 20
tcactgaaagcaatagagaaatcgcgggaggtgacaggcccacacgcctcaggcctagtagctagcttttggtgatttctatgcgctgaccacacgaatggaaaggaacaactaaaacaactgtgcttactcctcctaccaaggccacttattcccctatgtacatctgttaattctgtttcatgtgatactagtttcgtcgtccaaattataattagtgtgtttttcaaccctcaacttgcacataagtttggttttcaaccttaaattataaagctgggtactagtagtagacatcctccaactccaaccgttgaaatcggacaaatttggtcccttgactagtgtcaaaggtggccttcattttataaaaataacaaaaatatgctttaaccaataaaatgtataagtaatctattttaaatcggaaatgtgtgaaatgtttcagttttttttttctaaaaaaagttatctaactgttggtaacctatttacagttattcgaaacttatttagctttgtttctactgtttcattgctcttgcggactgatctattgaaaacgtgaaccaagaagattttaaataactacaaagggggcataaacaaatgaatactattttcaggaaaaaagaatgatattagtttcacatttttatttaaaaatgaaaagtttatgaatttttagagatcagaacaggtttttattagtttagaaaaatagacaaccacctttgaaactaggtaaagatcaaattaatctagttttgttagttggagggtgtcaaatacctgatttcatagtttagggtcaaggtactaattaaatatcgtataacgggttcataattgtttggcatcgagacagggggatcacgggtgctgtcgctggcgtaagtttcaatagcggtatatatatgatgaattgatgatcacacatatatttatgtatatatatcatgaataataaatctaaatgtatatttaactatacttgaagacctgatgtggcacacactttaaattaagaaaaaacatggtgttcaatatattatatataagtcatcacatgtcagagtttataacagaatagattatgagagccgtaaaatagtcataagatcatgattctttatcactgtcgggagcagtatttaattaaccttattaatagttaatatgtgctaggattatttactgcatatcatatcacgcttaccactagtggtcgctaaattccaacccactaaatctgctagtctgctaaagaccgttacgaacattattaattagtagcttgtttagggttaattagaaaccaaacttccgtgcgaattgaaggttgaaaataaattttgcccccaaaataatagactgtccattgagttgggttattataaaataaaggcaaataataaaaaacaacttacaatcatatcgaaattaatttccatacacatgatccaactttcctacgtgatgtaacgtgtcagggtgggttcgaatattttttgctacgtaatgtagtaacgtgtcaaggaccttcgcttgatgtgatgtaatgcgtcaaggacatttgtttgagtaatcttttcctaacatg

SEQ ID NO: 3401 - DNA, 1733 bp, Zea mays
  misc_feature (1)..(100): optimal_loci_322790_G1, chr9:147503595..147505327, Cluster 20
taacctggcaagtggcttttcacgctcagctagctgcataagtatgaaatactaatctattaagagcctaatgctgcttcaaaatttagggttaaccagcagaccacataaaccttagtatttgaaaataaataatagttatatttgagtatataataattgtagcaaaacaccgagcaaggaaaaggttatatattataatttgtgggattcggcatcgctccctttgagacaatttgatccatcagagcgaatgcatctcaagcctcttcgctacaaacaaaatcccttatcgctgctttgtatgcaggcaggcaggggcatctggctagggctagcacgccctagcgcatacatctccttgggcccatagcttagctatggggatggagaagagggggcccgctggagttcatgatgggctcgaatttgctgcgtttctttctgggcctacggtgctatccgcggcctcgccctccccgctggtgaaattcttcagggccggcttcgacgggtcacgggcgctggcgctgatcgtcagcatcggctgatggcaggagaagtgaacacgagacagctgccgccaccggccgccggtgcacgcgtcgccgttacggtgtcgacatccggtggcacggttccatagagagtaaggcccagtcgtcttcgcttcttttggtatcccgatcgttttagaatttttagatgtcccattcgtccgatcggtccaaactgtgcggccttcttctattgcgtgtggtgcaatgcagcctctacctctacaagtatattcgctggagcgtgcgcggatatatcctcattggcggcgcagggaaaaaaaaagaaagaaaacaaaaatccttttcctattgacttttttccatgatgggtaccaaaaaaaaaaggcttgacgacaataagaaactttgagcacgacaagagtcctttcctgtcacgcctgccatatgtggcttgtccaaacaaacctcatcggactcgatacaacacgaatcggtatcgactcctgacatgtagtagtcgttatcgaccatagcgatatcaacctcgattggttcaacctgtagaacggtagctctaccgatcgtcgtagaatctatcggtacctatccgcacttgtttggtaacgaccaaatttagtgacattgagtgttttagattggttcatacgtgtgctacgttatctagttgttttgtaacaatttaaagtccaaaaatactaaaaaaaccatacagtctgatctataatttatattttatgtatttattttttattttaaaattatgtgaatttatttataaaacatatattttaaattaatgtgattgagttatgcaacgactgattgttgttttgcgtcatctaattttatttgcttaattatataatcagatatatttcagtttcaataaattacaacatttcatgtcagttaaaagatcgtagaagaaaaagttacgtggtgatgagatggttgtaggttgatgtgatttctctaagaacgatatgatttctctaagatgataaccctgatatatgattaatatgatgtaaaattttatattatttttttcatattttaaggatttttaataaaaaaatacaatattgtagatgtcattgagaactaaaagtttcataaaaaataaagatatataactttttaaggtacaccattttaatccttttgcttaagtttctttttttgacccac

SEQ ID NO: 3402 - DNA, 2235 bp, Zea mays
  misc_feature (1)..(100): optimal_loci_322921_G1, chr9:148196112..148198346, Cluster 20
cataccactcgcttctccttcaaacagttagtttcaaacaatttgcatggtgtgaagtatgataattacagttaatcaaaacgtttttataatttattcagatcatctctcgcattttgcatctgtaggtttacagaatttcgtatattacttctggtacaaacatttttctatataattgaacaaacacatttgtaattgaatccgttttgcaactccaaactgaaactaaaatccttcaaaaacccaatccaattatccttttaactagaacacaatagatattatagctataccttaacatgatcgatagaacatctgtgggtgtttctgcatatagtctcgcaggtaggaacactcatgataaaagaagtagcctcttggtcacatattagggaagggttcttcatggcaaattagaaagtgcacttgaataaagaagacataagaagtaatcctacaattcaatatgtttagccaattatgtagttccatttcgtctctatagaataaaaatataaatatactcatgtctatatttaaatatccaggaaccatgtgtttggaacatacatgccatttcattaatttatataaatgttccttttcatggcaaaagacaaacatattccatgtgttacaacaatatttgtagtctgaaacaaatcttaaactagagctggagaagaagcttccattgtacttcaatatgtgtgctctccatcaaccttatctcttcattaacaaactcctacatcttgtatctcttatttatgttttgttttgttggtagctttcttcatcttttctctatgttggtggttttcttagataattgatgctgagctaacagcttttccatgggaaaaacatacaacaaccttatgctcgttttccgtttttatgctgattgactccctacaaaccattgttctgttcatttttttgttcttatgtctcaacagaatagtgattttgttaggtgatgcgtgcaatacctattgaagataaggatatattaactgcatataatttttcggactaatcacaacttactcctcgtgtcgtcttccttgtcagcttacacaattttaaatggtacctatatgtttccatgatgccatctactttaaagttgggggcacatggaacctgtactttgcttcgacggtaatatagcagatggaccaattaactgtatcatgttcactagcatgtcagttgttacctgcatcaccatatcataatactttttctttgagtatccatctctgttcctatcacttaaacaccggcatttggcttctgctttcttgattcttcactcaaggaaatgacacaataagtgtccttattttacattcttattccaaacagagactatgaggttggtaggccatatgtctaagtaatcgcttctgctgcatgcagtggagctctgatcagttgcaccctcactccaactgagttgaccaacgtactggggttggtgctaaattcccactttttctaattaatgtaaggattcataatgcatgattcaagtgacatttaatgatgtgatgtcaagaccttttccagtgcagaattaaacttcaagggaaggacttagtccatggcgccaggtacctctagattgtgttgtgaaaacattggaaaaatgaaggggtgagctcaactttgcagtgcactttttgcaccctcattatgataatcgtgatttctctctacagttctggacagctaccctagcgctggatgtggcaaaaaccacaagggcttgtttagaatcaaagataatagagtggattgagggggctagaatacatcgctactcaattttgaatagtgagggattctagccccttcattaccctttatcccagacaagccctaatacatccggaccctcatgtgagtcgaaactcattgcagattttgagcatggtaatgctcttactagacctcataatggtattgtaatcattatgtgttaacattttgttaaatgttttgtgtgtcgtcgcaacacacgagtatctaactagttattctataaactgaaggactataaatccatattctatcatgtaggttcttactcaataaataaatgaggtaacaacatattagataattattgaacacttaaagaataaatatattaatcgcatcagtgagcatgttggataatggactgcaaacatatgatcacgtacactaaaaagtggagtc

SEQ ID NO: 3403 - DNA, 1689 bp, Zea mays
  misc_feature (1)..(100): optimal_loci_325401_G1, chr10:4867602..4869290, Cluster 20
tcgaatctgaaatcgtttgactcttaaggaacaagaacacggtttttttcaggcacctcttttgtttgaaatgaaccgggccaacacgacaactctgtggtagcctcgtaaagatggggctcgtgtaggagctttcatcctgaaaggaacaattcggcattttctttagcccggcccagtcccaatagtctaagcaatatctctgttgcaaaaaaaaatgaaaaaaggggagaaaagatgcattaacatgtcgaatgtgctcaatatcttttacaaatccaaacatgtgacggttttcagcccgctttgtaggttatgctttgaaattcatgcccatgttaaacaaactattatttgcttttcaagagaatccacttctagaaaaaaaatcttgcggctatggacttagacatctacaaataagccccaattttgtgttacatttttttttgttaatgttaaggcctgtttcaatccacaatgctataaaattagcactagtggatctaaatatacccgctaatagaccaactaaccactagccaaggacctactaactatcaatcacattttttggatttgaagccgctaatatgtgataatagggggtcatgggtgccaattagtgatggtggttccaaatagtctctactaataataagctatctatcaactactatctattggctagctgattatcagacgatggttatgtttggattataatagcttcatagaatcatgttggtaacgtaatgagtaaccgataacgttaaatcatgtttgtttaagttcaatcgtaatcgataccatactacaaatgaatactgccttattcaaatttgttaccaccagtattcgagcgtaaatcattaacattactatttacattatatttcgtgaaccaaaccctacttctaggattctagggatatggtaatatacttttcatattcaatttcttatttgaaggtttatttggcagaactcctagtgcaactcttaggcttgtttagtagcaagtggagtgaaggggattgagggtcctagaatccctcactatttaacattaaatagtggagtattttagtcaattcaatccttcccaatactcttactcccaaacaagcccttagagtaactctaagagaagttcacactctttattacatagaatcaagtatccatggtgtatatgtggaggtattgtttaaaacaaggaactaagatgctagatgctaatatgaaatgttagggcgattcctcacttgtgctacttccgtagtagtcacacaatcgaaccttatatctttcgccaattcattttatataggcaatcactttttacgtaatgttaatcctagagatttatcttttagccgtataatcacttgttctgaaggttcagaatcggagagtaaaagagttccaccaaaacaattaaaaagggttttaaattgctgtgagacatttgtccgaggcccgcatttatcggatcatctagggcaacagtgccttagttccatgtagaagtttttacaccatccttagcattacatatagcctacaagtaaacaactaagctcttcataaaattgtgtactgcacccccacaccatgcaaggctattattgcccctgaaatcgagtatatgcaacacttgcctagttcgctaagatttgggggcat

SEQ ID NO: 3404 - DNA, 2764 bp, Zea mays
  misc_feature (1)..(100): optimal_loci_32588_G1, chr1:199896903..199899666, Cluster 20
aggttttcgagctcgttaatgcattttgaaccatatgaattccatctttttgaccctcctttatttcggttacactaatgggggagaatgttaagaagtattttggtccttttatgattcatttaatacattttgaatactttagttcctaaaaccaaataagatagatactaaattttagtctcctaacttaaattttagtccctggatgaaataaaccaaacgaccctaactagtaatagaatatacaaggagcacttggaagtttgcgcaaattggaaatatgtccttatgccaaaattagacaatggttagttattttaactagctcaccgatccgtgctctagcacgcctgtaaaactgcacaattattacaagtttcacggataattttaatatgtataaactatgtaaaattggttatctttactctctctatgtactaacacaatagatacttagatattttacacttttttacccggctatgataaaacttacaaattggactatttatattttcatattttttattagcatccctgattttttctatacatattaagttgaaattttaatttaagttgtatcaattgcatctcttcttgtgacatcataaatttatattttggcttttgaacttttgatatcagatttttttattcaaaattctagtgtctgttatattctttgttcattttttatttatatcagtttccattagttaggatggcataaacgaacgttttattgtgctgccgacacttaagatgttggatatattttatatcaaagaattataagtgtaagtactattatttaaattatagtacctgcaattaaactatcaatactgatatgttataacctgttagataaaatatataaacttctataaagtagcaacttataatttttcattatagagttttaatataatttagaatgaaggtcagtgtttttggtatgtgatttgtctagggaatatttttcaacaatgataaactattaaattatagttatcactaatctatatgtatatatttgatatatttggcatatatcatttaaatttactttgaatttaatgattgttgtagtgggcatatagcatatatgtccacaaacatccggacattagtttggttggctacaatcctcatagagaataatagatattggatctattatgttccctaaaaacagtccattttttcattagagaaaaaattaattaccccctaaatctacatctaaactaccaacctattataaaaagatgaaacaaaatatatcctttttgtttacatctaaagtatccaccaaaaccgttgtaaaaggacgtaaacgaaaatattcctcaaacttatgtccaaatcatcattataaattaaaatataaacgctatacattatatatgtttctaaattatgtggttctacactacaaaattcaaagtaaatgtaaaacctagttgtcaccatgtatacatatacatgcatatcttagcgttgaatatatattttattttttatcttttagaaaaaaatctaacatttacaaagtacatctcaatgacactggaagtctagtttaaatcatattaatactctataataataaattttgtaagttgttaattaagctaagtttatacatgaccataacattataaattcaatgatcatagtttatttaaccatgaaaactttattttttatttaaaaaataatatacctttttaggagagaaaaatcaacttcttaagcaccctagtgcatcctgaaacaaaccttatatgccattgcaataactacaagaagagtttaggacctataatccatttacttaattaaatataaaaggaactatgagtaaaatatacaataagaactacattcaaatttaatacatggataagaaaatacaacaactaataagattaaaagttcaaagccagaatacatataaattcatgatatcataaaaggaatgcaatacaatagatataactttagccaaagtttcatgtaaatacacattagaaacttgtagagttgcactgcaacaatggaaatacatatagactaaatggtaccacacacacacacaatttgtccatggaactttttaatgcttatttacataaggttatgtagggtgtagggactagatgggatgggatggtccgaatttgttgtctagatgaaataatgagtctatccctgttttttgtgttatcggatatggtgggctggaatggccttgtctatagtttgtttggaaggatgaggatggaacaactattatgattatcctcatgtttgctggcgaggttacattctaaaaatttcaccattttctttaccttctttgatttttggtacaaaacactaaaagttaataaaacaaaaaacaacataaggtcgatgcattatacataacatgaagtccgatcttgatacataatactaaacctaaggttgtcacataatgccaactttaggcttatacaatacagaaaactaaagccaacacatagtacgaaattcaagctttagatttgttaatctatagttatttttccatttggtacaagcaaaagaaccattcaagttaccatttcactactctagaaacttttcacaaatgaacatagctacataaataaacttatggtctaaaataaggttgtagaatgttgttgcaatgtcaacattcttcactgaatattgaaagtagattgatatgtgagtgtccttt

SEQ ID NO: 3405 - DNA, 1708 bp, Zea mays
  misc_feature (1)..(100): optimal_loci_326190_G1, chr10:8843573..8845280, Cluster 20
ttcaatttctatccgtgaagcccacacgtaactcactggccgcgctggcatatccatatttatgaggacaccataataaaaacaaaattagtgttataacgtatagtttttataagtggttttttagtgaggtggcagctaaggaaattatttagtagtttatgggctgtgactgctcttaacatccctagctagagcctagcttccagaacataaatgattccgttgtttagcgcatgttggcactgtatttttttttcgaggcagacatgaggggtactggggtactggggtagaaaacatccttactgtgcttatattattaaataaagaaaggagtacagaaagaacgaatatcaaaaggaaagaaagagagtctcctccaaactgtgcttattagacgagtcaagattgtgttgtgtttagactactgcacagctgccaaaggagaagtcaaggatgtagagtctcgaaattaaataccgatcaagtttttttggataatatgaaatgtgcttttgcagcatctactacaatggaagaaaaaaatgtcaatcaagtttgacgtgacaattaaatgccaatcgattttttaattcaggctgcgtccttttgtagtaataacaccatctgcattctgcaacctctcggcaaagcgactcattcatttttttggtgtttattttattctacaaaaaaggaaagaaacagaaattgtatacaacaaaaaaaactgctttcgttgagagttgaactcaagacctcccgcttactaaacgggtgctctaaccaactgagctacgaaagctcttatttcttttattttgtgcaaaagattgtgaactttcatttaaaaaatgtaacggaaattgtataaaaaaattgctttcgttgagagttgaactcaaagacctcccgcttactaaacgggtgctctaaccaactaagctacgaaagcttttatttcatttgttttgtacaaacaactgttgaacataatcgaacgtggttaatgaataggtatggtataataaattgagtacatatataatccacggctaagatacaaatgtccacctctcccttatcaaagcttttagtttaaactgcacgtacacacaatttaatatggtattggagccaaagatcttaggtttgaatcctagttaacataattacataaaataattgtttgagtctatcaacgttgacgatgaatcagatccacacatctggtgctagtaagagcttgtttaggagcaagtgaaatggagaggattgaggggactagaatacttcactgttcaaaaatggatagtgaaaattctaataccttcattacctttgctaccaaaagcctaggtttccgccagcgaatctcatactcccatcccacgcgtgcggtgtggtgttcttgggacgctgtagacggacggacggacggatgtatgcaaggtaaataattaattatctagttatatttgtttcataactttggcttgattaatagtctgaggataacatttggaacaaatcctctgtctaattctaatcacttaggtgttttttgttcacaaaaatgtaaggtaaatggcaacaaaaatgatccacaatcgagtactagcggtaacaagtttgaattggtcggtatcagattttagtgtgttatttgattatggttgaacttaaacaaacataattcaacgtt

SEQ ID NO: 3406 - DNA, 2134 bp, Zea mays
  misc_feature (1)..(100): optimal_loci_33540_G1, chr1:205237601..205239734, Cluster 20
atcgttctccatacgaagttgtaccctcttatcctttgttgtaatcttacgaagcctaagatacttgtataaatctttaattaataaaagaaagagagggcattacataacaatgttttctatatttggatcatgtatcttccattaaaaccttatcttacatcattattgttttgactttagatgtttcatctgtttgtttataccttcatcttcatcctatcaatctaccttctctttgagaccgaaggaatgatagggtaaagatgaagcccgatctaactgtgttgccttgaaatttaatgcccaaggggattgaaatcaagtgtacaacagatccatctagcatttagtccagtttgaatttagcacaatgtgagccatgttaagtgtttatgtgatattatgaggtttttagccccacgttgtttattgatggatgggatgacaaccaaaccaatgggtgcaataacttgtagagtttgtacataatgagtgtaggtacatgtgaaaactacacatatgagtactatcaagtcagctatctacaaatgatttgggttaggggcaggtatgcatcttcacctataggtacttattaggtatcctaaaatccaatgagccaatactatttttcctaccatatccatcatgtttccattacaaattcccaacccaaagaaactctatcattctcatattccctcccaaattgtatcctttgctttcccactcaaacaactctcattgtcccacaactatctttcagtccacatggacctaatggactaatttatcgccatcaaacattagacattcttgcctaggccttcattgtcaatcagcctcatatagcccaagcatggtcacctattccacattctcttgctactatctagcaatgagttgttgctcccttgtgtaataagttcctcttttcggtaagtctagttgctcctgctatactctatgccttcctcctgtcaagtccttcgtgttgtgctaacttaatatagtttcactaaagggaatagggagaagtgaatagaaggaagaggaggaagcaatgcaaggtggtgaagaaacatggacaacgaataggaagaaggggaaagaactaggcattagggagttcaaaaattttctcacatatttgtgatctcaccataaaggtagtccctagtagctattgatgcatacactcatcattagaatggaaaaaaatcgagttcatcaactcagatttgcgagatctaggctagtatattcgatgaatatctaggaatagcatgttcataatttgactagtgccttcaaacacaagttgtagctctcatttctatatttccaatggtgttgatttgactcaaagcgggtcaatggtttagggacatcagccaaaatagtgttattgtcctatccatctaggatttttcttttctagatagaaatatttttagttttatttgaaattagggttggtcctagtaacttaatcaaaagttgtagcaaaaattctatagatatttatgatgtatttattttctacattcggttaagtagtttgagaattatgctcaaaacagagagcaaatttagcaacctagtcgaatatttttagaaaaaataagagaattgacaaattaggatctaatgagggatttagttgagatttcatacaagatttgtgactaacttggactaactcataagttagttttgttccatagtagtggaaagtgcgcgtgatgaaagtgtgatggcggattctcaccgaagttaagccaagtgcatgacgaacctatgtttggacttgtgcacattgcttgagttttcaaattgatttagttaattcatgtgttatgttcatgttccatctaactcaatttcatgtcttcctttacattcagtccacgtttggtggatttggatgtgtgcttggttttatattcaaattcaagctttaagttttggtttacattgaatatcaatgacacttttattcggtggtgcaatttttttggttcctatgttcatgtttctgtgagtaagtgttgcctccacttgcatggcttttattcttgcacttgcttggctttatcgataaatactatagatgcatttaggcactgtc

SEQ ID NO: 3407 - DNA, 1416 bp, Zea mays
  misc_feature (1)..(100): optimal_loci_338277_G1, chr10:83597064..83598479, Cluster 20
tggagttgtaaggtcgtatccagcaggttactcataccctgttattctatatatatgtcttgtattttatatttaacatgtcgcactgggaaggtgttcatccgtacacggggatagatatgggtgctactccttccatctggagaccggcaagctgtagcgcttggtgatgaaagatggcaaggagcacggtgacgctatgtatgcctacgccctggcctggccgcctgagttcctcgctccaagaaactgatctggtgatttccattgttttttgtttatagtaaaaagttccgcttgatgaaatgctcaactagttttttttttctttctttatgattatctgtatgcatgtatattttgccatatcatattgtagaagtagagggagcaagatattttctttttggatttgatatacagttcttactctcacttgctggcaaaaagttagaacatggaaattatcacatagttgtagaaaagcttgatggtcatcagtttggtgagttgtcccccccggtagctgtaggatgtggtatgtagtatgtacttatagttggtacaaattaattgctcaatatgttctatatacttgggcaccaaatttgaagtttgtgttagactttgcagtattattcaacactccagattgacatcctttcgaattgttggtaataattgttattatgtgtgaaatttaaggaactgctttgtttatttcaaatctccgttgtccacttaactttgcaaattttcagtttcatgtactttaggctttgttgtaacttgcatttgtgcaattcagccttttacgggttatatagtatataccttgtgtgtctagatactaaacataagtgttcaacacaaaggaatactgtaattgaaacttgtaggactccacagcaagaagcatggggcccatctatgctaactcctttgttcttgatgcctgtgttcctcgatttttttgctgagacattccttggcttccatgttcatgtctcatgtcacttgtttatgtgaagttgcttgatcaaatagagatgtaacactctaaaatcaaatcgtatcttggttaattaagaaaattccctaaagatttaaaatttcaaacgtaatataacaaaattatgaattgagactatcttccctaaaatttaataaatagtaaatgtaaaatgttggctatatacttaaactataataaatatgagggtgagttatgctatataaattactcctattgggttatataactatgtgaattccatgcttattatatttcatgcatacaaatacttatttgagcaaagtaaataaggagtaaataagtgtaaaatatttgcattcatgttgatgttttggttgtgcatataaatatggtttgacgaatcttttagatcgtcatcc

SEQ ID NO: 3408 - DNA, 3364 bp, Zea mays
  misc_feature (1)..(100): optimal_loci_338361_G1, chr10:84100282..84103645, Cluster 20
tatgcctcttcaattatagtacaaccactaaaaacatatcaaccattttctgactaaaaatcattgatagagcttgctatattaagtaactaatatcacatatacccatgtcacctaaaatatgttgaaattggatttaggtgttatggtttgggtcttaagggtgtgttggaggattaatggatcttaaggtaggaatttaccacatgcctacgacttcaaagataatagtacatacaaaagtcagatgacatgggataataacgggtaagctccagcaatgaggaactttcagtcgatggataagctcataggaaggggtggaagctcttggagatgaaagtaaggatccaccccttcctctaaaaatatttagtttagtaagaaaatggttgatgcttcataggactagaactatgtagacatagctctaagttgagaaggtttgatatctatggtactaccatttacaattgcccctcccttaattttacatcacctccacctatatttgtagggattgttattttgtggttagtttggtgctaacagtagatagaatctagcaccagtagacattggagatggagtaggatgacatggtagggaaaactttttgaaatcattttggggagttaggatggatgaagagtcccaagaaggaggaactaattgagtgtgcgccaacggaccaatctttggttctagcaacgtagcagtaattgactattggtaggttgcatcaaggttaggagtgacataagcattagtgttagtgtagaaagaagataaggtataggatagaggaagataagagagatggagttaggtttaaatggaaggaatgtgttggaaataccacaaaatccaattattaaaagaatataacatgtcaagactaactctatctaataacattttattttcttaatggccttttcttattaggtaaacacaaacatctacaaaaatatcaatcaatgaatccaaacatatagcactcaacccaacaaatgtaaggaatgttccaagttattatgtgccaaatattgagaatatatatatatatatcataatgggagaaaacacataaatatattgaacaatgcattcttaagttaacaattcattttcaattcttgtagaattagaatatattctagatatgtggaggaacaactttgaatttgaaaaataattatttacataatagcaacacacaaaagtgaactagacgcaaaccaatacaaatggttgttacacaacatgtggcaaggaattctatagaaaaagttccatccaatcaacattttgagtataagttaaggaatttttttatattggaaagaaatgacataatcatcatggtatgaccatggaactcaatctggatcatgtctctaaaaatttcatggtttaattcctaatcatattgattttttttatttttattatgaaattatttgaactcatatgcatgcatatattaagcacaaaatctctagaactctatataaacatgtgtacataaatttaacttgagtttgaagccaagattttctaggagaatgtcttacctctttctacgtgattcatgtttctttatattggatttgtgttccttaccaccagactcttgactcttttcatctgacacatttttattgccatcagaatcatgcatcttgctaccatggtcaccttgtttcttgccatgagactgttgtttctcacgatcggactccatcatggttgataatgggatttttataggtttttgatgattaatgcctttgaaagagggatatatatgagtgatctaggtaaagagaaagttgagacaagcatcaacaaggttggtaggaaaggtgaatgttgtatgatggttgataattgtagaacatttgaaaagagagaaggggagatagaggtggcactctcttgatgagtcaatgagagagagtttgtagagataggggaatgtggtagtagggtaatttatacctagaagaggtgaataattatgtatatctttaatggtacgcttttaatatccaggagatgccaggtgcccatctttattatgtttcaaatttatatttgctagtttgtctggattcttaaatagaaaatggatagtatttatacatgtacaaatctcttgctctctctatcccctctttatcgctcttatggatttctcaaagaaatcattaaagttagaatttcccaacaatggtataagctaatataatgtttgtgtatagaaaaactagcaagctaacttgcatgaaaaattgaacataactaacttggttaggttcctctaaccacttatgttcaagtgctcacttcttgacttggcacaagtgctaatattttgtcaagatttagaccggacattgatatttttcaatagactttgtcaacaagatttatctgttttgtcttttgaaggttctagtaggagtagggtttacgtgtgtgtgctcatagcaagtgagtatgtgtgcttaaatgtgtgtatttgtgtttgtaccatgtacttagaaaaaaatacaggtattgcatagggacttaaggttaatataaaactgatgttattaaatcccgcttctaagcaacaacctttatagtttatacactcttttaccataaaaacaagaaatatatgtatgttacatggacccttatattttgcacattttgtatctcgataaaaaaagttacgcacatatctaaatttcctcgtagatatgtactctttattggcttactccattccttagctaacaatagtaattgacattagaacaataaaattaactagtccataaaatgttcattgctttgtcgtagcatcaactattgttgacataaggagtatagtgtagggtttaattgaataaaacaaaacacttttgtaccaatcttaatttgaaattatgttttgtttatatatgtgtagatttggataatgagtcagctcggtttggtttgacttgttatcttaacgagcgataaggctagttcgactcgggttgtttataagttcgagctgacttattaagtttgtgagttaagtataaataatatatatgtacacaagtctaacaatatactatagcattacacaatacattcatggtctatagtttataccataaataatgcatcaatgagtatccatacatccattacaaataaagtgataaagtcataatattcttaagtttataaggtctagagcagccaccaacgatcgtaaagtgtaagacaaaactaatataaggtcaagccaatagttttgacttgttagtctcagcaacaagctcgttaactatatttaactatataagttaag

SEQ ID NO: 3409 - DNA, 1709 bp, Zea mays
  misc_feature (1)..(100): optimal_loci_33863_G1, chr1:206746430..206748138, Cluster 20
agctctagaattaataggaaccagggcctaaggcgcatggtcggccgcatacgcactatcgttgttggtcctagcatgttggacacctcacggtgcatggcttctgagtgaaggggtatgaacttcgctactgctataccgaagcctttccaatgtgtacacaagagatattttgtatatatacgggcttaattgcgcttcttaacaaatagggcatttggtctagtggtatgattctcgctttgggtgcgagaggtcgcgagttcgattctcgcaatgcccctttttttattttttatttccatcagcagaatcagatttttttggcgtttctttgctcctggtttcgaaatattgttcatttattcgttaaagtcagaatcagaagtgagcagttacgcactttttgaatcattaatcaggctaaccagagtgtacacacgtggggacgtgagcttgccgggtgtttttcgtgtcttttctgcttctcgttttcaaatattgtaatctagctctcattgaatcactatcaaatatgtctatgcattgtaatagaatccacaacttatgtacgtagtcacctaaataacttacggctccgagatttataaaacgaccatgtcagattttgtgccatggcaagtagcatcctatttggtcttgcaatggatttggattgtgctagttttagatccgaaatgtgattctgtattgaatttagattagaaacatgtggacgtcaagagtgaaaagcggacagaaaatacatgaatagaggatagtgggataggatgaaaaaatgtatttgcttggtagcagtgcgctgtagtgggaggaaaaatgtcatgaaaaaaaagagaatgcacacgctctatgtatttgcttggtcctaaaatgtttgactttatatcattcaaatgttatcttaaatgagttgttattttctttttccaatgcacatttctcttcttctaatacgcattttcttttgccgatatattttattggagatcaaattagctcagacaagtaaaaataataacaacttaattggatatttttatgtccatgaatagtacatgtcaggagacagggtcctccgtattcgtaatatttgtgcaaagttctaactacccttgaattataaggttataattgtgtgctcattcgagggtattttggtctatttctatgcttattagcctttgaatccttgttagtgatcagtcttggcaagcatatcttcgcttctaaaaagactctctagaggctttatttgattgtatgaagatgttgtctttctaggtgaagcttcataggtcctgaggcttcatacaaagtcttcgtaggtgaaacttcataggtcttgaggttttgtattgtgtattcgctggtgaagctttcaagcatagaaaacaaaggtgaccaaataacttcaatattcataagatcttcttatcactttactgctttgttgaaagcaaagatggtcatgaaagtaaatttgaaacaaagaatgttgttactcagctctaaaatatcggcgaccacgtttgcctaatgtggaatccctaatagtagccactcataggtgaagtcccagctaaaggtctgaatcccataaaactttgatttcaagtaaatgtaatagcatcatccccaatatttagtgttggccattaaggagtgaacaatgaatttaaaacttg

SEQ ID NO: 3410 - DNA, 1896 bp, Zea mays
  misc_feature (1)..(100): optimal_loci_34424_G1, chr1:209301379..209303274, Cluster 20
tacggttactgatttcagaaaataataatgttttgtagggagattattacaagccaatgcaaatccacactgtttctctgcagtgcttcggatatcgctacagctagctagctgtgctgagctgaaacaggaacaggaacagtctcttttctggagaaaatcatggcaataatcataaacagagcgatgcagatatatgtctgtcaaaccgtcgtcgttagtccgtctgcgtcgtccgagctagctagattattgcgcgccaattaaggtgcttagattgcgcctcgcacgcacgtccgcccctagctcatgtcagtatcgatcctggttaattttggcgcttctaatgagggtacacaattgaacagacacttcagtcgacgcgtggtggtgcttcgcttttatttgcatccatctgtcctttagactcgcatatgtatatggtactagttgccttgcctcctccccctctaacctctgaacccaatttaatttcaatagactctaaattccatttatatttcgtatccttttcagtagcagcagcctttatttttatttaattattctggcaaagggaagcgcgagacacggctacaattcattcagaggggtgtgtgtgtgtcaactgtcaagtgcaggtgcaggtgcagtgcataaaaatagagagagatgcatggcacagagcacctcttaccccggatgcacgcatcattactctacaactttaatcatcagggcaaccactgctaatcattcgaggtctctcctgctctaatttttccttgcaggagtcaagggagccagccataagatcagccaaaggaagccaaaaggcactccatgcatttggcttaattatatagtgcgttaccatcttccatacatcttctcctctctctctctctgtccaatgatttacaagcacgcatcacttttagattttcttctccgtctataacctccaacccaagttttaaaatttgtattcgaggtccacaccaattaatctaaaggttatgacttcgaagaagggtggttagtaaagataataagccttgttagtttgaaatactaggtcatgtttgtcaactagtagtatgcagtagctagcagggcttttgtggcttgcggttcccatgaaagacacgcatcaacgtcgttgcaatcatgggagtgccgatcggacaccaaactattgcctctcaactgcaactcatcttttaaaaaatgaatttgtactgtactcgataagaaaaacactgcaatatatatataccatgtttatttcatttacaaatttaatcttcttgatcccgatcggtgattagaaaaatgctttagggctgtacgttgaagcaggcagctaagttctctgagcactgagcagtagatggaatcggcgacaaatcaggcgtaggagagtactacacgcccccatgtcgtgttccacgtcttcaataatcaggcctctacgcaccgtttagtttaaaaatgtttatcatgaattagatggtgacagctgtggggttgggggtccaaagtattgaacaaaaccctggcctgacagcaacgtgttgtatgattttgtaataacacatacgcagttgttccagatgtaaggctaaattcatcttcaccctatctggggaatagcaaccccgattacatgtcacatttgtcctaaatatgagcgtatatgttgtttcattacaaattaatcatactcaactattagtcagaaattgttatagtagaactcgttcacatcgagctagtttcatgcacttacaaacacattttagagcagctcccagatattctctatattctctatattgtggccgccgccgctgggttttgccttcgatttcgttgacttcagaattttttatc

SEQ ID NO: 3411 - DNA, 1510 bp, Zea mays
  misc_feature (1)..(100): optimal_loci_344494_G1, chr10:118143677..118145186, Cluster 20
attcaagcatatgacggtccaaagaggccaattatctggtctaatagttttttcgatatccgcaacatatccagatttcaaattcgagtccgaatagtatagttcggatatcggatataaatatggatggttgatatccgtcgggttttggatatctagatatcttcccggatatatagatatctttccggatggttgtgtgcattttgatgatttctaaaggaaaaaataacaatacacaaatagcctcagaaattcatgaaattttacagagccacaacctatgtccatatataacctaaaaatatttgaaccataaaatccataaaatgcaatcgtttctttcattccacttcaacttgttgcgtgagttacacatgaaatcactctaaatatctaggtttcaacataatcagtacttcaccttatcattttgtgtggagacttaatattatcttattatagaatgtttattagtattggtaacttatttgcatttttggttgacactcgaatattttataaatttaatttttttatgattttctaaagaaagaaattaataatatacaagtagcttggaaaactcatgaaattttacagagacacaacatatgtccacatataatcccaaaaaatgtttagaccatacaattcataaggtgtgcgtttagttgtcgtagaaatcgagccaggatcgcatgagtctagccagtattagtagaactaggatgagatcatgcagacgcttttgtttggttacttgtatagacttgttcagattagacacagattttgtttggttggttacactaaaacgtgtattagagaaggatgcacaaataaatcttcaaatattatatagcatgaatggtctagttttgttgaaaaaatcttaggaatacaaacatgaaattagtttgatgattcaatcttttaattagaagatataataaaaaaacaccctaaaagatgtctcgtattccgtgtcattgcatggggctggctgctcgcagcctgcatcccgctgtacgcctcccacgggcgtctctgcgcagcctggccggacaccccttttgcatctgctgagccgagcttcgtagagaaataaaccaaacaaatcctgctttaaagatctgcggatgcagtttctcggctcatgcaaccaaccaatcatacggaagatgtcaacgtttattctatttcacttccacttgttgcatgagttatatgtgagattactataagtattcaagtttcaacataatcaatgtacttcactttatcattttaatgtagggacttgaggttgtcttcttaagaatatttattagtcttggtaacttatttgcatgttttgcctacacttgaatcttttatgaatttaattgtttttaaatgattttctgttgaagaaattaataatacacaaatagccttagaaatttataaaactaggcacaacatatgtccacatataaccctaaaaatgtttggacttaatgaatgg

SEQ ID NO: 3412 - DNA, 2272 bp, Zea mays
  misc_feature (1)..(100): optimal_loci_344835_G1, chr10:119886934..119889205, Cluster 20
ggggatcgcctccttcatctgcgtcatccctgactttcccaagctaggtgggttcacccttgtctttcgtacgagcgtatctcaccttactcctctctgtatcaacaacccatctgatgtacaactcacgtggttggatgacgggttgctgaatgagtggacacgagcttcgttttcgggatttcgttttttgcgttaactacgctgcataaactcacgtcactgcttatatattttttactgaaaaaatatcggagtgtttgtttgacgaaaagatggttcagcagtcaaacttagttactattggagtagtggttagaccatggaggtataaaaaacttttactcacgtgagaggtgtactagaccacaaatataaaatatgttcttcaaacaatattaaaattaggactgtttcaatcctactactgaaatatcgatttcagtttacagtaaaagctggctagcagatagatccattgtcttcaagtctattgctttgctatgcaagaattcaaacaatgtaaactgcaagtatgcactacgcagtacacacgataactcatataaaacttttgcactaactgcttgctaacataggactgtgattagctgatggaagtacaaaactatatataatatataattaactaatctgttgccattgttgatagttatgactggtcattctgaaggtaggaatcaagaattgttatactatatgacagtgtagaaacaaccatgccatttgttttgtatgatctgctctcaaaagcacatcaaccaaatttttatgatcctgaaatcactgattaaaacgctataagagatgcttgatgctttcatctttagcatgaggatatctaattagtaacacataattttgtccaaactgagtagctgataacatggtatccggtgtttattgttaaattctaatgcttcaaaattatactttgtcatcaccagtttttcatctccttcattcctattgtttgagtgctataactcagttgttacctataagtttttcaatgatttttttctcattctccacctatgttcaattaatattcttatctactattggtgggatatatggttgtctcaatgaatattcctatctactatttgtgtgatattcacatagtttgttctgctgcattgtcatcagttagtcttgctatatgctttatatgagaaaaagtgagaaattgcacctttttatcagccataagttgttggtttggataataaaactggtttttcctgaaccttggtgcagtaagtatcatcattcacatactgtgactaataattttgtactccctcttttttatttttacaatgcttgttcctcttcactaaaatggcgagattctgtacagtttaagttgctcatattgtctatccatgttcttttgatgtgcaatacagggaatgagaatctcttgcccttgagagccttttgacttcagaatatttgcaatgccacgattatgagcctgggaagcctaactgaccaaaggctaactgattcattgttttcaccatgattcagacataacacctatcaccatcatcactacaccttccttcttccatttactatagtcatttcaaaaaatgtttttgtaccattatgtggatcaaagatatcgaaaaaggagcgatgatcgtttcttatgtacctgtggttgcagaaggatgcaaccaaatgcgagatctacgtggccttcaacaccaatcacctattgatggtcatcgggcttccagagtgctctgggttccgataggatctctaaagtttacacctttacataccctggaatctctaaccattgttgcattccactttggtgagtactatgaatgagatatgaacattataaaactgttactttgatccctttgtggtggactagatgcaacaagcaattcatttaatttctcaactgtcacaaccaaaaacagagatgacataaggtaataagtaaatgaaatgacctatgatgacatgatgagggtggatagtatataaaaacaattgacaaaacttataattgtaactaagatccatatatttaaatatatgaattcaagagaattggggacatccatggtgaatatgtgcgctgacatgcagtcttggtcaaaattgcacccatcaccaaatggatgaatctttttggattgaaagaattgtagcattccctagccctttcttattgctttcatggtcatcactcactaaatcgacacagtgagctggc

SEQ ID NO: 3413 - DNA, 1599 bp, Zea mays
  misc_feature (1)..(100): optimal_loci_347380_G1, chr10:134660407..134662005, Cluster 20
acattaagaaaaggttagaaccatgagaaaacccttaactggtcctaggcatggaggttctgccttggtctccatgtgggtacggttgtacacctctgtagagatcattttggatgcataaacttcgggcataagcatttggttttttttcttttagagatagtgtagtgagagttaatgaattcgtagttaagatagatttttattacttatatatcatgtttatgcatgtgtaaattgtgtttatgggtttctagggctccatagagtgtatctagttatgtgaatctagctacattgcatcaatcatcaaaatcttcagcgggtcgttttctatgagatgaataactaaattgatcatttgtgcatctagattgtttgatcttgtgtttcactcatcaaagtgtggaggaggtgttgttgagcttctcaagatgtgggagaagttggacccgcctctccttcccttggtcgccttcttcttgatttctcctcttaactgcttgttgctagggaaagagggttccacaatatacaatcacaagcagcttgtggattcgtaaaccttcctctacatgatcttctttctagacatgtcctcctaatgcccccttctccctcctttgttcttggcggttcctagaaagagttgagatgcgaatgtgagagagtgagggtgctggtggtgagtatgtccatgaaatggatatatgatgatttgttgccatgtggagacagtagtgccttggtgagggtagttcattgttgttcttgaagtattctgacgaatggttcatgggatcattagatggtggatggtttacgggatcattagatggttcgtgagaatgaaattaatttataagtgatgcttatgatgaagaagatggctatatcacaatcaagtcttggcatctttggtgtagaggaagtggtggtgaaggtgttcttaattgttctcgatctttcctagtcattgcacctcttcacgtaggttgagcaaatccttaaatgacatcattcttttttttttaaattggcgtggtattttcttagttgtgggtttgccattatttttaattgatgtgacaatccttgtgttttatgttaaaagcatttcaagaatccttttgtaacttctaaggctagatctaatatattaggtatatatctagtgccacatcagctattgttgccattgtcagcatgtatttaccacaacaccccaatgtgtagtcttttatcatcttacagccacatcggtgctatgtcattttttcttacgaacttttatttaaaatgaaacacggtgttttattaaaataaaaattacataatatatacaaataaaagttccataattcataaatattttttaattttttaaacattaatatatattatggaccaataaataaataacacatgccatcaaatggacgatagcccaactgggtgaagcgaaccaatctactcggaacccacaagcgttgtcgccactaccaactcaaggggatgatattgcccccatttgtgcctgcctagccagtaggaataattggtacgagtagatttttttttaaaataatctcttatata

SEQ ID NO: 3414 - DNA, 1737 bp, Zea mays
  misc_feature (1)..(100): optimal_loci_347616_G1, chr10:136011584..136013320, Cluster 20
attgtcccgtcaactagcctctctttagacgttagattggctactcttatattgaccctaatacatttgtattgagtagattagagtataacttaaactaatttacgccaaatggatatcaatacatatgaatatagctaataatagaatgtccaaccaaagacttggcttagggatcctacaaacttgtcacgggacggcactgttgttaggcacttccgtccagtccggttctgccggaggtgcctagccatgtccattcggtaatagcgatggaaagagaatgctctcgatgcacaattccgtgcacgcgacagcacgagcacgggcacgggcgcacgacttgcactcacagggcgcgacaaatagcgtgggcgtggcatgcaatgaggcaagtggaacgcgcacgcgcatatgctttctcgacctggctcgagtgactgccgttctcggttttacgaatcatagactggagacctctctatagacgactatagagcgcactggcctccggcgagtggccaagggaataaaacgaggaaaaggacagggcagcacgccttctctcggataatatatggcaggccgccgaagacgacacagctgaacggtgcagcaaaggcaactggttcatcgattttcttgtcatcggaatgattaattagcctttgttgcacagcaaactagctagagcctagaggtaaaagaggtaatatatctagataatagtatagatatggttttattaccataatgaaactcaatttatctttttgatatcaataatagccccctcccccctaacattttattttcaaagttggtttcggtcggcagtaggctgctgctcgctcgtaacaaaaacactcagctaaccaaaacggggaaggactactacagtcgtcgatgctataaaccagtctcatatcatatgactgccttgccttgccttgccaggaccggtggcgaccacacggtagtacggtacgtctctctagtttggttctcttgattgttggcggcagcacaagaacataggtgacgtcaacaagactcatcaattcagtaacaaagacctgcaggcaatgattcgtgggacatgtccatctctgtacagtgctagtgtcatggaccatcggtgcttattcaattttcaaattcaaccggggggggggggggggggggcggctaaagaacccaacaaatgctggaagggctcggtggtaggaagaatgagaccgtgagaattcaaaagtttagttctcgtcctagagcatgtttggttccttcaattgacggattaaagtttagttcctatactgtttgtttccaggtgctaaaagtattcaggacacattaagtaactcataagaagaccaaaacgctccttatctttagttcctattttatttttattatgtggcaaattttgagactagatggaagtaaaatgaaaaaaataattcttagtctatagaacaaacattcttgtaggatgtagaatagacaatttgtttgtatacaatataatattatgagctactacctcccaccgatcctagttctcttcaatttatccaaaacatgataagtttttttaaaaaacatcaatatgtatgatataaagtatatatgtaataacaatacatttcatgacattacacatatttatatcataaatattaaaaaatataaattcgattaaattggaatactttaactcggtacatattagag

SEQ ID NO: 3415 - DNA, 1589 bp, Zea mays
  misc_feature (1)..(100): optimal_loci_348407_G1, chr10:139989581..139991169, Cluster 20
tgtgtgcccaagcgggcaagcggcagcaatcgcagctggtcccggcggcggtcccaacggtccaacacccatgagttgagacgagggtggctttaaaaacagcggaagtcaaagcctagaccaacgagacaaaccaatgagcacttccaaacagtagtatgtgtatatcgcggaggctacgtcgtagcaaggaaggcagcggtctatttctggctgattgaaaacgtgaggtagaagtggggttgcttcttgttttcaactaggtgaaatcacatcagcaacgtttcaatgcaactcgtaactcccaagaagctaaacaatttttaaatctaactaaggtcctatttagaagcattcagtttttaagaaactagtttaccatacacaacagtttatgactcagtttataaaaattacattatcggtttcttaaaaatgaagaggatgaactctcctatctaaaaaaataaaattagtttattaaaaattaggttgctttcaaatagaacctaaatttatataaaaaattgccagtaattaccgcaccacataaatatcaattgataaactaaaaaatattttttcttagtaaacatacttggatacctaaatattgaaactgttttctataaacttgtcaaaattttaatctggatccaaaaattatattgttttttacatagaagaagcacgccgtaagaagaccccacacctatttttttttaaaaaaaagaagtttatttttatgaaactgctggagttttccgaaaaacaaacgagcaacataacacataagctgattggaaacgtggggtaaaactgacgtgcttgttgttttcaactaggcgatgtcacatcagcagcatttcaaccacatctagttatttactctaaaacaaaatccacacatacgattgttttagggttttttatggtggtgccctccattttgctggtgtgctcatttttacccttagaaaccccttgtttttaacgtgtgtaccgtgtgcgtgcacaccatcgtaaaaccgacgccaaaggcgtctgtttcatctagaacaaagcactgtttctgtttgttcattcatctgtactagtagtggtaaactttaaacgaggagaggacggcgactggcgacgacaggacaggtcgcccaccggccgccgttggacagagaccgaggagagcgaattccgtagggctagggcgtgcctgccagtggcctgcctcatccctcctcgtggagatcagatctcatctcatcaacagcaggaggaggatttctgtttctcttttacggctcgtttcactggtgtggctctcactcactcactgtcactgtctcgcatcgcatgcatggtggtggaccaaacttggccggtgaaattttacccgctgctgaaatgcgactgcgactgcgactgcgatgcgatcagattccacaggctgcggttcgcctggttacaaaaacagcctgattggatggctggttatgcgcggtcaggcacacaccaacctggccggctggatacaatagagttgagcgtatctgcccgtgcaacaaaaatgacttgttttgcatttactc

SEQ ID NO: 3416 - DNA, 1856 bp, Zea mays
  misc_feature (1)..(100): optimal_loci_348782_G1, chr10:142169824..142171679, Cluster 20
ggctatatatattcaacagatttccaatcttatctcttatttcaaacttctctctgtaaatagtgtcatctactgttttacgtatctatttacacgatccactgaagacgatctaagctataagctatctaggttcaccttggtcaaactgcatctatcgcggaaaagataagaagaagaaagttgctcgtatatatagtggactggacactggagacatcttgtctgtttcattgtgttgagaggtctatcgtcgtcgtcttacactttttagctcaactcaatggtgcacggtaactcaacccacttaataaaaagacatctcttcgctgtcttttgaaacagaggtgaagggcgctgggtgcttttggagtgtcaacttgtaaacagttagctagatgctgttaagttttatgctggcaaaaaaactgcatttttttttgcttcccttaatgataattcccagaaaacacaccctccgtgtgtcatataattgcagagaaaacaagagcgagagtgaagcgcacctaatttggcgactagctaccttgtctttacgttaattatcacaaagctccaaagtatgatgattactactcctgtcgctattcctgtgtacaaaaaatacttttcacatttgactttgggtataatcactaatatttactctagaatattaaaaaaagacttcaaatttatgagattttacgagtatatttgactactatatataaatcttcaaacgtacataagcaacatgtttcaaaactaaataacctgaaatctcaagatacatgcagtagatacacaagacgttttaggaggacggatgctaaagctggacttgatgttgccttgatgaaattatgtgctgctagctttggtagaattacgggaacaaattgtggatggggctggatttggcaccacacaaatgtgggatgtccttctccacggtagagtgttttttagcttcgttcttccattaattgtatgcatggtcttgtactgtttgatgccttctggaactagagattggagcgttactgggcctttacttcacagtagagaactagagatgccatgcatgatgagttaagcgttgtttcccttctgtcttggcggaacggaaccggttgatattttttgctgaaatttggcctagctacttgattgaacctattattgttgacagaggattttatggatgcgcaataatagaacagattaaagctaaaacgaagcaagaatcaatgattgttaatcacggagacaggacggccgactttccttgtctctctttcaagcttcttttcttttctttggatgccaaacagaatcttgattaaggagacactgtcacctgggaacgagtacactacaagtcgagggcaatgacaaggcgtcaaggcgtcattcatctcctctccctgactatcgtggaaccggctacacagagtcagccaagggacgagaagacgtggctcagtttggcgccaacagaacacgccgtggtttctgaacctactggacctcatattattagggtattattttattatttttgttgttgcaatgaaggtctaaaatgagtgtagctctagagaagtccacatgtatatgtatttattacagataataaaaacgaatgtctcacttacaagccctgatcctgtgatccatccagatatgtctaggctgggccacggatggcaacaagaaattctccattaaaaaatagcttctcatcactgttttcacgataaaaaaaatttctccataaacgcttgtgaaaatgtttcttccacatccttgtttcttgtagggataaattcccgacaaggttctaaaaaccc

SEQ ID NO: 3417 - DNA, 1746 bp, Zea mays
  misc_feature (1)..(100): optimal_loci_349151_G1, chr10:144111852..144113597, Cluster 20
tgatattactagcatcagcttcaagaatttgtgcagatgcgccttttgaggttaaattaatcctattccacgtagtggatatggtacggtatcaccgcacaaaagcatattaattgacctaagaagtatatatatgtctccaaaaattattagagtacatttttccttttttaatcaaataaaacaaaataaaatagggaattgtcttatatagaactcatgaagatgctctaattacttaacttccctaaacatcatgatgcaatattaaacaatgggtattatcaaaaactcggccacgatatacatgtcaattaataaagagacagggtaggcctatagtactgaagactttcacattcatggagcttgaagaagagataaaatgagtcaaagtcttatcctcgcaaattcaaatacagagaagcaatatttcaaacctacgacctgatgacttagtgagacaactctcattactgcatcatgtatacccgtcacaagcatgccaattagtcggactgtcggagtaacaatctcatgagaagcaaccaagggtcatgtactcatgtttgatatggctcataagctgcttagatcagttctagtggtatagatgagcaaaaagacatgactaagcgtaaaaatgaggagaaggcaaaactaagggtatgaattttaaaaccgtattaaataaattaatcaatatagtatatataaagagagatgaccaagttttcgtagggaacaaaagatttttttgggataaaaccttgtcttgttttcgacgtaggagtcataaaattgagacccctgaaatcttcgtatgcacgcttctcctcacgtcatctatgtgtattgtgtactaaaacagtaaaacgcagaagaattcaggttatactagcttttctaacctcaattttgctttatttgtatagctcctctgactccgatcgttttaccacatacggccaaagtgttctcttttctttgctaatctgagaattcctaggaccccttttattaaaacagagggagtacgtgcttaaagttagcaacaaccaaatctgtacgtgttgacgtacgagtgtaaagatgtagtgcgttgtatctttaactgaattatgaagattgaagaaaatgaactgacctttcacttttcagagtttagctggttttcacttgcatgaaaattgaaagatacacgtacttactagcatgcgcgcgggttgaccgtttgacgctaaagctagtgaaatggtaaacccaatacggtgaactcataatgcaatcatatgcaagattgcaagaacagttcagctccacgcctagtcttggcgagagacctaattcaaccctttcttttccttagttcttcgacggcgtgatcaatacctacaagacatgaccgttgaaatggaaaaaaaaattagaccatcttttgaaaaagaatttctaatcaaatggggcactaaccaaagcaattaagaatcgaaatcatgagcgacacactaaagatctcagtgtttttattacagactacaataagctacaaaccaaggaaacgaaacattgattcagctagttacaaggtgtgttcgtagtagatcaatgtacagttaactgttcgtgtcgcccccgcgtggggcaactcagacgcccccagcaaccctagccgtcgccgcatcacctagggtcttctccttctgcgccgatgcctgagtgggtcaaataaaaagtccgcgcgac

SEQ ID NO: 3418 - DNA, 2010 bp, Zea mays
  misc_feature (1)..(100): optimal_loci_349305_G1, chr10:144744437..144746446, Cluster 20
tcttggtgtcacaaatcatttggcggatcttggtcaagtgtgtgacagaagaaattatttaaggacgtggatccatataccttgaaagaattaggtttggtgtcttcaggagttctcttcaagcacttcacgaggcatcacactgagagcttttgtgaagtgtttgggggaactcttggtgtcacaaatcatttgcatttgcttgatgttagtcatgcaccatgtgatatgagataaaggacatggcaacgttttgtgttactaggagttccctacaagcacttcatgagaccttgacttaataaagggccattgtgaagtgtttgggtgaactcttagcatcatgaagcatttagttataataatataagttatccatgtgaataccatatgggatacacctttgaacaatgtttggtgttaccatgagttcccttcaagcacttcacatgaggcaccattcaaatgacaactccatttaagattatgtgtaatgtgaagtgtttgggggaactcttggtggtactcaacatccatttgtgtcttcaagttggtgatactcaacactgatgtaagtttccaagaacccaacacttgaatcatggtttcaacttccaaattccatatatgcatgtgcttcatgagccctagatatgtttattcatttgttttctatttttgacactaatatatgacaatagctagataggttcgtctctaaggttttttttggtctatgtgcaaaatacaaaagtatgccatatcacctatactacataaaaataaaattatcctaaattttattccactgtgtttatctaaatatttaaaacaaaattaggcattaaaattaaaatgtaaagggtgtatcatatttactgatatatttttaacttctagtaaagaggatcttgtgcctgatgttctttgaaatgagatcttcaattacatcttcatatttaatcttctctcgaacaacatgttcaaatacaattgttgttagtattgtgcatgtgggacttgaacaacttcaattttgaaaagctttgttctacagatgcaacaaaagtatgcatgcaatattggcattaggagaacaatccattcgcttcacgaactttagaatatcatgaggggtccatgtctttgttagagataaagtattagagaaacattaactatatatatgcaagtctttgccgccgacatcagaatattggccactctttaccgtcatctcaagttgagtagaagaagaaaataaacttttgttatctaaagagcacaactcatatgtaaacaaaaaatctaatgattttctcataccccttgatattattcaaatcttatagtcaatgaagtaatagtttgacaaaaaataggtaaaaatattgagggctctaaaaatttggaggtcctgtgtcgtcagaagaattttcgaatgtgggcatgaataggttcggtgatgtggcctagcatgcccacatcaccacatctgcattctagaacttcctataatgtcctccttcaaataatccaagagcaaccccctcccacctcaaaaatggtgatttttgtagttctagaacctccaatctcatcaaaatgaatgggggagcttccggagaaagatgatgggggtggttgagaggatgattttttagccaagaggcacatgctaagggctagtggatctgttaatgatatgttaatggcaacagtcgtactattgtcgtctctatatattatcatattaaccgtggcagactacttaagatagtcacctaggttaactcttttattggagatgattgtcataaagtgtttgacttcgttaatgaactattggaggtggattgttgtctccgggcctttcgacaattaacgaaaacgacacctattgtgtacgccttcgttaatccctaggtagcacctgtaaaattatttaagtagtattgtaaaagacaaataaaaatatatcactattaaaaataaaagcttacttcgtag

SEQ ID NO: 3419 - DNA, 1668 bp, Zea mays
  misc_feature (1)..(100): optimal_loci_349575_G1, chr10:146187975..146189642, Cluster 20
gaaactcctcccctctttttcttcttttcttctggggggaagttttgggacagcaggccatccccccctgaagggcagcgagatgggctctgaaggatggagcagcggagcgggccggacagcgccaacggcctaggtcagtcagttcagaaaagaaggccggactggaccaaattgctcctagtgcaacgtcatcgcccgagcagcatggaggttacctgtcactagcttaatagaccaccttgcctcgccgctgtccaatcagaggcatcaatgacagcgacaggaggaaagtgattatatataactagaaggtgaataattcgtgattgatgggccatgcaaaaaaaaaaacaaaaaaaactattccctcggttccaaattagaaatcgcacagatcatttatttcggttttccaactggtcatttttatggccttgcattgacggaggttactaaataccaattactatgctatagtcgctatatctgatcaggtgctggtaaatgttgcaacttgcaaactagtgaattttatgggtgttttacatatggatttcaggatttgaatatataatcggaggtcgactagctttcattatgttattaattgcaaccgtggatcacaatcaatcaatcagtcacaccaaccggcggccagtccctatacgccgcatgtgcctctcctgtacgattgatggctgctttgcttccctaataaataatgcaagccaagattcgttgaattgcaatcgattttaagttctgaacgagcaacaattcaccaacctttcttaatcttcgtcaccaacaaccactgcttctttttttttttggcgcgaaggaattcaattaaatcgagaaaacagttacatctttacattcaagtctctcaacaataagggaatgtacaactatgagcctttggttcaatttttccagtataagagagaattaagagacaactaatataactctaaactcctaaaacataaatacagtcaagataaaatatgtatagagagtcgtgtagagacggacttttcgcgaaaaggctatctcttgacattttttcatttcggccattcttactggaaatttagtagcactcttttcaacgctgccacatcatcaaaaacacaaggaaactatgaatgaaacaatgtctctcaatgcaatatttcacttcactatttcgtaagctagcatactaattaaatgtttgaactcaatggcaaatagaagttagtaaaatatgtgaagataaaacaaatcactctcagtggaggtttcatacagtttctaagaccttggaaactagttagcatggtttcatcccccataaaactaatttcatcccatgaaactcaatcctattaaatgctatgccatatcatcaaaaaatcttatgtgacacaaacaaccattgtgattagccttagtcccctagagaccccttaaaagacccctcatttatttaggttgtatatgccctaagaaagatacaccataattactcgagagtccctttgtaacctccagtccatttatgattgtctagttttaatatatcaaaactcaacaacgaccaccattggagcatgatcttccaaatcacccacagccataaaccgcaaaccttgtaagggttcggttccatatgaaatt

SEQ ID NO: 3420 - DNA, 1495 bp, Zea mays
  misc_feature (1)..(100): optimal_loci_36329_G1, chr1:219227845..219229339, Cluster 20
gtctgaaatgaacctatgcttcttcggatccaaaatattcctttcattttaactgctttgtattatgggagctattccccttgaaagatagagcctaacggtacgagactaagtactcaccgtctacctccatccccatatctaaaatgtcgccacacaaggtgcttaagataaatttatcaagttcctcctcagccaaatcattctcttctttctctaagacacgtgatagaccgtcctgcttatttccgatttgtggtttcgaacatttatagttaactaaggactccactaatttatgggcattactaatatctaccggacaatcactgattgttttctcttgatcgataaattgattagatgtaacatgtaaggaagcaaaaatatgttcgattcacaatggttaatttccacgcgtaggagtaaagaggaatgcaagtaaaactatatttattattattgaaaatagaaagatgtatagaatgtgaatttaatagaaatgtcgaaattgttgctaaggacaaaggaaaaactcgtaaaatggactaaaaggatatacaaacgcgtatatccatttgagtttcacttttcagcttcgaaaatcaaagcaaatcctaaatgtcagtttaaaacccttgatgcttgcttgtacaaactatgcagttgttaattatctaaatattacatttatattttaaaaaaatcttatgttatattcggacctctagagataatagttagctgctaaaattagttgtagaggttcagaagatctctaaactaatatctaactgattattaattacccacaactaataattatttcattagctggttcaacctagctaataatttgttaattgtctaactattaaccctagggttcgaaacatggccttagttatggttctttctacaaatacctacatgccacgtcgaggagatagtccaaattaaaccaggtatacttgcgttttggtctagggtgtaattaagcggatttatttgtggctagcccgacaaatatgcagatttcacaggttattagtctgcttgcgtccctaatctattcttatcgattggctgtttctctacctattaacctatccttagcgtctagacaaatagatgatttgacaggtcgtctctcaccaccacctgtcaagcgacctacacattgtattgcttgtgaacttttaaatagcttccatatcgaactgataccttttgcaggcacttaacataaagaggtaagaatctcttcaactttcttctctaaatttttcccctatatctcattttcaaccctataactgccactattgtttatgctatcaataatcccttatctatcataatactctagtacattgtctttatcatcaacctatagacaaacccgctagtgttaaattagttcttttacatacttctagttggtacaaaataagatgttttattaaaatataaataaatccgatacataatcaag

SEQ ID NO: 3421 - DNA, 1599 bp, Zea mays
  misc_feature (1)..(100): optimal_loci_3705_G1, chr1:19094032..19095630, Cluster 20
ctaggcattttccttatcttatatatgtagttttcgtacatacatattttatatcataccctcaaatgtcttaattatatatatatatatatatatatatattagttttgcttaatttattgtccaaagtataaaaataggtagaggatagaaaaaatctatatatataatgaagaagtgcgttctatatttatagaaggctttaaaatattgttgaatgctatattggagaaaatattttttatatttgaagtagaggagcctacagagtctggcgttacagaccgacctataatcctcgcgtgcaatagcagccgaaaagccattaagaaagaacagaaaaagaaaatagaaaactattttctcgggacctcaagaagacaagaacagaacaaatgcgttgcgacaatccggtgttctgcccatggtttcatggcatgtgggaaatatttccggtgagcggtttcagttctcccttggactagatctaacgtgtgcacatcaacaattaacaaattgcagagaacattttgttcttattccccagagcattcgtcaggaacagtgtcgagtagttgtctttcatagagtattgacagactaatgtttagtgattgaggcaacttgtcagcaattttcttgggagcactccaatggctgttgtgtgccgtctttctactctctccgagaaacaacagaaacaagtacacgttgttgtggtattttatgtgcagaaaaccgagatgttcggtctcaaacttattttttctgtccatgtgcatgacactttcttcaaaaagtgcagttcatgtgcagcctgatgcaaagcagtagtacagtataccctaggatacaaaaaaatttccctgaaaatctgaaaaaaagtcacaaaaagctttttttttttctcatctgcactagacagacgaggaaagaagagatggctgagcaagattcggtcattcagagcaactttatgcatgcacctatggctttccatttttacgccgattcctaccggactcgacttcggcaaaggccggttttcttcctcgatgtatagccatccctgaatataaaagatggtagttgtatcacatgaaagtaggaattgttttgtgttggcctcagaatataagaatcacatcatatgacagtctaggagcaataactcagcaaaaacccaaagaagtagcatctgtttcatcagtttaatgaattagctcccaaactgtcaccagtttcatctaattttcatcatcagccataaaaactcagttacagattcacagccacagagtcaaagtaacatattacaagtaacagatgttgactaacatattcagagtaacagattgcaccaaaaattacagattcgaagttctctgtttaaatggtcagattcaagaccagggattacagatttagttcgtcagcattacaaatggacaagtcatcatccaacccaacatactcattgtttggtatgcaccaaaaatagttacatgacataggaccaaagatcagtgcacaaataattgaatcagaatgattagattagcatctagattagatgccagttaggtcccaaaccgaatg

SEQ ID NO: 3422 - DNA, 2009 bp, Zea mays
  misc_feature (1)..(100): optimal_loci_3741_G1, chr1:19255581..19257589, Cluster 20
ctatctctgtctgtctggaactgccttcttcttgccacagatcatggacggtactaggcctgtagcggtgacatttgagggcagagcgctgtagctgcagttgcggaaactactgtgggcggccggggggtatatgcatgccacggcaagggggaaaaccatgcaagaggagagagagcgaccaagatgctcagcagatttgccgggagcgtgaacgaacgaacgaaggacgaacacatggagttattagctgtcgcgtaccccggacgcatcggccggttgatgtgccgtcaaggtcgcggggcccgtgtttttctccgcgagtcccgtgtgctggcgtttggcggggacgaacggaggaggagtctttgagaaagaattggagcgaaacgggacgacggcgagcgccgagttggcccacggcaacgggaccttcttcttcctggagcgttcgaagcagggtatcggaaactgagctagcgcgctcaggaacggccgaacatgtcggtgtccagatggattgctgcgctgtctcttgcgcggcgcagttgtcatgcgctgtacgctgctcttccagcgggaagaccgggctggtgacgcgtagagagggggggctgagctgttcgtcgcgcatctgtgtggcactctgctgtgaccgcaatgcaaccagagccagccaaggaccaccaccatgtcggctcagctgctctggtgccgacctggctccagcagccaacaacggctgggcaagttccgaactagtagtcacaaagttggtcgcaacgcgcaagatggtgttctgaatgtacttcgggcgtgacatcttgtcgtccatggagtctacttttcgggacgctccctgcaattctatctccaaccaattcttggaaagtttaagcctcatctagttttatctaaccatcatcattatcatcatcataagacgtaccgtgccaaagtacctttaaggttcaagtttggattaagtcagtcaaacccatttaatttcgttcgccgttacaataaccaacacgaacatttatagcaccaaataagcacaatatttttttaacaatatattaggttggtagtctaacgttttatttgggacacctccagctccattaaattcggtagagcaggtcattaagtgctctaggaaaacgtgaaactggagatgtaagcctttagaaaatatttagataagtccttttatttattatttagattaaaaatatttttgaaactatttaaattgatattataaactacagctccacagtggaaaactgtaacctagagccattctaaacaccggctaagggttatttgctacaagtttttatatatatttaaactcttgtctgaatgcacatatgtccacctcaatccacatgtgtttaaagatgacattctcacaaactttattcaaacaagttgacatggtaatactatatgttgtttttcactgacgattagattgcttaacatctttcctaataaataatatcaaatatatgttttactattgttggttacaagtagtaaaaaaaacaacaaatcatagaaatgtgttagtgcacaataattaaacagttttaataaaatacatttttcttcacagtttcctattatgatagagttaagtctaattgatggaagtttatagatatattttgaccagcttcaaatctttttttttgtttctcatgtaccaatatatttgtagcattttcatactttttaaaaagtctatggaccttatgagcattatagtttttttggtttacgaaccatatgcgatgtttaaactattttaaattaaaattatgaaatagtgtttaaaaccatttatgaagacaagtgtgtcatttagtttctttttagagttaaagagattttttaaaaaaaattaaagctcatgaagggaaactagactatggaaataatctagaaagacaaaatgatggtttgattccttcgttcattatgacattattaggcctgca

SEQ ID NO: 3423 - DNA, 2299 bp, Zea mays
  misc_feature (1)..(100): optimal_loci_38311_G1, chr1:229562916..229565214, Cluster 20
attttcttatctttctgttcctattacaatgatcgttgggaacttatccttctccaggtgtgaaaaatcggtataactaatttcatacagtttgtctttttcttcattgtttcccaatttcacacgtcactaaagaaatagagtgattagggggacttgttggtgaaccgtatgtggtacgcctgtagcttgttgtttatgcttgacatatggagtcaaatgatttatacgttgtcattattctgcaatgttctgtgcaagatattttgttgtgtagccgattctagagtactcccgattctatattgaagaactaaatgtcggacttcgtggcgtcgccaccttctttcttcacgatggtgcgccctggcacaggctgctcatcgcttcgacacccatccgacaactgtggaaattggaagttctaaaaaagagagaaatgtggaatttggaaattgcaatctgcgttttattattgttttcactagataagtacttgtatcatgtgcgctatatgttttagcagaaatacaactttgcctcattattcttgtttttttgccacataatgtttccttcaagagcttaataaaccagtcaatagtatcgtctgttatgttatttatttcttacataaaaactcccccccttcataggtacaatgaagatcgaagtttcataaaatagagccatggaggtatagttgcagagtaattgttggtcaaaagttttccctgttgaaatgaaagataataattatttctaccttcattctcttttcctattattttggagattgcattgtatgcagtgcattcgttattcttttcctgattgttacatgttacaaatattattgatgtacaaatgatgataaaatagtttgatgataaatccctattattattttgatgtgataaaagtataaatgctttcatgtataccagtggttcaagttttacaatgtcgactacacactcatttcgagacgatatgtacaataaaatataggtaggtataatttgtaaaactgtgttgttcgtgttactatatggtattttacttttgcacagataccatcttatcaactacatgttaattgatattgtcagcttccggtgttggtaggtgtgagatcagtaatggagggtgccgttaggaaactaaagatgggaggacaatttgtgcctactcaataagtaatgttgttttgaaacattagttttctacttttcactttgtttacattattaaaactactttttaagttctgcataaagaaatatctgaaggttgtaaatgtctagtgggtttcaagggtgatggagaagaagtcttgaaggtaccattcggaaagtagttagtttacagccttgaatttagcattctcctgaaggggtagaaattcattgtatctttatgtagctctatggtgtggagcaagtggaaagtgctgttttgaatggtggataacctcgtaatttttgggtcttgaatatgttccaaagtacatgccccatattgtaccatcttgaggtatccatttttgctacttttttaatttgatagcatttaataattgtttgtttgaatgttgctattgcgtagtcctttaaatttgttattctatgattgaattcagactttaagtgaactttagaagtttataactatgaccaggctttagttccaagctggctccttggcgctaccttacactaggctaggtaaaggtgaaatcatttgatttcctagagattcggctgctgaagcctgtgcaaaatgaagtgactaaaatatttatttactagagggagcacaaagatgcaatagtaacctccagagctagcaaaataaacaatgctgaaatttggtttaacacttatagaatgttaggtggaagtccatgtagttttgttgtgctcatgagacaatacactatgttggacaatgaatacaagtgaacccactatgttgaaactcaaatgaacctccaaatattctcataaaaagtgcacctactttgtaggaacacagataaattataatagtacaaattcttttctttttcttttggcaacttgaatacatgttcctcattttacgagatactagaatacttagtttgtgttgtgttaacgagagatcatcatactaatgctggttgcaacctgtgaggacaaaaaggtttgaagtaccttgtttcccctataatggattctacctaactcagtagagtgaatctaagttcagcttttgcatattgaactagattagttgcaacctctgtgccaaacta

SEQ ID NO: 3424 - DNA, 2305 bp, Zea mays
  misc_feature (1)..(100): optimal_loci_40351_G1, chr1:240481019..240483323, Cluster 20
acctcaaaacatatcttgcaatcgaggaaaaagatccattgttctcccgtaacagcaattgcgccgctgaactgcttcgggctccacttcacctggtgcgaactgccctttccagtgggaaggttgggctctttgctagatctctgctacatgattctctagctctgagagctgattttctaacagagtgattctgaatgattctctaccggaattgaatttatttgacgaaaactgtctgacaaataggttgtgaagtgatttttgaggggttaaagagtaggtagcagattgggagtgctcggaaactgggttttttttctcccactttctaatacaaagtagatactattcactctactcctaccatgaagcagtttcgatttttatcgtttggcttggtagaagtgattttcgctgtgagggagctctgctaaacggcgctaaaacatacaatagcgggggaaaagcctgtctcggttaaaaacaatgtgtatatgcagagaaactgtcattagtgggtgcattgatcgtaaaaataattccatgggattccggtggtccagtatcgtttattctaccgggctcaaaagaatgtcctatgcaaattgtagaattccaatattgtttttttcttcccctatggcataaagccaacggcaatgccgagaaacaagacgacaaataatgtttttgacggtcctgttttctggtctgccaatgctcgctacgctaggggccacttgggattttgtaagaaacaaggagagattcttttatttaacatgcttgacgcacgtaaatacggacactagaatagctatcgatctatcatttccttcccaatggagagtcgacacgacacgtaaggagccatggccatcgtcgaaagagaaggacgtttggttggaggggcaccaaaccaaagccccccaactgttgaaactggcaactcaattattggtttcgttcgtgctaataggggttactgcatgatattacactgctagggggctctctctccctcgtgcttagctgctgctggccatctgaaagtaggcttcattatcaatgtggggttactgcacgatattacactatttcctgagccacctctagatgagcataccttgtatgtattccatccattctaaaacagtagtaagatgttctgacttttctaaataaattacttttattgttattatgcatatttatttatttatatgtagcataagctataaaaagtcaggtctaatacagtggtgagcggagtcaggccacgggtttgaagtagtctcttggtatttacaaggaagacttaattaattttgtccctttcttagattctactaacataacatgggagcctccggcataagctttgtatctaaaaacaaaacgatcttataatttaaaagggagggaatactatctatgactccttagggcagtgtttcttaccttatgtctgcaactagtagcttattagatgatggtacgtatatgttcaatcaattcatggtcagtcaaggtaaagagaagagaagatgattaccatgaactgttggtacgccaactttgcgctgttgctacttacactgcgtgcctcctcccccgcccccgcaacacatgcccaaacagtcagtggatgacccatacgacatggccttaactctcctttgatctcacgagcaatgatgtcttgaaggggatatgatcactccatgcatgcctctgagtctctgacggcctttctaccatttcggtgtccccaatatgggagtcaccctccttgcgatcaggctttcgtcttttgggggcttcattggtcctgtaatagccaaaacctggcgtcacctgaaattttggctgccatttggtttaccactaaaatttatcgacacctcatgtttgccatgttaaatctgtgctgaatatattttttttgtacatgttaaatctatgctgaatactgcttgtagcataaattttggtagccagacatatatatatatatgcaggttgctacaaatccctcagagcatgcatatgcaggttgtctctccagtaatcaaatctcaacgacttttcctttgacaagttaggttcagggaaacaaacagcagcttttcttttacaaataaagcggctgtacgcgttcaaatggtgcaaaatagtcaccaactttcgctgtccgatcgaagcaaggcttgcgccttgaaggccaccacatcacatgtatgctcgctcacaaaggatcggaggcgcttcacactgcatctgcagctaaacaaagtcatcg

SEQ ID NO: 3425 - DNA, 3381 bp, Zea mays
  misc_feature (1)..(100): optimal_loci_41706_G1, chr1:246678566..246681946, Cluster 20
taatagtcggtatggtagtggcctaactctccatatggtatgtaagccttctatcgttgctcctaactctaatcctcctcgggggcacaactgcaccaacactttctctcactcgtgctctcatccctaaccctagatcccaaatcatctcctttcttgacgatggcaaggtggtgacttatcatcgtcatcatgtacacgcttgtttgaacatctatattctcttgagtcgctttttatcctcctctcactagcttctttgcccttccattcctaagcggtgggtgtagtatgtgttcctcctcccagtgttcctcacatgcgaatctgtgctccgcctacgcatgtgagcttattttctcacatcaatccctcctctcacacaaaccttagtatcattttccctgattttatgtccatatcgtagatcttaacctatttttatttgctcgtgcattataggtgtcaatctttgtatcatgccaatgtcgcatagccattgatgaaccttacttgctgagaggggccgaataattagttgaggtgatggactttaatctagccactgaggaggagtactgactctaggatcatatcgaggatgaggatgcctagggttaattgtcgagaagcaaccggacctaggagataaatcattatacgcatccacttgcatgattcattccgatcattatcacagtggcatttacattcatattcttggtttgcatggtagttgcttgagtatatgtagaggaactcatgttaacttctttttacatccctagttagctctcgagttaaattatgtagttattaatttgtgtgtttgagtaatatcaacatatagacttagcaactagaattgttttaaggggggcttgtttattgtaaaatagaggtggaacaatatatattttcaccgccatattcatcaacctttgcaaaaatatttcgtgatcttgaaagaaagttttataggctatctatccccctttagcaatctagatcctatcatcaacattgcataataacatatctaaacctgcaatataatgaccctgtttgacaaaacttatttttagcttcttcacagatttaagcagaagttgtgtcaaactgacagcttctcaagcagcttatcagttcagctgcttatcagaatgaattaaaagcagccaacaaacagaagctgtttttcaccagcttctcatataagctgcttttctaaccggcagtagcccatactaattaattttatgatgtggagttgatgatgatgtttttttgtgatctccactggacttgtaatctatatggaatatatgatacggacttgtaatattatttaaatatgtgttacggatttatgatggtgttcaaatatgtgctccgaactttgtagcatcgttctagtatttgatttaaaattgcatccttgaaatctgtatctgtttatttatcctctggtgtgtttttgggcgccgaactaatgggtggcatggtcctgtgatcctgtcaaacacgtcgtcgtgctaccagcctagtagcacgataggaaaaatgatcttacgtgggccatgaaaacagcacgatatgttggcacaacatgcaactgttgtcgtgcatatagctgaacgcttttcatgccacgtgctagtcgtcgtgctatatcaaacgggatatctacaagaaaagatagggccaaatgatgtgcctagctactagctccctcgtgcacgacaaccaatattaaattaaaggccctgcatgcgcaatgcaatacgtccgtccgtatactgatatatactccctctattttggtataagtgtacttttaaaatctatttctagagtttaggatatgttctaaaataatatatatctctaaacataagataaaataaaactaactccagttttttttatcgaattgtagtgattatatttttacaggagggcatgtatatataatgtctaactaatattattctttgtactgtttttttaaatcaaaactgatagaagttccttttatatcttgaaaccgaaagagtacgtgtggagactgaaaatggtgtcaggtttgtcgggtcccatgctgcgtcgatcgagtggatttggattgcgagactttctccgccccgatcggatcagagcttccacaccacaagttctcaccgagtcaccgacaaattaaagcagctttcttatatgtgctttgtttgctcctgcgtcgattctaagcaacctaattaacctgttttcgtgtaagaataaagcgatccgtattttttcttaataaaatgtgtacttaaactagccaccaccgcatgcatacgtactgctgacttatctatatgactgtatgtgtcaagcatttcgatcgatgccagggctcaggacacagtggcaggcggcataaaccttctgggagaggagaagattggtcacacattttgactttcaatttatctgtcacgagcccgctgacagctacgggtctgcagtggcaaaacgcatcgctttggtacaccggcgatgacgattgagagtattgacgaagtggtacgttgctgaggacacgggactactttcgtatacaccggacaacggttgtcatctatttgcagctcattcacttgatggcgtacttacgtgtcctatgaggtcaccatgagtgggtgttagatttgtaggaattaatttatatagtctatctattttatttcattttagtctctataaattattaaatacgtacattaaaatggtaatttataaagtaaaatagaataaaacaaagggacagaaaaatagtctcaagaaaccaaacaccttataatactaatggcttcgatgacgaccacaactaaaagacagaattacttctacacaggctattttgtttgggccgtctctacaatgccacatagaataattgatctttataaacatgttcttagacaaagtttgctatctagccaccttttataattaactctaccgagacggttaggtagcaagtcgtctctggtttttgtaacatgtggtatataaccggcctcactcatttcgcctctacctatctcaaatccttacacacaccaccttctcgactccagatcgaaaaaggtttatgtaggcctagagaggtgaataggcttgtctaaaatcaaacttaatgcaacgatgtaaggggtggttagcgactacttctcctaacttatgtcctcaacttgtgccagtgttgtccatatttacttttgaatatgataattctagctctgagtcatggattcgcttacttcatcgtcccatcaaactttcagatgtattctttggactcggcgtttgtgggcctactggttagttcttgaa

SEQ ID NO: 3426 - DNA, 2725 bp, Zea mays
  misc_feature (1)..(100): optimal_loci_42258_G1, chr1:249325922..249328646, Cluster 20
cgtgtatactttaatgttcgacccagacctagggtttcaaaatttagagctaattgaagtatcaaatccaatgagatttttaaagcaagctgttcaggaaatataagttgaggtttcttttctgaattgctgtcatttatccttgcaaacattgcaatgtttctcaacattatcatgtgcattgcttattatcttttgttattatcaagtgtcacgcacaattattttaactgatgggaagaagacgtctacggattacagcaaggagggcgatgggaggaaaagaacaaatgaatcattatttctttatgatgagtggcattggtagataattaactttaaactccacatttatatatgaaaacaagttttgtgaagtatctcttttattgctctaccaaaatagcgaagttcactccaactccacgttatttttgtggagcagagttgctgaagtttaaattgtttgacaagcaaaacgtggagcggaacagcaaaaataaagtgggggcagttccaaacaccccctaatactctcctatgttaccatgttaaatgtcaagctataaaggatgaaaggagaaagctaaaaacggatgtgcagtcaaagcttctcatgaaattaaactactaagtcatagcaatttattaaaaaacaatagatgtattttattattaaaaaaagttaagttacatgtaccaaccagttcaatctgaaagctcttacttcgatgctctcttaggcacctcagatgtggaataaaaacgagcaataattatttttaattaattgtgctaaccaggatttaaatttgagattctgaattgatgtcatattaagttgtatgcaccaacaggttcaaccaaataacttagactgatggagaccggtggagaattcacttgtattttcacgaagaaaattttattggtagaattttctctttattatatatattaatatatgatgaattataacttgaaatctagtatattggtagagtaaataataaagtacatctatattttttaaaaatatgatttttggtagtttgattttaaggtgattgcacaagaagattgatattacaacattttttcctagcataagtaccacttgttctaggtggtgctggcagcctagtgccaaccatttgttggtgataagattaagatagtattagataccaatttttagtaggtcatgtacttgtattcagtactcatggtcggacctatatataaattcatttctatattttaactcccagtgaagtatcttaaggagtgttagacatcaaggtgctcctagccagttaaaaaaaatcaactcctagtgaagtatcttcaggagtgtagacatcaagggtgctgccatacaatccaagttttcattaagtgaatgcaagtaatattatcacatgcaacatacactgaatgtcaagcaaatagatgtagcctacttctatgctactatggtattgtagatgtgtatgacaattagaaggtattcacacagatagccttcgaagatattcatcaaactcaaacatttttaatcagtttaagtttatatgattagatctatacaatatgttcttcttcttattcttttctatgaacaaaccatcttctactggattcacaggaagaacacatagcacaaccttagtcaactcgtgactcgtcaactaagaggaagaacaagagataatgcttcttgataaatctatctacaactgtttatagaatgatggggaacaatctctacaactagcggaatcatagaaagaacatgtaccacaactatagctaactctgtggattcactggatgaactagcgacattgcttcttcaaaactctacatctacggctacccacgggattacgaggacgaaacataccttgcagggtcttttgccggaccttccttctagactgtcgatgctgctaccgttgactgattttgtcgagtcttgcttcaaatctgatggggcgtgtctttcttacacgaacgcctcccctttaaactccctagacgacgcttcgaagccggcacgatagacacaactcatttcaccttctatagtttagtaccttctccctcaccgttcttgaactcacgagcaagaaaaaacaagagagagaactttatcttgtctaacccaacaacacctaatcgccattcacactcacctaatctatgggtttgaatcgtgtttaagtaaccatctcatttaagcaatgtctatctattgatatatagaaattgtaccgatggtgcacgtgcaactaaccattactttataaactatcaaacttttcaactatttatattacaatttttgaatattttgaacttattttccaaatctaagacttattttatttatgttttaaacgtaatcttcaaatttaaaaaatatcgtgtaattaaatgttactgaattgtcaaatggtttgatcaaatgtatatgaaaattttagatggcatatcctatagtgaagttctagatctatcactccaagagatgttacgtcaaatttgtggtgacgtgaaagaaagagaaatgaggagaggagagtgaattattcactagtagccatctagagatagggtgctcacagactcaagagattttgtgagagaaagatgtggactaaatatacagcttatatcatgaaagagttattatataactaggttcttagttagctatatg

SEQ ID NO: 3427 - DNA, 1650 bp, Zea mays
  misc_feature (1)..(100): optimal_loci_42928_G1, chr1:253112190..253113839, Cluster 20
tggaacatcatatatatatttgcatgcgttatggatatgtcaagttccaaatttttgtgaatgttcaaaatacatttttaattactttacatgattccacctattaggttttctccaccatatatttggctggtttaagggctcctcatcccgtcccttcaatctgtgttggagatgcaccatcatgatggatcctactgatctttatttactctttagtagtttttgttgaggtggttggataatgtagtataaagcattttggtgggcaatctctttcttctcttcctctttccccaagtgatggtagacacgaccatgtatacgatacgccctccgccatcgacaatgttaaacggtgattgggatgagtccaggttctacctttagtgtggacatatagtttataatataaatttaaatagttttaaaaatatttttaatctaaataataaacaaaatgatttatcaaactgtcttttaaaggtttacagctctatctccacgattttctagagcagctaatgatctactctaccaaattctctggagttagaactatcccaaacagtacagattctgaacaaagttcttttgtgagtaaaattacgggattgatattttgttggggaaggttcaaatttagtaacactaaaaaggacttggttgggagcaaggatattggagagaattagagaggctaaaatcttcttgctatttaatttggatagcaagaaaattttagtccatccaatctctttaggtattttttctccaaacaacccataaaacatatactacctctcccacctacccggccacccaaaaaaatgatgatttgtcgttaggacccaaatttatcccacaaacgctcaatggaactaggtttgatctatgtcaacttgatattatggtttgtatgctcatttttttaattagcggcttattttctagttatcttggatcacatttaataaatagggatacatggatggttttaattgctcactgatacatacatattaattaataaaaatcttagaacatcaagtgttgtaagtgaatactagcatattaggctatctccatcagcttactcatcctcgtacccgtattcaaactctagtctacaaataatacaatctactacaaaacagtgttttaaacaactatacgaggcggccctcaatacattaattgttcgttatatatgatcatggcacccaacgcacgtaggatgcatcttgtagtgatgagagtaatcgtcaaaattcaataaaacttccctttttatcgaaaaacacatatatgctgcgcctgcgagcaacagttggagagacgacgttagtgctatgctgattccttgctgaggcaacaaaaatcaatggtggtgcagtggtctgtgcggtgagccgtcacagttaacttcaaatcttcgattcgatagcacgttgggcccgtccctttgaccatgcatccatcctccattcatctttgatggtgggccatcgatccgtcccacatatagatcatgccatgttgtagcacgcagcctgtcgagcgagtgcaaatgatgaggtacgtgatctagggttagacaagataaagtttttttctctttgtctgaaacacggcctatttaataatgtc

SEQ ID NO: 3428 - DNA, 2963 bp, Zea mays
  misc_feature (1)..(100): optimal_loci_43577_G1, chr1:256469704..256472666, Cluster 20
gtatcttttcttgcgtgcgtgtcctgcacatagacttccaggatgcggatctggatcggaagctgctggttcgtcgacatgcggcttaaaccaatgccacgattagcgcgtgtttagaggcttcttctaatctaatcgtgtgtgcgagggcaacgtttgtttactcgagtcgtgatacggttggtgttggtagggtttgggcgtgatggcacccgttggcgacggagtcacagaggtcatcttctttctgatggcgatcctcaggttttatcctcacaagggaaggtcttggttggtggtggccggccactgtcggcgtctcggattgcacatcaaccaagtttgcatcatggagatatatgccatgctagtttaccaagtttatcctctacttttcattttttaaagtagacatcatcgcagaatacaatgtagcatgcatgtagaggataaacttttgattttaaaagtagacgttgatgatagaaaataatactactaataatagatgatgacattgagagtgtaaatgactaaatgtgcatcggtgccggtagaaccaatgggttggagattataatttttttgtcccttatataatgctgtttttgttgactgcctaacctaactaaagccgctagctagcgtagcgtctaatcacccattcccatttgcattcagagaacctagaggccgggcagagagaaccggccggtacctcttcgtgcgtgacagatggcaccaatgctctccatggtgtcaaaaggccaaaaggagacaacagcagagcctacgggggatggtcgaggtccacttgtgctttagcttgtactagtgagctaataaaaataaaaaaaaagcaactgaaaccacgtagcgacgatgcaaaatataaaatagaaacttcttgtgccgtccaaacacaaacagaaacggacgtgaaatacgacacatatgcttagcacatactagtagtagtacagtacagacagtagacgcgagaagaagaagaaaaaaaaatcgagcaaccagtcgattttgccaggcgagcaaccagaaacgtcccgcactgaattcaaagggcctgaaagcaacatctgccgcctcttgttgtctcatcaggaaggcgtcactgttacgtcacagcggcggaagaataatctcgttattacaacttgtataggggagtattttgtcgctccaccaaacaaagtagtacgacaccaattgcccatttggcattttttttggagggctcatgtttgatggatagaaaatgcctcaaaaccataataaacattccaatcgtctttgctcgactaactatttagtttagctacgaaactcaatcgagaagctagcttggcttaaaaagaaactcgtgtttgcacactgaattgttggacatgttcttttattttctagttttttttttgtatctattgctggtgctagatttataattatatacatcttatatataattgttcctagcgtgtactatgtgtgttatttatttaaaccatcaatttctactatattaaatctagagactagctaagagagaatctgtctataaataaagtatcaaatctgctggttagattaactaagttatctggagggacggttatagcttcaatagtatatatgtcttccggttggctacatagcgcgcgcccatacaccaaatcagtgggacacatacacgcaccatgattgcaaaactaattaagaaaaggaaggctatgagagggagataaactaaaaggcaacacaggaaaaaaaacgtggggataagatatcgatacaaagaaagattggtgaggtgcggtcattgttgaagccctaagccaagagaggccgttctaggtccaccaactggttgttatatggagatggagaccatccatccatccatttatctacctatccaccgtctgccgtctccgtatctagcctggctgccccatccatccatccatccgtgctgctaaccaaaacgcccactcccaacctcaatgtgtgcgtcgctagcctcgtgcgtacgtggcttggatttcatttcaagagctgtttattttctctgtctggatcaaatttaaaatcaatcatccatgcgcggtttagatcaagagcgttatcatcgtccgtaactgtaaagcgcccaacttgttcatcttatagttgtcagtttaatcgccagacacgtcggggtgctccgggctaaactttacttttgatggattatgatcttaattaacctgtgacctttttgtttcgatagaaacatatgctagccacgagtcggcaacgaaagaaaaaaaaaagttttgccattgtggttagctagctagctctgtagcttgttgttgtgtaaaggagcgatggtgtgacttttacctgaacttcgatggctttacttcttcggaccctaaaaagctaacgctgtggaaattcttgtctaggcattttgacggaaaagaaacctttttttccctcataatcttgtcaaggaatcttatgatattctcttgagagaacaaaaaactggaccagcattattaccttttaggttggcggttggacgcatgatgtgtctatttgcttccataactcgcaaataaaaaaaggcattcaaattaattaaagtcaactacttattaattaaagttaatttaacttcggttgagaactgtttgtctacagcaggtgatggtacgcgtcttcgctgaattgttagccgaacattgtcggggaaaaaactggaacatttggttttaatttactccaaaaacattaccatgacgacaaatgtgcccagaaaacgaacagatatctaaaggcatgtttgattatatacttgaggtgccaaaaaattgtcacatattttatgtcatacttgtataagacacctatttatgattagacgttcaaattctacatcataatttatcacgtct

SEQ ID NO: 3429 - DNA, 2078 bp, Zea mays
  misc_feature (1)..(100): optimal_loci_44137_G1, chr1:259300048..259302125, Cluster 20
ttaaaaatatgtcctttaatttgtctctatgaaagtttccgcatttgacagcacgaccctttttatagataaaaaacgcatttcttttgtcatattaaacagctatttaatttaataatatctggacaggtcaacagtgggtgcttgtttgttttatttttgcatacatgtaattgtttagtatatggtgaaagtgctaagacattgctagtgccaccaacgtttggtattcagcgagatggtgaagatttgaaatggtgagaaatatatttttttctaatcttctcccattggtgcatttacaaggtaaagttattggaccatctttcacttcatggttatcatctgtccatctggacttaacctatttctcttgtcactgttagctgtactgtctcggctgtcttgtggaaatatatcagcttacaaaaaatgattatatgctctggcatgctcttagtcaagaaatgtttctctttctgagaccatgtttaacagacctgtaacaaataactttgttggattggtccacatgcatgtaaccgaagaagctgcaattcagagattattcagtctttcgacatgcagtacttcaatcagaaaacaaaatggtgctagaaattttctgcaaatattcttaaaactcatatatttacctatttaccatgtctggatggggtaaacattcgtagggtagcaacctgcctaactacttatttacacagatgactcaagaagttaatggaccatatcatgaaacaaaaacttgatctagagaacgaaaagtgacaactgcctaatcttagtgtgcttaccctgcatgactgaaaagacgcaaaggtctatgagaattaggccatgtttgaacacactagagctaataggtatccaaacattcccctgaggtatcatctccatgactgaacagacactactaaggtattgctaaaggcccccagtgtgacttcaacaatagagaattcagttcacagttgaataaacaaccgatcaccagcgcacgctgcaaactgagacaatcgagctgtctgacactcttacatattgacaatttacttatataccgagtcggtcagcggtaccgtttcttccttttccatgcatgtttcgcaatcgctagctggccattttcagagtaagagcatcatgaaacggatcagggggggattccgtatacttgtacttgctcaacgctgacattgctatggctttcagcagctcagatgttaagccattggttgcaacttgctcctcctgatcagttgcagcttggccctgctccgtacaggaaggattcttagcctgagccctacagctataagcccgggagagagctgtgcttgaaaggagatgtataaaggtcagttgtttatatcaggtcagtttaatctacatcctgagactgagagctgtattcatcactagatcgaagacttactaacccaaatctgacaaatggagcgactccattcagggcctggagtgctgaatgttttctgaaaacgacagtccactgagccacactcaagcgtcgagacagtcatgtcatgtccaagcaaatcgttcagctacgagcctacgagtacgagacagttacaccacgcccaagcataaacgaccatgcgctagctgcttgttccgtgctggtagctctggtcctgttgactgggctctgatcctgcgaccttcaggctttcggctgtctgctgcgcgggtttcgggagtcctgaaatgcacgcacgctccaaatgtcacgctcgattcggcgagaagactctgtccactatacaaggagggtgccacgggcccacggcacgtgagagcactgcattgttcatgggaaatggcaccgatggcaagggacatatatatacctctattcgttctatgttcgtcctataattcagcatgttttcaaactcttccaaagtttgtgcaaagcgcaaaggtacctttagaggctgtttggtttgctacataaggcacaccacaagtctagtttttattctacgaaagttttgcatcatatattgcaatcctattctagcatgtaaattcta

SEQ ID NO: 3430 - DNA, 1696 bp, Zea mays
  misc_feature (1)..(100): optimal_loci_54353_G1, chr2:13704033..13705728, Cluster 20
gagttgatttattttgatacagagggtgggatggagtacgtagttcacaaacacgatggacgcagatctataataattttgttttcccatctcacagctttttgagcatctctagcattagggtttccttccgttttacctttggcgatctgaagtgcatgcaccgtggggctgcatggtcggacccactagcagagggactggcgccattgcgtgggtctcacttcgtcctcaagttctcagcactaccaagcgcaacccattctcgagaaaggcgagctcctgacatgcacgaccatggctgacaacctcgtcgagtcaccgactcaccgcctaggcttggaggtttatcctctatttcggtttggaggtttgtccctccttagtgagcagtcaactatgttgttagttttgtaaaatcttagtcctaacctcggtagaggtgaaagttggattttgttttcgttatctaaaaaaatatacacggtctgctgtcgacagccttagagtgactcacaagtcccctctctatagtgactcattagccgtccttacaatatctggcggtggtagcattttatcctaaaatctttcctaaggataccattttttaaaaaaaatacttaccttttttatggtacaaattctgtgatcgatctataggtgtttctcttcctgatttggctagccttactatgcaattagattaataacaaaaacactgttgtaagaaactgtagaattaagaagggcgatagatatgcatacataccataatcgtatatatagcatgctgatcatggaataatcatatagtattgagatactattgttagtgtgttatttagagttagtaagtttcagttgagtatagatttttaatactgcttatatcatatataacactaaccatgcatggctgtcgtacgatctgtacttattgttataaagttgcatgattgcttgtcatattttagttacataaacaataatagtgaaactaacgcaacttggtagagaacataaactatattgctgcctattttgtttaatgaaaagttcaacgtacgtacatccaagtctcaccatgtagttgaaaaataaaactattgcgttgatttgtcgcgaagaacgaatctcaccaaatgatctagaaggagaagcattaaaaaagatgtgtaactttgggcaaactatctttgttggatgctaaactcatgttaattggcgtcgtgaaaagatagtaaaaagtagttagcttccaacaaagcgttttcagctcatcatacgtggtgattaatgaaagtactactggggtgcgctggttacagttacgatttgataagatattgcatataaaaataagttatggtgaggatgatgtgggtcatccccatttgacctgacatagtttattaatagtaaactacatacaatcaaaatttaagttcttgtctaaaattatgctagaaagaacaattggacaattaaaaaaacaccaatcagttcataaaattgaaatttatatgttgatagaacgacacaaaagtctcatgtatacgcctgtgtacatgccggattgccggacgtgcagtgtattgttgtctccataagaatctaccgtgtttggcacaattttttcagcttctttacaaatttaagcagaagttctgccaaacaagcttctgcagcaact

SEQ ID NO: 3431 - DNA, 1609 bp, Zea mays
  misc_feature (1)..(100): optimal_loci_54858_G1, chr2:16633926..16635534, Cluster 20
gatcccgtgttgtataaaagatgaagggggaaaaaagatgaagaagcgacgcggcgcgggtggtgagctgtaatcaaggatccagggtgcaagtgcaaaccagacggcatgaaaaccggacccgtatacgtgcgtgactagtgccatcacgctgatgagctggttgaacgcgacgatattccctcatgcacttaactacgtcgccagtaaaggctgcgaatgttttctctactactactacagtactactagcaccttcgacatgcatgattcagacgagacgtggacgcccgcatgcatccagctgtgaggatatgcatggacgtcgcaactcgatcggaggtcgacgacgtggactagaagcaaaattaattccatacaaatatggacgaaagcagggacagggatttgtacgtccatgccggcaagtggtcttacaatatacaagcctaataatttgagtgcccgcatcatatgtcccaatgttctatggtagaaattatattgttgaaggatgcgtacagtgcagcctacgagagtaaattgtcgttagcttggaaactaaacgcaagtttctcaaattcacttcacaaaactactgtttaggttttttttccctcccgtattatacctaaaattctcaaaaatcataaagtcaccataaaactctcaacgtcaaagcaaggctacgccgcctggtgtgcgaaagaatgaggctatcagatttttgaaataatttcatgaaagtgcaaacactcatattaaatacgtacacttaagctctaaccgctagagctaaagttaatatttagtcggttacaaaaatcgttggcttggttaaatcagctaatgaacttatgtgtcgtttgatttacgaaatggaacgtaaatggtaactataatggttcacactcgattatcagcgctaacaagtttgaatagaacaatattattttagtgtaatattttttttacggttagacttagccaaatatgatgtaacattatcggttatcgttaacgctacaaatatatgaaccaaacaacactttattgttgggtatgagttggataacaattagctaaggtactagctagaggtgtttaaaacatgtatatctaattttagtagctaattattagctttgtaggttcggaccttaaactaggatggatatcttgcgctgcaaaaaatctaatcaactaaggtacatgtagtcaagtagttacttgtgtatagatgttgaaaatcgtatatgcaagatgataatgttcaacctgtttttttttaataaactagaccatctctctgagacttaacacatgaaattgacaaacaacatgatagagcttgacaaaatttaggaggttctgaattaaaccactacaacgatataatattactaaattacttacgatagatagatataatagtttgcatgtttgaaattttaggataggtttgagtgaggctccatatgttgaaaaaagcggtatccatccctgcagcaccccactaccgtttggaaacacaatgctttgtcactgcatgtaatgccaaaaaattgtggtgcaataacttaccacaacatctctagcggtttcttta

SEQ ID NO: 3432 - DNA, 2807 bp, Zea mays
  misc_feature (1)..(100): optimal_loci_54868_G1, chr2:16682028..16684834, Cluster 20
cgcgtggatgagaggaggccaagagtctgttggtgtgggaacgaagcgaatgggtgtgtgaaacgaggagataactacggtggcatcgaggtgtagaccatgaacgacatataattttggacaaataaaatgagctaaaacgccagttaaaaacttggacggagggagtacacactatcggttgccttcatgccttgtccactgccagccagccagccagggcaaggtcgtgcggggatgatgaggaaacgcagcttttgcaacgacacaggtaccactagtagctttctgccaggggcatcgggcggtgcgctgatgttccaacgaccgctacaaaggctgccgataggacaaggagtccaggacgcagtgcagactagcggtgtgggtatgattggaggcacgatattagatccatatgagttttttacttattgcttctatatggccttaactacactatgtaatccatgtgtcaattggtttgttttggttttttgagttgaattccctatccctcactattttgattcagtttttgggctcgaatctttgcttaccaagttggagaaggggtttgaggaggttaaaattgtgttgtgaaactgttctgggatcattgccacctctggtatggtctgattcaagtcatggacaagtctctatccgagttatactatttgaaaaaaccctaattcgagtttgagttatgtgatgtgattctcaagtattgatcttttggagttcaaacttttcgaaccatataatcttctctcaatctcactacatacaaagtttaatctcaatcagaacaagtttgctcaagtggcaccgcatgcacgacactaccgcgctctgacattgacggccagaggagcggcactgccgctttgcctagtaagattatcctttggttctttcttggatcttcaatgttaaattgagtttcgtttgttttggtagcttcatattcatctcaagaacttgttaaagacatccaaccatctattggttgaggtatccttagttttaaacctttgggaggggggtaaatttgagaatcaaatcaagattgccttagtgcaaagaattgtattggctcctatatatctctactctggtcatctattctatccttcacaagtatttgtctagttccttagctctcgtatatattaaaatttgagatgatcttgcttcttatattatgattctatagttttttcatgtagtattgtttgattcttatcttgtagttccttgttatgagtctatcaccacttttaaattctacgtaatcactagttaccttaatagacaaacttatacaatgtgtttcttttagatgtatcgtacaaatcagtaatttcttattttgtatacataataaaagaaaatttatgagttgtatgccaatcattagcatataatgatgtcaaccttatcacataaactttagtttattaggtggtggtttggcaaaacaacaacatctttctgccacctcattatctcatctccacatttttcaaaattcttgcatgactttgtattagactagctatcgcaatgggggcataatatgttcacaaacgagtttctcaccagttgtggtctcaaccgattttggtcatggaactgatattggttagaatttcaattttcttggtattgttttgtcattgcaagtgttctgatatactcgatggtattattgagttcgtattgttttgccattgcaagtgttttggtatactccatggtatcatcgaatcatagtgaatctaatgaagttttaaaatatattactatctattttccaatataaatatttgttcgtctatttttttttgttattcactagacgttgtctaaagctacgactaaagtattgttcttcacaatcaatgctcatcaaccattaatgctgtcacttgatatttgacaacttcaatgatattatcaaagagcacaagaaatctttttttactatttttagtacatatttctttgctttagggccaatatttctagaattatttcttggcatcatttaattcatatgcaattgagttgtcatctataaaagctttaatttacactaatctatatttcctttatttatatctatattagattatattttctggtcatattgaatatgaactaaattgggttatttattaattgtatttgatatggatacattatttattcttaactaatgcaacgatgatatttttatttcttattagtattgtaatttttagacttgtatttgatatgttctttttattcatggtcgacagatcatcatgttcaacggcgcacatttctatattttcccaattagccacataatttctagaccttataatttgatacactatttattcttggtgttatatttatcatcataagatctaactatgcatattttattttttacttaatcgtgtaatttcaggccttgtattttattatattatcataaatttaattatacatattctttattttttattttttgtaatttctaggtgttatatttgacataggtagcctatttattctcggttaaatcaccataaaaatctgaggacacattttccccttttttatttaatctcttgattttagaatcctgtattttacatcaatacttttttgttagattcatactgagagtagaaaaaatataaactgatcaacaatcaatgcagatgaaaaaaggctaaaggtggaaaatcgcaactgactaaaaatgcataacaacacggatggagaaaaaaaactaatcaactaat

SEQ ID NO: 3433 - DNA, 1674 bp, Zea mays
  misc_feature (1)..(100): optimal_loci_55765_G1, chr2:21404339..21406012, Cluster 20
ctatttttttttaaaacagttttttagaaactggatgcttctaaataagctcttagttgtttagaaagtgtggaaacgactaaaggagaaagttaggaatattaataaagaaatatctaaggatatgtggagataatttcccaacaacttagcgtataagcttagatttggtgtgaatacaggtagtatttagaagtagagtgcgaaagcactccaaatttcccaatatgggaggttgcatgcacaacacagtcccaaaagttgtattaacgagtttgccaaaaaaacacacacacacaaggtaattctcgtgctactattctcttggcgattttgttagtacagtgttgaatttggcaacggttaacatattgttagaattcctggtgacatccaacaatttacacccaagacaagcaactctacgcttatccaaatccatctaacaacagtcatacaaattacaagtctgaccacatgaattgtgtctcgtcaaacaacctactacccgtttcaacaaggcattaaattccgctagattccaaagattggctcacacacgaatttgagctcgttgacgcatgaatttgagatttttttattcttcttttcttgagagagattattttcctcatgcttctcttctaaaaagtaaagtttaatgaagaaaatcaagggtggaaagtattaaggcacccactcaacgatagccacgcctctaccactagctaggaagagcagaacagcgctgtcaacaggaattaggaggttccatgtgctgacgtatttttacacccaaaacaggctgctatattcaaatcagcgatgacacggccgagacaaacgctgcgtcagaaattaggcgatttatttacatgccaaggaaattaggcatcgtcaaggcaaggtagccatattttactctggtccaaccaaagggtcggtgtttcttctgggttaacatggtgtccacactagttgacgcgagccagcccaaccttagcttgctagttataccaaacaaagctgttccaaaacaaagttaattcatagatgctggataatttttatgtatataaattcgattcgatcttcttgggcgacaaaaaaaacaacagtttttttaggaaagaaaatgatatcccactgccctccgtcccgaaatactttactgattttttttggaacaagctagtgctatgaagaagctaaccatgaactaccactgtttattgaatgtgatcaaatctaattactaggaataaatcactaattaaaaaatgcatggatacatgcagcctgcaaccacatgcggtgctaaattatagacggtaggtgggatgttgattcgggcccaacctatgtcaaagatttgaaacattaagttttctagaatatttttaaaacctcgaaacattaagtttttggttgcaatactgcaatgcaagctcttatctcaaatggactaactttcaatatcaagccatgtttgtgtccaccggagattgtgaaaatcatattgcaaactgtggatcatgaaaagcttggattgtaacaaactagactttagactttaagaagctggtgtttttaggatggtgaaatctttgtcatctattgtgcaatgtccatagtaacccaagtttgtatgtacttatttttattatgttgttt

SEQ ID NO: 3434 - DNA, 1797 bp, Zea mays
  misc_feature (1)..(100): optimal_loci_55860_G1, chr2:21815629..21817425, Cluster 20
gcgtattgctaaacctccaacaatagaaacgaatatttcattgttaaggtttccaaaatacatcatgtatttcgcagagagctctgctcctcctgttttttaaccagcgcccaaatcctggtatagtgtgttccctagtataaagtcaagggtaaaaacattataaactcacatatctaatatgatgatgacaaattagctctctctttcttctttggttgtagtgagaaatctagtttagtaggtctttgtttcacttatatatatcctgacaactataggtcaggatgaagcttagaagtaaaaggtctacaagtctgaagcctctaaagttgtccgaaggccaaaattaaagctatttttatgttgatctacccctaccttttatggctcaaggaaggatagagtgatgcacgacttctaggcagtggaccctgctcagtagaagtccaactacccctatctttttgtgcacgtggagctgtacgtgatgacttgtcttgaatatgccacgttgttgagattaccatgctatgatccggataacaccagatgcttcctaaaaagctgattgttcgcacaaccgatcaagtatcgcagatgcatagggtggttctaaaggttagctctcctaacactatgttggtgtattggattatgacatgaagattcagactgagacgtaacttaatcgagaagtaagaaaggttgtgttattgtattatgtatcatgatcgttctactagagctagatctaatagtacgagctaggtgctgtgagattaaaagatggacagttcagtttaatgtacacccattaattcattgttacgtgtccattatacctcattcattaacttgatcaagtggaaaaaatagctcatctacatagcacggtcatagacaaagttacagtatgttacaatggacctgatcacctgaacaaccgggggctatgtcagcactcagcagctttatagggccctcgcatctgacgccatagagaggttataagagatccggaacgtcttcaaagcccataggtcctgatgtacgttctaatggtcacgtcgtcctagacgttccgaaaatcacgagacctcccaaacacatttaacatatatctagattaatttattgtaattaaataaaacataaacaatggtcatgtcaaatctaacatcctatctcccatatataagcacacaagcaaaaaacgcacccactgtattagtatatttttgtttcgccgacatgttttttctttgtcatcggtttgcctctcctaacggaacggtacggatacagacgtgcaaacggataagcctttgtttttgttatccggggcttccaatatctgatctgatctgatgaacaacgtttttttttcttcctgaacctggtccctggttaggtgacgaacaagtatcatagcaccaagaagcagcacgcagcatcccggtggaggtttcctattgcaccagcccgatcgtgccatccaatccaacccggacacatgaggtttcctattgaaccgtcggtaccgagacgtacgattccgattctggttgcgcatacgaagttcacacacggggttggtatatgtattctaactggagaccttaaaatttgatttatgcacagacgccgtgatgattattttcctcttttttttttgatttctctgccgctgtcgcggtctttaccagttccacagtagtaggtggtatcgtccttcctagcgctaagctataccatacgatacgactgcatttctacggcatcattgggccatgc

SEQ ID NO: 3435 - DNA, 2049 bp, Zea mays
  misc_feature (1)..(100): optimal_loci_5607_G1, chr1:28613065..28615113, Cluster 20
aatcagctaattgttagtccgaaggctggtaaactgtttgctcattagccatttgactttactaatagatgttaatagatcgtataaagataaagagacatctaaccaagtctccaaacataccctgactattttttatttgctaattattagccactcgtaaataataagcaaggagaattcaaacatggccttaccatacccttgtcaccttctaatctagtatattaagtttctgccgttatgtacgtatagtaaataatataattaacatggtattggaataatctctaatcaacgtacaactattctagttagtgaacaataatatgatactgcctatgtcctaaaatagttctttattattataacccacttttttccatccatatttattcaaatgataaataagagtaaatcattatatggtggccaatggacgatggacgacgcatctttgggggtagtggatgacactgcacgaagaagaaactattaaagctatatggtgaaccatttttttttaaaaaaaaggaataagagtaaatcattagaaacagttgaaggaaaaaacaacaaattagctcctttttcttttttaggagctagaacaatcattgattagagatgctcaaaaaataaataccgttaatgggagttagagtgatctagattatttaaaaaaacttttgagagaactgttagggccgtcctatgagatcaattttttttccagcggtcctataaaaaaagtttgtcactatgtcatgtactagcactttcaagaaaacgaactatccgattaggctgattcgccacgaaggtagtggacctgtgcaaattcgataagacgcccggatgttatgaaattgtacattggtgatttggcttactcgccacgaaaaaagtggcatttgatcgatcttggatccctctatccttcacgaaacgaaacgatctcgaaggacgatgctttgtactgttattattggacctcttgacgagccagcctttcctgaggtcttccacccgaaattctaaggatatataaatatataatatagaaaaaaaccaaaaaaaaatatagtttatttgctcccgatgctaaaatactgtccacccgcgctgcaaagcaaccgatccacagtcatctcttatcagcaatgcctatccttttttttttgtaattcactgtccttgtcagctcccattttccactcccagcgccagcggacaaaaccccatgacgcacgcattgagctgttcgtgataagaataaaagatacacgcccgcccctatccctatccatcccggttatttatttacttatttatttattttattgacaccccacctgtcgccgtctcgctcagccttttttcccggaggaatataaaactgataccttggcaagcaaccgaccgtgacacctgagccggaggcgaggtaaataacacgtgatggagcaacgagataatacgcccgcccccgcacgcacgcacgcgacaacgctactccgtgcgttcctgccgccttcggcttgccggccttgcgaccttcctcgtgtccgcgcggcgagaccaactgggtactgcacggccgtttgcgccagtgcccatggatagtggagactggagctggagtcactgcttgctcctgtggccactcctttgtacagtcggaggcgacgaaattaaaaaccctagccacctcatttctagagggaggtagaaaaacgaattcttgctggagcgcaccaataaggagctagagctggagttgtttagcaaaccgagatgttttccagaacgctagctagtactcgtatttacaactgcatgcagtacttcctaatcaccccgatggggtgttcattttcagggttaacgactcatcaggcaacgaccaggccgtcacccatggcgtttagctaagcgaaacgtcactaccatttgtgccattagattatttgagtccattcataattttggaggttacttgaattctcagcagcagccgcctgcagcaaaggcaaaggagatccagca

SEQ ID NO: 3436 - DNA, 1863 bp, Zea mays
  misc_feature (1)..(100): optimal_loci_57771_G1, chr2:32502797..32504659, Cluster 20
cccaaacaaaattcaggttccagttatttctggcttaggttcgggttttttttagccggctgcagccagcgtatctgaaaccctgcgagggcgaggcatcgagatatggcccgtgattccattcccctcaccacttggtccgctttgttttgttgtcacgatcctctttggacagctagagatgctctcgccgccccgggtatgcaggtccgtctgtccgtttgttcttgttccgtttcttcatccttgtatcacgagtttgttcttgttcggctgcagatgtgaataaacgacgctaaaaaaaaggcagaaagaagtgagtgatacaaggatctatactaagtctgtggcagtaaattgcgtcacgggggttaggtggagcttcgacgggattagcgagaacgccaaggaaccctaattatctgccaattctactgtaccactagcttgctttgagatgtgagaatatctacccggtccgctcgccagccaaacgaacaggtgacacccacgcttggggtgtggtccaccctgtttctgtccgcttgagaacaagttggtcaattattttcgttcccggatcgcccaggtgcacacgcaattcctatttttcatctgtactagcggcacgaaagatcgggcgtgtgctgctgtccctcactggtacgtgatttttttatcccagataatgtgacgtccagtcagctcggttgtctcgttcgggaaaaaataacaatagctgatttttaagagcgggcatcatgagttggcctggcccgagctatgttccttgactattattgactattgtattcgtactaaacacgagtagcacgctgcatgtattctagtggagagaaaatacagcctcatgccaagtacgagccaattaaacaaaatgtcagatctctctataaggctacttctcgaagtatatatacacgatattctttgtgcataatgtgtcttgagtcttgactgtatttattatttaagagttaagggttgtattatacaatttttagttgtctcttatatttatgaaaccgatccaaatggtcagggttgtacatgcccctcgtatctgatattctcggctgatcctagctagcagaaattattcttatcaaccgttagttaattgtttatatccttccacaatataatgatacacacacatattcatatacatttaaaaaacacatttataatcaatacattataagtatcaattcacatatcacacaaataaatccatatcatatttataaatctgtaagaaaccttcaagtctaaaacgtttgaaacaacataataagtatcaatattcatatatatccaatcaatcttagctcgaatccatcatatgaatagagttctcgtttctactctggttaacaaataagttagactcctcggcgtcttcgtatagtgctagttatggaggagaagactggaaactttatatacgacgttgagttagaattgagttacattgacttattgacttttagttcctatattttattttattttattttattttattttagtttctaaagtaataaatacggaaactatagtttttatatttaataatttaaataataaaatagaataaaatggagagaataaaaattagtaactaaaaacaaaacagcctagttagactctgatggctagaccacacgtacggcggcctggaatgcatgcatccagattccagcattcatctcagacggccctcttcttgcagtcccctggtgagctgagcgcctgagcccttctcttcttggagaaactgcactggtcgcttttcacatttcagccaccaaacagattagctgatgccacattaacaac

SEQ ID NO: 3437 - DNA, 2329 bp, Zea mays
  misc_feature (1)..(100): optimal_loci_60216_G1, chr2:47548903..47551231, Cluster 20
gcagcttctatccaaataggtctagctctatgagctctagctttaaaaaatttaaaactggaggacagttttatgaaatttttgaagctcatcaaagggtgtttccaagacaatattttcataccttttatgaagttgcaagtaaattaacaaccgcgccactggttacagatcataaacgcttcgtttctatttatgatctcttccttgtttcacagttcttcctccggcgtgtcggaggtcttccccagcacgacattggtgtccgccaggcgtcccttcatgacgagccactgggagcgactcgggcatgccgagcaccatgtattagggagtgcaccagaaagcatccagtagttgacaacaaagcccatgaggaaggcgcatgcgaagaagattaccaccacgaagacgatgatgtagtggcgcccgatctagtcggacgttcgcccaaccgcgaggagccgatgagcgagtacacgatgaggatgccatgaggatgttcctccaataatctaaagatgaaatactgaattatacataaattataaatgtgcgtgtgttttatacaatgtggcgtgtgtttatgtcctataagagaaaataatgtatacaaataattttgttttgatggcatctgaaaagttggcgctccaatccaataacccaccaacatactttcagcccaatcaacgagcccaccaagacgagtccactactaatcataaacagtaacgaagaaaacttacataaattaattatattacagaagttgaatcctatgtgcaagtcaaacagttctcaaacccatctcaacattttactaaaattgttgaagtgaattcttctcaaataggcccttattttgagtttttagcacgtttcataaaaatctacaaaatatatggacctaaccacacatctgaattttaggatactttatattttacggaattaaagtgtttaattaaaaaaataagatttaaaaccgtttttaaatctaaagcacgtgaagatgtgcttaaggctatctacgatgaggtactctaaagagtactccaccaacatagagttaaatataaaataaaaaattgctccaacgaagtgctctataatctactgtaaacttgaggaggagaccgaacgaaacctaattccagcgttcatgtatttctaccctatcagacatgtgaagacctgctccacagtccacacattccatgcgacagcgagctggcgcggctgaggaaaagtatataatacagatataaagttgatgtatagagtaaatattattgtagtagattatgatatagagtagagaatctttctaataagaatataatttttttaagtattaatttagagtaagagtgcggataacctaaatacccttatatacagagataagaacagagcctttccacgtcagcaagttcccttgctgggcgtgggcccagatgctccaagccacacaaaatatctcggtgtggagctcagattcgcgaatctggtcgctttgatactgaaaattgttacggcaaccccacaatccatgcttgttttttatatttctcgtttgattagatctgcatgaatgtccactacatataggagcatggaatataactctaccaagcgttcttctaataaggtatttatacatttgtacaacaaatagtatgaagatttcataagtgctcatgtccatagtatacaatgaaacgatgttatgcacagtccaaaatctaaacattaacatatgggattgtgcactaaaaacagataccaagcgttcttctagtaaggtatttatacatttgtataataaatagtatgaagatttcttaagtgctcacgtccatactatacaatgaaactatgttatgcacagtccaaattataaacattgacatatgggattgtacattaaaaacagaaagaaatagtgtctcaaatatgaaacatattaaggatattgaaaattttagaagtatgggattgtacatcactccaagcaatatttttggagacaagtatctcaaatcatgatatttggtatacatgtgctagaagctagtcatagataaaaactttaggttagagtggatactctaaaaattccatgataactactaaactatggtattaaaggtagaattttgtataaggtagccaaatacctattgggaaaaatatcatggtatataaacatataaaaatattttgctttcaaaaacaccctctctacagtgtttagaaagaggaaaacccacaaccgtaacgacaacggttctaaggaaaatgttaaccaagtagagttatgctt

SEQ ID NO: 3438 - DNA, 2940 bp, Zea mays
  misc_feature (1)..(100): optimal_loci_6855_G1, chr1:35235400..35238339, Cluster 20
tgatgatatcttgacaaataattcttgcaggatgtggtttttttcatacatacaaaaaaatcattgttgagacatgcttagagccaaggaacaacacatatttttgcagctcggctaaaggatctcgttttgtttatgttataggactttcaacaatctagatctgagtcaacatgttctttctgaagtcattataactattgaaattttgtaacattctctcagacatgttatatgttctaatttttgtgtcttatacttctatgctggtcaaattgaatatgactttctaggcgaggtagaaattgattattcttcatactagccatcatactctggtgtaagctattatgacaacaacaacaacaataatacacggtttagaagggataaacatatatttataggtgaaacacaagcctcagtagatggcttggcaatgcatggtctatggagtactctacgatgacaagtgatacatgttaaggtagaacttgaggcaatgacactagaccactgtgcaaatgtacaaggtgaccatgctaaacctctattttttatggaaatgcgatagaggtcccaaaaaacacatggcatctggagtgctaagacaatatgtgggaatctaaaagctcaaaacacaagtgattgaagacttggtgaaacagtttgtggttttgctctgattatcaatgggaatatacttgttacaaaggtggtaccgtagtaactacgacaatggcatgaatttttgtcgcttctatgagtatactcgtgttgttaaaagagtaaatactacagttagactcagttgttgagtccatctttgatgaagatcacacatctccataaagctagcctgtacaaggacgtaaaatcatttgatctataaatgtatgatgcttcgagtaaacttcgacaagaggatggcaaagtaaacttacaaagtcttgagacttggttattgcatgaaaatgacttatccttcgttctagatttttttgttggtcacttctaatgtctgataagtattatgtgttactcctttcaaagttgtcatgtgtagtgtgttaaagaggaatatttttaagaaaatagagggttcaaagaaaacaagtctctttgtcttataccacaatctaagtattttaaaataacatatacatataacctaaactaaacagcaaacaaaactaaacattataaataacaaaataaaacatgtatcgaatttgatctaacccatatctacctataaaaataggctagaaaatatacctaatgtagaacaaaacaacacataaaaatgaaaaaaatatagaggataccttgatcttgaagatataaggattaaatccaagcttcaaaggctgaatacatattagagatagttgaaaggactagagagaggaaaacaggaagagaaacgagaaataaatggaggtcgaacgaatgccaagcagatgaaaggagaatgctcggccaagatgtgggatccgtaagaattatggaataaaccaaggtcagcgtcataaatcttgaggtcataccatgttattggtcatgctagccgctggtgtgatacctcaatgctataatctgtaataccgagacgtgtaattttagcgccaagatagaacgagttgctctagggtttaaacctaattttgtgtgtgtggaaaagactaaaatgaacaatgtggtgtggttatccattgccgcttctccagtcaagactccaggaggcaggagcagagagctgcagcgagagagcgcagcgctgttcgtgagacgatcgaggtaacatttgggcatgtacgacgatacagtacatgcagagggatgggacgctatcccatgcgtactgtactggtacaggccatgttgtactacgtacccatccatgatgaatctcgctaggcgctcgatcatccatccagtcgccaatgcgattcacgccccgcctccactcactccttttatttacaacctgtcaggaaccactgcctgccatctccgactccgtccatgccccagccgccctggtccgattcgctggttccttgcaagctggctagctagcgccccatgctagctcttgctgccagcggtgagccgagccgtggggcactcacgtccgctggacggctggaggacaggagacatacatgaggcgggggcgagggtggggtgacgctagcccgctgctggagtacgggttttgaggtccggagcgtcggggcgacgacgaacggatgcactaccgcactggtgtctgtcctgtccccccctcccctccgcgcctgcggcgttgccggcccggcagggggtagctctgctttgctgccgaaagcgctgtcaggacggcggcccatagtctgctaccgctactgctatagcgctggctatgctgctgcgtgcagcatgcggctgcgccaacttgtcgggctgggcctgggcggcacggccactcaccattgctgatgtgctgagtgtctagagcaaacacagactccgcgttcaggttcaacaagcagacgactcggcatcaaaggaaatgctccaagtctgtagaagtgaagccctcgacaacctaacaagataccagctagaaactaaaggcgtagagggacaggaaaaaaaactccccccaaataactcaatgaaggcgatctagtcttgaacggttgaaccgaacagccagaagcccagaaccgaaggcaaaggtaaagtcgagtccaagtgggagggaaccttggtcagcacaaagaagatttcaccaaaatcatataggctagcaagccaaatagggggtcaaagtcaaactcgagcagaactggaacgcagacaaaattctacatctaaatagccgcaccgagcgaggaccctcgagtcctctatatttttctttctctttcgcaatcatgtcttcggagaaat

SEQ ID NO: 3439 - DNA, 2898 bp, Zea mays
  misc_feature (1)..(100): optimal_loci_79861_G1, chr2:170494134..170497031, Cluster 20
cttgacatgtcatatttgttttctactgaaatatcacactctacaccagttcccttaccaataaccttcgttatatgaactctagcagtcacaataggtgaaacaccataacaacgaccatgacctaaaattagtaagataaacaagagttaatttcacaaaactacaactcatgtaataaggaactacaacttctgctggtcatttcataaaactacaactttgaccctagaaacaagcaactacagctctcaagtaaacaagttgtgtggcccactaagactatactctatttgaatggcaggtgggtaagttggtgtagttttatgaaatggtcaccattagattgtcacaaatggttgttgttttgtgaaattaatttagaaagatatattagacaaggaaaagacaaagcataacattgccatcgaaagtttcttgctaattgtctcatcacatccaacatgtataggtatggaaatttccttagcattaacactaattggaatgaaaacttggctagctaatttccctaactttttctatcattacatccctctcatattcatatcaatcttagcctgcaaccttaacaagaaagaatccaattatacaagtgcccaaataacaaaataatacaaagttgcttccaagacgagatcaccatcctaatacaatgtccttataataatatcacaactattaactaacaacaataatgaaatattacatggaaaattagggcgaatagcctctgtatggtattagtgaatcgttggtttttatatgggtgtatctggatcaatgtttttcacagaggcaaatatagaactaaatgtggggtgcacatgattggagcatatccatttcacatttaacttttcctagtgagttgaagcatatatccattgcacatttaatttttttctacaaaactgtggtagcatgcatagggtgtcgtcattgtatcagaaatttaaaaacatcaaaataattgtattgtgttatatgtttgtgttacagctccttgaacatgttagcacaagctagcagaaactgtaaatccaggttctctgatcactataatgctattgttggacctattgttttatcaaatgagcctttatggtcacttcaagagtagttcgctcatcactcatatatggagtcgttagatctgtttcattcccattattcaattctattagctctagatcttattgtgcaagcaattcaatttacagataagaataagaaaatatggaaggggcaaaaatgctagaaaagatatgagatgtgcttagaacaatgattatgctgatgagaaaatagaacattcgcaagcttcctaaaatcgagaaatcttgttcctacgaggatattgatctattacatccgtactgaagttgatagagaggtccagatcactttgagaagtaaatagctccattgcgaaagatccaaatggttccacaattagaagcccgttatttttatctgaaaagtaacaccaactatatttcaaatgaaaaacaaagacttcctagtaaaagtgatagctaaaattccacagatcacactatcaactaaaactaaaaagaggtgtgtttggctggaatgaaacacaatataccatcaattaaaccatgtttagatttttaacacacttctattttttcttaatgctctacgctaccatataggggacaccattttctatatattttctatcatttgaagcataaatatttaagctaataagatatccttaaataaggtttatggtgaaaccctattatgttgttgcatagttatccataaactttgatatgttttaaggaggtaatattggttcatccataaaaaacatggttcagtttattggtcctaagcaagttttagtttgtacaaatgtctataaaaatcaaaatataatttgagtaaaatgtctgcaaaggcttgtcgtcaaaatgagcaccatttccgccagcattcaagtttatttagaatgccttgtaccgtggaccataaaatgtttggtactgtgagtacatgcaacataattcagattttttcttctggacaattttcaagttagtaggactgggatagaagaatcttgcgcagatgtacaacaatcagatgagttgattctatatcttttagatcccacacagatccatatatgaagagctctacatattaagattctagaaaatagcaaatcaaaccctcaaactctgacaacaagaactagtagagtgctagtacatattatagattatgccatacaaagtggatcacctataagaatcaaaatataatttgagtaaaatgtctctaaaggtttgtcatcaaaatgagcaccatttcagccagcattcaagtttatttagaatgccttgtactgtggaccataaaatgttttgtactgtgagtacatgcaacataatccataatttttctatcttccaagcgtttttcaagttagtaggactaggatagaaaaatcctgggcagatatacaatgctcagatgagttgattctatatcttttagatcccacaccgatccatatctgaagagctctacatattaggattctagaaaatagcaaatgagaccctcaaactttgacaacaagaactaacagagtggtagtacatattatagattgtgccattcgaagtggatcaactataatctagtcacaaaaatgagactttcacaggtatgaaaagcaactataatggaaccgaaagactttcaagtctatcccatataatggcagtagatgtgtgtcatatatgtaaggaaacaaccgaactacatattcatgaggaggtcagtggtggtctttggttgacctcggtcaagttcgtggacgagagcctcgtt

SEQ ID NO: 3440 - DNA, 2012 bp, Zea mays
  misc_feature (1)..(100): optimal_loci_81521_G1, chr2:179444231..179446242, Cluster 20
tcaaaacattaggccaacaaatctaagtcaacatagccgcctgcctcaacgtcgataaccacaattaaatccaagaaaatgtgagttttcgtatgaagtttgcaaagattcttgggctccatgttacatctgcatgccatattaagtagtcaatgaaatcaagatgactcgaaacttattttatatttttatactaataacacagatcatgtggaactagctgctagctggatcataagtttttaaatgccagcagggttgtgccgctaaaatacctaattaactattactttgggatagacacggtctgtgcaaacgtgcttacatgtcacacaaaaactgctacacaatcaaactttatataccatcgtcatacagaagtcatatattttttatatattttaatatagaataaactagaacataagatttgcacatagtgatagagtaaataataaagtacatctataattttttataacttaattgccttgcgaatgtatagtaaattattgcgcaatagttttctaattagctcaaaaacgtcagtttggtaattggtagtagtgacaaaacaacattattaacactgctttgcaaaaagtagtgacaagattgtaaagagctgctctctggtcctcccatgtgctgctgctcctttctatcgtccttgttttttattcggacatatgccatttttattgttacaacttccctttttaaacattcatcggccaattttaaagagaaaatacgtgagaaagaacaaagagcaggacatggtccatgataagagagaaaaagaaaatgtaaaagtggttggaataatttagaaacagtttagaatttttgttgtaaaattatcttctacatttagacccagattctagaaattgttggagaaatccaataaatatactgttttttagccacttgaaaagtctcttcgatttccttattgcttttctagaaattattgaagatgctcctaaaaaaaggatatggacggagcactaattactcctatgtaaatgcacgcacaaccgattaatcttgtgaaagcataaaagctaataagatttgctaagttgacttgaatatagtcgcccagatgatttttatatggttttattgcataaataaagaaatggatgaagggttgactaggagataaacaaaatatgcgtgtgttcatatataaaagcataacatgttgacttgatcgtctcgtgtgaaggaaaaaacgtacttatatagctatttcacggaatatttataattaacaaaataataacattggggatcactctctagtctgtatgctggaccaggaagctttctcagagtgctgggtcagctctttaacatgcacgcactacgcacatcatgcacccacgccggttattattatagtgaagcacatgccatccgatccatgcagagagtagagaaccatcatcccatcattatttatttatttattaggaagtgtaaggagatgttccacgtgtcgctgatcaaacgaatggcttcctaaacaaatgatgatgcgattcatcatgcaagattatatatatatactcttatgcgtatattataataatattattgataataaaaaatgaacggctcagaatggtgccattcatgcaagatatatgtgtataattataataatgtaatggctcacataaaaaaaccgcaaaggaagctagcagagaccttttagttaaaattaaaataaatcggcagtgcgctcaactgctcaagtcgatctagtaatctcttataccaatgaccatgctactatagattatgtcctcacatgcatgtatatacgtaagtgatgacattgcaagccgtcggactattgaagaactgtattctagctaaatctactaattaacatatctattaaaaaacatataaatacaatattatagatcatttaccactagacgtgcaacataagtagcagaagaaaaacgtattgtccctttgtgctgctcaag

SEQ ID NO: 3441 - DNA, 1533 bp, Zea mays
  misc_feature (1)..(100): optimal_loci_8190_G1, chr1:42854864..42856396, Cluster 20
tagtaaaaaaatgtactactccctccattcgtttttgtctaacgtatttgatcgtttcatggagaccaagaaaacgaatgcaaatacatacgctgcattaaaacagttgttcgaaaacaaactccattattttttcccaagctaatatattccatactactgcatgtggtgagttttattattaatgaatacttttcaatacagccacacaatagtttttgcaagatttggttcatgaataaaactacttctctcaatgcatagtttcatctcatgtttaatatgccagtcacaacattaaatagataagtggtattgtaataaaacgtgccatatgaacaatatagaaaagtacaatggtatcaaaattatgtacaagcgcatgaaaatgccaacaaaaatagtttactttacttcaacattcatattattaacaaaacatataatagagtcacatgtaaactgaattggatgtaacacatgttaaatattggagccatggtgcacaacgaggatgtgagttgcataagattggccaaaatatgtggggttgcaattatgagcactcaacgcaagttttgtgacaaattagaaaggggtgcaactttggtgtcttttattgtgggaaagaaatagttcaacacttctctttgattgtgcttatgttgttttttggcacatagcatacctatttttaggtttgcgaccacctaataatgttacttatcttttcaatggacactacaaacagacaatatatttaacaatgcttttatattattaggaggaactgtaatttctcgaattatacgacttacaaaaattgttgttattttttatagatgtcaacttttttgtaggttttattcaatagaacacattggttataccactaaacacaattggaatggtgtgaaggaaacaacttgaacactgtaatgcctttaaggcattgtgcaccccagttgaggcacacaccaaagctaggcctatgggaaccacaccatgcaaccccacttagacatgcccgtctgttggaggtggtggtggggaagactatgtgaggttctaacgtcgcttatgcaatggtcattgtctaagttactagagcaagtattaaaagtgactgctctagcaagtgactgtgttggtgtatccatagttgtgttgcacaacaaaatacaataatctcaacagagaaaattttccctaatcccctacctagtgtgtcgagtgtcattgtggacatacactagggtatgtaactacagaaaagaagagttattggagagagcaagggcatagtccaatgaagcattgaacctaggtacaattaatagagagaggtttgggtcatagtgtgtgtaataccctatttcctcttcctactcatcgatcgacgaacacaaaagtgaacaatactacaagctcataattcaaccgaccaccatgacctcctagctccccctttccactttgtttgagtgggaattctagcctatagatcgaaaattgtcttcccttagatgttat

SEQ ID NO: 3442 - DNA, 2132 bp, Zea mays
  misc_feature (1)..(100): optimal_loci_82662_G1, chr2:185401880..185404011, Cluster 20
aatcgcgtagctcaatatgatcattagtgccactagatgtaacaatcaatacaagtcactagaaatcactcctaatctcacttggatgaatcactatcactggaggtgagtgagagatattttattggatttgctagggtgtatatcaagttcgaaacctaggatgctcacctcaaacccagatacgctctatttataaggtcctaagatgaaactagttgttggatcttcattgtgcaaaaaattagggttgtcacaccgtttaacgccccactgtcaaaccataatgcgagggtttgataaatctagagcatggcacatgtactagtcgtttaaatattatcgccgtctcaccaatgactatatcatcgtatggtccgacattcatagtttctagagtctatgagttagtcttttgtaaatggtgactaagatggcattttgtaacttcaccaggtctaatggaaaagtataaattcattccacctaatggcacttaagtaaccatcttcaaccttaagttttcctctttatagtatgactattctaaatccaatcacacactctattgacttttcactagtaaagtaagttagcttatactttcatcttgagcctttgtattttgcttttctaaatgtttagcacttgttcatccatcgtggttatcaccattctccttacagttaaccaccttctcaacatttgaatatggacttgaacctatctcactcacaatacttagaatacagattagttcactagttgtttcaattaccaaaatcatacaatgaagctttcatatggtaccatgcatattcttatactttttatatgcttatttacgagtaattatactttctgaattttaagagcactcttttctatcatatgcccatatagtccttgcaaaattcgatctaggtcgtgacacgtgagcatcgaacatctttggttgatgcacagtacatgtcattgctcgcttgctgttgtgcttgcctgcgtttgtcgctcgcatacaaccactgcttgctcgcagtcattgatcgctggcggcctctcttggcaatgatccatgctagcctgtgtgtgttgttgttgtttctctactgcttcgttctcgtctacatgtgtgattgcttgttaaatgtgataggaccatattcatggttatgctttattcatttatttgttggacctacggccatatccaacctcccatatttcaagcttcactatgtaaacactctcaaacaatgtcatctacagttctgcgtcctctattttacacgatcaactgaagtcatcttaataagataggactaaaaaaaccctattaaattggaatatgtgagatatgaagaaaaaatatttaaataaatatatgttgtatgtagcacacataacagtcggacgtgcatccacttgttgtgatcgtcgtggcacatcagcttcaggttaactgtgtctgaatgtggctgttgggtctactgaacaacagcactaaccaaagcgcacctagccagccaatttcatctgcaccactagctgctcttcgggttgccaaagaattatgcctccaatataatggaatgaaggttggtgtgatggtaatgtgactgcaaacgtgtcaaccctgcaattttggccgataaggcgagaattttggggggggggggggggggggggggggcaacatgagacggtttttttggagcaacatgtggcgggttttttttcccgatcaacatagcgaagtatgtgcgcgaggatagtgctgtactgctgttcctgcttcgccatgaagagaagatcgaaacagtcgccctcgacgctccctctcgtcctgcaccgaccactagctcccactttactatgcttatcttccggataaacattcatgcagtatgtttcagatttgctgatgttagcgtttggagaatgtttgaaatttaaaaaaatcgtagtttataaactaaacatccaattaaaattctaattgcattaataatgaatctttaaacaaaaccccacataggtatatttagatagtttcttttataatgcaggatttatttcttgaagatagaacattcttgtttttatcaagtacaaatgatgtttgttggcgc

SEQ ID NO: 3443 - DNA, 2237 bp, Zea mays
  misc_feature (1)..(100): optimal_loci_83392_G1, chr2:189494768..189497004, Cluster 20
acacgtcaacttgaacagcagtttccaaactatagactagatttctctcttgccacatatctcaacggctccatgcaaggccccttctactgatgatgagtaaactcttccattttctttatttgcgagtaagagtactaaattaaccttgcttttccaaccactacgggttgacaaaaaagagcaaatcattctctcacactgcatgcacatcatcttccatgttggcctgctgctacgaataagccccgaacggctaaacatatagatatatagccgcatcattagtccgagaactcttgtttgatctcgacatttcggcatggcgaggatttttttttaaaaaaaatcttatcctgaaaatgcgttgtcgatacaacgtcgtgttgtggatgatagatactcgatacaacggcgacgtcgcgcccatggcagttgagggatggaggcgtatatacatagtgttacaacactacacgccctctttatcttatcaggcgccggaaactatatagtagtattttgtttggtccattagttcgtaaaatgccatgtgaatctgattggttatggcatcacggcggccattggcatgaccctgcttgaagtgagctcatatgcacgtccaatcgcagggcaagagtggttactacattgcgcatttaaattttacgtgtcggtgcagcatttgttcagggcactttttctcataaacatctcggtacatacacaggactatatataggtacccgctagcccccattattcttcatgaaatgatgatctcaacaaactcgttgtcgcaaaaaaaaatgaattactttatgaaatttcggtagcaaataattagccaggagaaaaaaaatcaaagataaggtaagaccgaaggtctgcaatgcaactgtgtatatgagtgaaataaagggtactaaagtgttccctcttccaaagaggtttcgcctttgtctcaagccacatttctccaactttaatcagactcggtttctatatatcatatagatataccttgtttaaatgagatatttatttaaatataattttttatttataaattattagtatatatatatcatctctcctttgtataacacaaatagatatgagttgtcgtggtcgaggttaagcgctttatatcaagatagtagggtctgaatccaccacactttttttttgatatcttccgtgtggaacgagacgacgcacaaagattctcacacttaaatatagtacacttaaatatagtagagttttctagataagtgcacaattatttttttttgtatacttgatcaaaatgtaagaagtttagcttagtacttcctttgtcttcaaatacaagtagtagatctggcaaaagatcaccttattccttgctaactggaatagagggaataattagttgttattttttttgtaattattggctagctatttcgagtgaccccaattcaaaaggagcctcaatatttcttgctaaaaaatatagaggagagaggagattaaagagtataccttatatgttggtagaaatttcgaattcttgaaccatttaggattagccttagtggagagttttgtgacaaagttctcaatgccaaattttttgtgttggtaattgtaacgataggttttatctaaataaaactatctctaacttaccaaatttgatgacgtgtcacaatattgaataagaatgaaacccatttggagaaaatagtaacttgctagctcaactggctggatgtgtaaggtgtggcggccatgcacaagtcacctagattcgagttctgttcaacttaaatcaaggtccctattcacaaaccacatgattcctcttagacaagttactttttatagggaatgagcctaacccaattagttagttaggagatgtggtcatgtatccaactagtgaactcgaatttggatgcctatcaccttgatcttggtatgttgcccttagtttttagtttgtttgaaaataagagtaaactttttcttacttctgcttaccttcacacctctatttacctctattgagaatatatacttaatctttgtttatttcaaaggagttatagtacattaagagatattacaaggagcagcatgtgtgccttgaattgaactaggtaaataatgaactaatgagtagttgagggtgcaactaatagttaggtacactattagctagaggtgtatagatgtatactgct

SEQ ID NO: 3444 - DNA, 2355 bp, Zea mays
  misc_feature (1)..(100): optimal_loci_84976_G1, chr2:198819774..198822128, Cluster 20
ctgggcgagcgaccaagtggtccaccccttcaggctgcatagaggagtttgaggtgcggtctcaaacacacacttgaacggtcgaccaggattatccacacatgtgagtgtgagtcaattggggatctcaactccattaacttctctagcctttgtaaccacaccatatttgacatgaccttaagcaaactttacaacaaccatgccgataagcatctaatcttgagtgtggttgataaccatatcaaacaatggaggcattgttcgtgttggagatcagtagtttttgtcgactctagagttcttattgttgaccatgaacttatcatgttgttcatgttcatcgaccttagcaacatgcatgtctggaacctatatggatgcaagagcctcacaacatagctcaagggagggagagaggcaagaagatgatgctgacatcttagcccaattgctacttatcatccgaaaactaccataaaaaggctagatgtgaacgatttcaaacgttggatggtcaaagattcctagtttttaagtttgatagttgaaacaaaataatactggtgttaagaacatttctaatagttttataaaaagcctcccaataaaggttttgatgcaaaggtgaaaatggatttccaacaagtactgatccatgcttgcttctagtttgcactaaaaaatatgtctccacgaactcctcacatatgaatgtacaacactctttatctatgatctatcatccactagccatccattgttgccccaccctactctggatggtcctacctagttatggttgtcgttatcttgttggggggggggggggttggctttggccttgttgctaggagctagtggtggttatggagtagttgtcagctagctacatgttagcaggtggggctatggacaatttttgacccttcacttattttcttattcttttagaaactaattattgactattgcagaatgcaaaaattgctcctatttgttttagttacttagtataatcaatgatttgacaactattttaattaaggagatcttagagattctcttggatgagcatttagttttcccaaaatgttattatgccagccaaggtctcatacttattggtgaagcgtgttgctcactacatctcattcacaatggtaggcctagtgatcttttataggtaggacaaacttaacaaccacaattttccaagttgggatgccatccatacttgacggctttagattgtatggtctagttgacctatgcatgtacatggatgctcactaaggagcctaggcatgtgcaaagggtctctaggacctatgtatacttgaacaaatcacacaactcctcatataagaacatatccatagatttattagttagatgataaaaatcaaattattccaaaagattattgtgccagccaatatctccttatacatacttgaaaatcagtattattcacatatgacactcgtacacaggactacacataggtgataggtctagagattttgtacaactaggacgtacttaataaatgctagctattccaaattggtttcccatccatggtcaatgattttgcatcacatgtgccaagatggccttcctaaatccatggactttcacaaggagcccggactggtgcccagggtcactaggccatggatctgcctctatggatagttgtacatatcatgcaactcctctagtgagcacaaaggggatccatgtttcaatgtattatagaaattagaaacatttatagataaatcataaaaaacaattagccaaatcatatgaatatgccaatcaacatgttatccatcaatcagtggactgcacataaaacttgaatggagtgtgggatcactttcaaagcataaaatgggctaatagcatatataatagtcccccaaatatcactcctcatccccataaaactatcatattggggaggtaagtacttttccttgatcccctagctctcttttttaagtggccacatacatatccaggggcggatctacaccccggccacccggtccgtggcgggggcttgatccatgtgatagtatataaatctatatttaatacaatataaaatagttaagataaaatggagaagaaaatttagtagatttagctcgggtcatagaaaaattctggatatacccctgtacatatcccccatctcccatcaaataaaaggggagtcgtttatcccccaataggttaagagcctaggatccaccccaaatttcacgcactccaaaataaaggaaaagtgagtccaaagggagtacagaaaaatgtgcgcatgggaggagtggatgtttc

SEQ ID NO: 3445 - DNA, 1693 bp, Zea mays
  misc_feature (1)..(100): optimal_loci_87446_G1, chr2:213212693..213214385, Cluster 20
catgtcgtaaactaagttcagccaaacattaattcggccaggcctcctaaaccttttttttttttttgcatagaatcttcgtctcgatcgatttagaggcactgcaagtcacagcaaattaaattaatttattattagcagtttagcaccccacacctcaaatgcagctaataaacagctattgcatgttggaattcgaaatctactgattattttgccatgtttcttccattttaatacgtgcaaaccagaaacagtattcgacttagcttccactgcgaatttgtgatcattcctgttggcatctgattgacgtgttaaacttgcaaagaaaaagagttaaattacggacattcatgaattcgcgtgtcacagcacagtcgcgcagatcaatcttttgactcttaacaagtttcagaactagctgattatttatttatatctttcgcatacgatggcccgatagcctccaattcatccaacgagaatgaggtatctctggaaacttcaattttattagatataaaaacacattgtcagctttcggggaggtcatatacttggatctaccaatacgtcttttgtagatatatccaattagaagaaaaaaaatctaagatgatgccagccacgtgtcctttaggctatcttcagcatcttatctaacctcgtatctatattcaaactttactatgtagacaatacaatatgtaatgcaaaacagtgtttcgactgatcatataattgaactgctaatatgatcttataggctcaagtcctaggacatttcaaccggaggctctcccggccttcgatggcgtgcatgatgaaggatcaaatacttgatgtggcaggactaaaatttagtcccttaatccaaacaccatgtacagatattacaaaagtttgacttcttgactttgcaaaaaggtccttgttttttcaagctaattctgaaaacggatattttttcctagactttgcaaaatcggatctctctctctctttaaatcggagctgatgcctgcccctattctgctaacagccactaggcgagaaaggaagctacgacaatggcaaagcccgagcacaggtgggcttaaaactgataacctcgctgggctagggcccaagtgggcttttatggagagacgcgcggggaagagaagcggcgatggcaaaggctctaaacgactaacgccagataggtattacggtttagtaccatctcgccagcggaaaaaggacaaggttggtcgcagtttatacaataggagcagtggctacccatgtatcacaagcagctgtgtggcaagcacaaagcgaactattctttcgccttttactaaagaataccgtgtgcttgccacaattacagcatacatttatttttggaggtgttgtctcttgttgagagagccccaacaatgctaaattaaattttacatggtttgctattaaattttatatgatttatcgagctctagcattggtggtttatatcctttggttttgaaggtctttctttaacaatgctaaataaattacattttatatgctttcgaaattgctgcttgtgattggagtacgcaacacgtctgtttgatgtctatatagttaaccttatgccaactaagaaaccaagggtatacagccaacataaaaaaaaacacatgcatccttggatcaacta

SEQ ID NO: 3446 - DNA, 1436 bp, Zea mays
  misc_feature (1)..(100): optimal_loci_87554_G1, chr2:213819513..213820948, Cluster 20
cattgatctttcgaattgggcattaactatattatcttgtgagaacaaaattaatttgtaactcgtatttctttgatcgtggagagatgccccatgcctccatttgtactaacaactctatgagagaccagtaaaagatggggacatgatttagagcgtgtttaaaagcactacaattaatagttagctgactaaaaatgagtagttactaattttagatgggttgaaccaactaataaactaataaatagttgaggacgtagctaatagttagttggactattagctgatgaaaattttaaaagtagctaatagttaaactatttatgtcatgttccaaactatatagataattattagtcggctaataagttgttagctaattttagctggtttagagttgctaacaactatcacctatttgagtggtataatgaataattagttggtttattagctgacacgtttaaacctctgagctatattttagctactagctattagttttagaggtctgaaactgtattttagctaaattatttggatgactttacctaattttatcaagtaattattgggtctagcgtattcaaacaaggcattagttattgcccattaatcattggggtgtttgttaagaattgaatccttggccaactttttctttcacactctatgaagtgggacgtgagaactctaaaaattagatctcgtttctcactagagaattacatagataatacatttctactatatcaaaggacaagtttctatggttccatagtttataccatcgttgtgctcctaatatttaaaatagtaaatgataaaataatacataaatagggatacaaactataattattatttgctctaaaccaacattcacactcagtagctaacagaacacatgtttttatatacttaaaaataaatataaactatagtaacgtacgaaaattttgctagtacaaatgaaatgtgggtagagccttatcgtcacttttgttagtcattagatgaatgtataatgtatagtctatcgtcactagagaattacatatgtatgtgcgtgtatatcctgtcgttctcacaattagaaggttcttatcactttcgttttccacgcacttttgtttgggtggtggtttttagcaacccggccctatgattttaagggactcagtgtagttggaccttagactatataaaaaattctatggtatataaaactatacatgcactaatttacgtgcaaaaccaaagcaaatacattgatatatttaatttaatatgtcaaatactaatcgaggaataaaatcaaccaaaataccaatatatttgtatcttggagctatatgattatcttaggttgtctttagtggattgtgtaaatagagaacacaaaactatagacgacactatttggcattgtt

SEQ ID NO: 3447 - DNA, 1573 bp, Zea mays
  misc_feature (1)..(100): optimal_loci_89040_G1, chr2:222266929..222268501, Cluster 20
tgcattgatcaagtgttcaaatagaaaaggaagaaagagaaaataagctacaagggctccaagcaacggtgtaactagatcattttattttaccagtcaagacataatagactctgtgattggatttagcacaaatgagcatactattaagagaagatcttaattggacttttttgtcatctagtgctagtagacattgaaattttgtgtgcattgcataggcttaagtgacgcactctgagagcaagcacttatgtttatggaaaacacttctaaaatgctaatattgttctaatatgttttgccaaaaaaattgtgagttggcacacttgagaagaaaggataaagtgctctcggtgtagctattctgcatgtatctgacatgtcctttgatgtaccaggtttatgcatcgaacatgaggttgttccttttatgttgcatggttttcaatcggccacaatggagtccagtgtgcactagatgtccctcaccagatgtgtctggtacagcatcggatggtgcaacaaaacaggtcttaagagagaatgcaaattggcacatatgctctaaaggtcactagatgtgtccattgaagcaccgtacaccacataatatagagaacttagagagcatgtagagaacttagagagcatgtaaaacacacacatatgctctaacatgcactgaatgtgtctagtgtcttgtctggtgtgtacactagatacccaacacacaataatgactagtttatagctattgggagtgcaccttgtgggtatataaaatataaatagaccttgtggccagttttcgctggcatctcagcaccccattcacctgtgtacacctcttgagagccaagatacagttcactcacttgcatcatttgaatcatcttttggtgagactagagagctaagatatagtccactcactctagctcatcataatctgacaggatatctcttgcatcactttttctctatatccacttatcttttttctatattatcataatctgacaggatatctcttgtagctcagctacatcaccttattatactgctctctctctctctcctctgtctgttcgatgtcagcatttaattaatcagctaagagccggtcactatacttcttgcttgatatcaaatcaaatctgaaccgcagcggcgcgcgcggtatacggccgtgcatgagcagccaactgggaatttaatggttgttgtttggtggccgatatgacagtatatatatcccgggcaaatgggcaatcgatcgagattcaccgtgtacgacacagcgcattaataatctttctgaccgcagttacagcagcttttgttgtgtactacgtactgatggagagttggatcggagagtgtggtcctcctgtgaatgggcacgtacgcgcgtgcttgctggagtaaccgctagtagctaccaggggcagggggccgggaggaaaccaggtagtatgtattatgtgcgtgtactacgccgttgacacaagtttgtgtgtagagagggtaggtacgtatagctagcgctgccccctgccctcgagcgagg

SEQ ID NO: 3448 - DNA, 1621 bp, Zea mays
  misc_feature (1)..(100): optimal_loci_8914_G1, chr1:47137919..47139539, Cluster 20
agcagagagaaatgaacgggccagtgtaccatggcaaaaaaattctgggagagaagctaaggcaccgtgtgtttgagtttttggacagtttttcagtataaaaaactaaaaatcgaaataaactgttagttttttgtttagtttcgagaaagttagattagaagctctaaaaatttgagtttatgtaggaagataaaaagtctagttttgtgtgctttatgtagttttgtgagtttatgaagctaataacactattaaaaagttattattggtttcttagaatcaaaagtccaataatagcttttcagaaaagctccaaaagctagctcagagatgggcttcatgggtccgacgaccgtaggaggggctagcctttgacacaaagatgggcttcatgccttcatgggtccgtcggccgtaggagaggcatgccttcatgggtccttcggcacaaagatggactgctggatccgcccttagtcaaacgttgcttatctatagactgctaccttttatttaggatattcgagatcaaacatgctatctcctatctcccattcagggtttgtttggttagaagaggattgacggggaaataaactatttttttatttcccatcaatccccttctaaccaaataagacattaggttattcacgaggtcaaacacattcctagttaacttccgtggcgttatcaattgtgatgagttctaagggttcctttggaatgtggatttcctcggtttcttatgtatttcaactgatttatatgaaatttctatataattgttctgaaattcctgtattctaaaggaggcataagtatgttttctagattgccttttctcctactagtttcagttttcaccccacctctatagagtgtgatgttcagcttggtgaaatattcggaccatacattcttaatatagtaaacgtgacagttttattaaaaaaagtactgagaagtttttttaaatgatccacatccgtatccatagatgttcctttttgtcgtgtaaaagttgatatgcaacttgtttggtaaaaatgctagtgggaataataaattatagatgtttgtgtgcaggcgcacctaaattttatcattttgtatggggttttatttatatctattatgtttgttatgtttgtatcttaacttttgtggtgaaatacacctactgtggttgggcatctttttttttataaaaaaacttctaagtatattttagaggatttcatgtttgcacccaattgataggttgcactgaatgaatgtttctgcgcccaatcaatagttgcactgaatattttctgatatagctgatatttttcgtacgagttccgttcatactgtcgccactagagatatttacaggataaaaaaaaagaggcgtgtttacagatatacagtataatcattgaatggtggtaatctgagaaagcaaacaatgaaagctacctatgcttggagatggtaacgtatcatgatcgaaatgattttcttcacaataagttagtgaccttaattaagttttgttaaaaaataaataggaatagtacctgatccaaatctgaattgatctttaaacttttttatataaaatctagagtac

SEQ ID NO: 3449 - DNA, 1893 bp, Zea mays
  misc_feature (1)..(100): optimal_loci_89659_G1, chr2:224853842..224855734, Cluster 20
atatttcgaatttgtcgttcctcattttgatctttactggaaactcgtacatatccaaatgttttgtgtttcatttcatacacctcataaataattataacaaaaacatctgtaaatgtttatgggatatacagacatccgtaaaatttaaaatcaacttttacagatgtatttccctaaaggtttatgtatatctgtaaaggtacacttttatagacgcatcaaataattcctacacctttaaacatgtaataataaaaaaaactattaaatatccaaataaaacccaatgatctcatacattctgatatcactgggttttataggtttaatatttttttatcttttattttcactttacaataagaaattgtgaaggtcataataagttgtttaagttaaatacttccaacacacatacccccgtccttttttggacgggggtaaaataaagtgttattcaacaattgcgcccgtttgcttaataacaagtgtggttcacaaagttttactcttgacttagtttagtgtaattatgttgaatgaaatccgtcattttttcatcataatcagggtaattaaaatctaataaagatgcaacttttttagaataggctctaaacatatcacaacataacttaaaggatccccaggattctttataaccagattgactaaaagtttttattagtttttctaactcttcttcaggaagataattaccaataaatttatggttcttgccaacactaaaattaaatccttctcttataccaacttcccatgacatcattcgtaagagttcaggacgaagaatttgattaaaatggtctagcgcataaaaaagctctttcctataaaagccttttgctatataagctgatacacaccaaaactcattacagcaatcatcaaactctcgctcagatggttttttaatccaatatttcttgtcatttggaacaattttttcattaatgtgtttatctttgtcaatcaaaatttccactaaaccatctgcgtcagataaatactgatctatttcatttagaggaattaaagttaaatcaatctttatgccatcattaaaatacataatatagctgaaccaatttcctagctctgctggaaataactccatatcttctggtttttgcataaaaattaggtcaccaaatatttcgagccaataatcatctttcttataggactctatatccgatacaaaaaaggaaatatcataatcttgaaaatcatctttaggaatgtttttgttagtcctggaaccctcaagaactgataatctgatcctatcatcattcatagcaatattttcaaaaagagacatcatctcattttcattacgcatttaaattcccccttttcactaccataacatcactactatttagtgctttttgttaaattattctgcctcgttacttttatacatttcatcaaaatctcattcaaccgttacttaaatatccattccgaatagagaaaatcattccaaaatatgactctaaaattgaaaacgaccgcttacccttgctccagataagcaccctttcgctgaacgaatcctttttctttggctaggtgttctagaacatgaagagacatatgtcgttataattcttcagcaatcagttgaaattcgtcaaaaatcgaaagattcataaagaaacgccatcctttctgtatatttctacaaaaagaatagcgtttttttagttttatggatacaattttttagcttgatgccgatgtgatgctaccccattgccaccaaactaagagaagacaactaccctaaaaatgaaattttgtgctaacttgtaataaaaaagctcatttttttctttttgggtaaatctgttttcttaacat

SEQ ID NO: 3450 - DNA, 2735 bp, Zea mays
  misc_feature (1)..(100): optimal_loci_92390_G1, chr3:1560544..1563278, Cluster 20
gaccttttacttgataatgtccatgctcttgttttcggtcaagatgagacttgttagagagatagaggcggggaaggatgatctctctactatggggtggagaggaaggtggaggaggatatttcccttttctatggggtgatggagatgctagtggtggtgtgaaagaggtgagtcaactattttagtcttcattggaagaacacatatttgctagctagagatgtttcacttaaaagtgtttcctatttttgtttaaaaaaattaggctttttggctaaggcaaaatagaaggacttataatttaagaaagtctcatggtaggccaaactctttcggtcctttaattattcacgggacaaataaaggtatgagacatggtggatctatcttagcttaaacacatgagctagggggcatcaaaactatacaatagccatgattaaggtgcatgcattctgagtgtgaattatgcaaaaaggccatgcatgctaccttccatggaggacgaatttgtaaaactcaccccaattttagtctacgaacgaacactcgccgttttttactttctactgcacagcgagaaagcagcacgcatataggcatctcatttcagttgatggcgttgccatgtcagttgaacgatggccaaaaagtcttggaaatcagctacccttttcttcaggaatcaaattatatttttttccatacattagctatatagccaactctctcacgccattttggtggtcccatgcatgtaaaccgatctaaggcgtgtctaggcactccaccaccgacctgtccgaccatgcatacatgcaactcttgtgaccatatatatactggaataaataaataataatgctcccattattcatgcatgagtcccatgtatctctattatattaaactattagttttcctggccttatatttttctttaattataatcagcccgcttctaactcgatcgagtaaatggagattcaaaccatagttgctagtcaacaaaagtacaaaacacacatgtatttatgttttatactaaccatagcaatatactgacaattttctagtgctcgcctatatataatataggagtatatatatactccgatgtggcagacatgtttttcaataccgaattccattaattttggccgaaatttcaccgaaatttcttagagacttaaacctaaagtatgttttttctaaaattttcaaatctaaatagaatattactatgatttatgattataaatatattaagtagaagaatatgtgtaacataaataataataaaaacaaaagcatatatgattatatagcagatgtattagtgtgatagaaaaaattggaattttctttcggccatcaccaaaatccatgaaattccgccgagattggaaaccctgatcacagtaaacaaaggtaatataaactgcagaccgtctatatatagtggaagtggatggaacaaccctgctaggctgctacgtaccattatattgcatgcaactagctagtagccagtagtctaagcaaagatggaataataatttagcttttgagaaagtgtgttagcactaaatcttatataataaacaatgcgatcctgtgatcgtcgatcggcagcatatatgttagaaagctagttttttttgtgtgttttaacaaatgaagattcccaacagaccgaacggcaaggaatctggaatctccgtttggcaggcacgcatacctggtacctgtgcttgctagctactcatccgtcccctgattgtgatcagtctcttcatcacaaccgacgatcaacatccgtgctgattgtaatcaccacagtatcgaaatgccggaagctgccatctgtagcaagaacaatcatatatgcatatgcatagcctcctcctcgtactttaattagtcaattgattaatcagaacatggccttctctactctatcggagatttgctttattttaatttgcgtgcgttgtatatatatagtagtaatcagtgggcggaatattcgtagtgagctagtagggtcgtccttgcactgcatccatccatccatccatccttgggtctgtgcaagcctgtaaaattaaagcgccctgcctaccaagtagaaggtgtttttcatcgattaactatggttgttaatgctttggaatcaatcaagggcacgcttgttagttagtagccttttgcattggttagctagtgttagaggtgtagtgctagctaggattgtgcatatatatgctaactttgcattacttaaccagttaagctttgctttgccatctctctctgtgtgtcacacacacacactctctagctattgctggttgttgcctgcaaagtgcagagattaaaatatgctaccgagcgcacgcctccatgtgggagccaaaaaacatagctgatgctgattgctggtagacgagataacaggatcataactgattgctggtatttgtttcagtagatgtttagtttctataactgaccaacgcacaacaaacatctaaagatgttatgtatatacgccactgaatgtccgactgtatacatacaatctcttgcgtctgcattgggtgttgtctgtctgtctctgtcccagatgctcaaaggaaaggaaaggatctaatttgtcgctcgcgtcacatgcatggacacaatcgacaggaataattaatatcctaaatatttggacattatttgcg

SEQ ID NO: 3451 - DNA, 2574 bp, Zea mays
  misc_feature (1)..(100): optimal_loci_93187_G1, chr3:5588654..5591227, Cluster 20
gcggctcctctcccgggcacggacagctaccgtgttcgcttcccgtttgcctgtacccagggtggtacgccgccgtacgtacctactcctactgctcactggcaagcgatcgttcgtcgtccgtcccccttccgctgtctctgctgcggcatcgtctgaagcggagtcgtgtcgaacgggcagtggaaagaggaggggggcacagggtacttgagtactagtgctactccctatcgtcgttgccataacctttttgacagcgagtgtgtcagagagagcccaaagcaggtttgtgcggcactaatcttgcaatcaccgccagatccggagaagcttttggtttctgttttcaggcggcactaatcttagcttaaatgaggcatgatggttttgttgatctgcttgctagggttaggggaatcatgcacctacgcggatctaatcttcatgcaataacaaatgaaagaccagagagaaaccacttgggttttggataaatttttccatgctctggtcagatccatttgcagaaagataattataaagggtgggtggagaagctgctagttgccccacttagtgttattatgctttgaaaaggtcagtgggatgtgttctaaaatcttgctccccactaagttagattcctttttttcgatggatttgactctgggaagtagaagctgcgatcttaagaactgaaaaccagagaagatatgaaacgacaccttacctgaaaatttgaagccgacgatagtaaagtgcagatgtgggaggtgccattgctctgcgtttacaaaagaacagctaatttttaggaacctcatcataattagtaagccttaacatatgtatcgcacacgtcactacgaaattttcttgaaaaattatggtcataacatagtaacacatagcatgcagaggtgagatggcccagttttggatttagatcagattggcgccaatcattgggatttgccaggaatatctccgcaaaggacccaaggcgatggaaaatgccaggttgataatgccccgacagtcactgaaacattcttctaaccttagccctaacaaacagaacaagctagctagccactgtacgggaatcaggacaccttgaggcttcagataccgggttgacgacgacccgctacccaatccttggcacggttagtggaagaaaacagggacgtcacatgcaaaagaaacaaaacagcccgtcgtgtacgcacagaggggcatcgcattgggatcgtaaaggaaggaacaaaaggaatcaatgatgggagagcgcaacaaggacgggggcctgcaaaaaatatttccgggcagcagagcagtggccaaaggccaaggggggatcccaatagcgaccttgcacagccacacctcactcctatggcatcatgcagctgaccgcacactggtgagttgcagttaaaggctttacgagtgcaggtccaagagacatgtacaggtgcaagattggcttggagattgattgagcgagaccaggaacaaaggatctctgaaagtctgtatggggcaacaggagcaagtacagactcactttcggtccttgaaattagtgcccacagattatcctgcagtattatggactcgctgcgtatggggtagttttctagttatcatggtagtgctcataaaaagcactcgctcactcctccgttctagattataacatgtgttggcttttctagatatattgattttactatgtatgtaggcatactgtatagctaagtgcataaagaaaagccacaatgttctataatttggattagagggactaaggtgccgtttggttcatgaattgtaaccgaaatgataatggtaatggttcacatttgagtgacagcgataataagtttaaataggccagtatctatttttagtgtgtagtatctgattacgattggacttaaacaaacataatttaacgttatatgtggttcatgaattgtaaccgaaatgataatggtaatggttcacatttgagtgacagcgataataagtttaaataggccagtacctatttttagtgtgtagtatctgattacgattggacttaaacaaacataatttaacgttatatgttaaccatcgtattacaattatgtgaaccaaattgcacctaaatgtgaaggcaacgataccggatagggctttgatgtgaatgttgggtatacatatgaaagtattgcagaatgacaacggtgaaagaaaagaatggcaggtgaggtaaattttactcaatgatgaagcaattactgaccatgagatctatagtgcaacagtgctgtactattgttggcgtgggcaggcaggcttgctttgtcttgagaattgtttaccaaggattaacctgctggtagttcctgcacctgatgccagtacacctggttctcacagcatctcatctgtcctctgtgaataaatgaaaattatgtagtgaaataaaatgtaacgaggggaagatttactgtgtagttctagttcagtagaaataagagtctgatgcacgattactacatcgtttaaccaaaaaaa

SEQ ID NO: 3452 - DNA, 1510 bp, Zea mays
  misc_feature (1)..(100): optimal_loci_96777_G1, chr3:24850182..24851691, Cluster 20
  modified_base (453)..(453): a, c, g, or t
  misc_feature (453)..(552): n is a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
cattacattaattattcctcctatttacatcttgaaattcgggaatttcaggtgtgacaacatacgagcacgcatgaggtaagctggccaaaggatacaaatttgcatctaattatcaatgccactaaacccatcagagctttggtgtgcccgtggtaacctttatctttgttaccactacatggtggatctcttatatgtgaagtcagcttgttaatgtgaaggtttgaaaaaaaaaacgactgtttgcagtatatttggtctaaagcactatgggatcgaaaactgtcatgcaagtaatttacttgctcgtgttcacttctcttttttttttaggaagagcaaaggcaaggaagcttcttattatgggtgggatcatgcgggtgctcgcctacaacattgaatggctggcaaacagtattataagattcgttgtctcagtttgttctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaatttcaaaagattcgtccgtcattataatcccttgcgctaaaagcaagcatcaaatttttattgcagggatgtgccaaagctgtctgatgatgataaagtctaaagttgagcgttggtgtttgtagtttactatgcatggcttttcatgcccctctctctgttgggttccagcttttatccactgttccctgtgttctggttcctctgcctgcctgcctgcctgcctgcctgcctgtgaggtctgctgtgcgcgtggggtctcaaatggctgtattagtaaaaattctacataacctcaattttttgtagttgcctactccatcctctgaactattgattgtcgtctacttcagtgcgtcacctataaacccaagtattgtatacctcggactactaaaaatcgtctaaataattttctagggcggttttaaaggtgattttttttactgttgtgccatttttaaaaaaaatctatataaccccctaacatctcaaggattgattgtataaccctctcaactataaaatatgacattgtactccctaaaatatctagtaatattcaaatgacctctagatggtcatgtttggtcgtttggacactattcacaccacacaaggcataagtacatatgtttgcacacaaacctatcgtctaacacccccccccccccccccgcttgtgctaccatccgatgaacaccaccttattttctactctacccatgcactcctcgttgacattgatcgaatacgttctctgtgcccttatcatacggcctctcacatattgtgcccctcttactttatgctcttatgtctacatgaaaaactgaaggacagtcggatagaggatgtgcaaggagttgaagtgttgaacgatgataatatatgtgtgatgcttaaccttaatgtcattggacagtgacgagggttggagcagaatataaga

SEQ ID NO: 3453 - DNA, 1623 bp, Zea mays
  misc_feature (1)..(100): optimal_loci_96778_G1, chr3:24852496..24854118, Cluster 20
cgcctttgccccctaacgaagggagaggagtggaaactgctacgtgcctgatctgaagtaatcttcacctgatgcacctgtaccaaaaacatgtttgatcgtagttgggtcagacagatcgagatcatgttcggcctccgctccaacaatatcttacgttgcttatgccaatgtggtaggatacaatgtccaaaatgactcaacataacaatccagtaaatcatttggaattaattgacatttgaagggctataataccacattttatagttgatgagtcatggagtcaactcttgatatgttgtggggggtatatagactattcaaagtgacatgtcaacaaaaatcacctttacaactctctcgtgagattatttagacggcttttaataatttgagaaatagaataactggtttttatatttatgagtggtggaacagacaaccaccctatggttaaggtggctaaatagattctttctttctttttttatgtgtgacagggtgcggcgggttgttgactgaaatggagaaaacctcatttcaactacactagcctgatgtactactggctctgcttttagtgtgtgttagcctttttctgctaggggaaacccccacttctccacgaagctcgtgtgttgggtatcaacgcggcaagggactcgtaaccctggttacatccctgacgctgacggaaagaaaactaggcgtgttgatctagatctggctcgtttggtgaccaggccacaagcggctttgtcctctacctccagccagccagccattcagggaccattttagtctcgtggaaatttggtctgctgttttacgcatacttgctcagcacaggcgcttgttactgtgcatatacttatttttttcactcaaataagctgcacaccgtcatcttttattagcaactcttgtttcatccctgcatttgaactctagttcatggggttccttttcctgcagctgcaggttactctgcaactttagagctagtttggaagccataaaactggaatgaatcgaatgagctagattagctttcttattcaattttgaataagaacatgaatctagccccccttcctttttctctatttcaaactagtacttacattacaggtacagatgctgttgcagcctgcagtatccatccggatcttgcattgagttgaccatcatcactgccgcaggcgtgcgtgccgcacgctccctatgcgaagtgtacgaaatattttatacgcgcatcaaccattccacccatccaaggaggaataaacaagccacttgtctgctaatacaggtgatgaagtgggggaggaactgctgtgtattacaaaagtattattgcctttgtagttcgtgcagataactacttgaaaaactggacaaactgtgctgaaaaggctagtggaattcttaagaatatacagggacaacagtgagctttcgcattcgacctttcagtcacgtacaggttccatttcagcacagcacagcactggaaaggaggtcgaactttttttacctttcagaataacaaacaaatcctagtactagtaccagaaaatgtctacgcttgtttatttggcaggcagctaccagtctgtc

SEQ ID NO: 3454 - DNA, 1476 bp, Zea mays
  misc_feature (1)..(100): optimal_loci_98329_G1, chr3:33779483..33780958, Cluster 20
gtggttggaccactaacttctatcgcatggtggcactgtaataagttaagtttcactttcgatagccaaccatagtcatcaaaagttacctatcctgtgtgaacttccaaaagctatgatcattagatggaagttacattaaaaagtgctatttatttttcttttttccttagtccataatttaaaaacatgtcatatatgcacatcacatcatacatcttataacccaaagaaagttcaaattctcactttcatacatcaatttcacacatacatgtcaaacaatactagtgaacatgtttaaacatcttctaagcatgacaaagtatgaaaagaacttgctcaacaactataagtgtttttcatccaggtacgacactcacacatctagacaatgctcatgaatatagtttgagttttgtatgctacttgtaggtgtgacacatagaaatccttggacatgtgagctcgaaccgtcgtctcaaaatctaggtgcttgtaaactagacaacatatttctataaatctaaatatacaagtgttagatgtcaaggtgcatatacagataagtttaacttatgttgaaatagtttacctaaggtggatgccatggtgcaggtggcctaggtggtggcatccccatcgatggaagttgaatgttcagtttcaatcctgcaccttacaatggtgtctatgaatgcactgttttagtgatcaattacatattcaattaattcaaataattgacacaaattaaacgtacctgaatttgatgagtaatctatgaagcataatgattggcatagtaatattattgtgaagcgatgtagtttgtatagtaggcatcacattaattaggccatcttttcacgcagacaagtgactttagcatcttgccctcaactacaagaagagctaatcgctaaactctgtgacccagatgttgccttctctcatctcacccctcttgagtcaatcacaccagtaaacatagtatatctgcaaaggaaaaagcaaaaactctaattgatatgaaaaaacaaagactctatttgacatttacatcaataaaagttatttgaaagttggtgaagcccataacttgcaaagagcatgttaaccttatgcatgattagccatccaaggaattattaccttgtgtaagaaaaatggaccatgatccatttgattaagtgtaggggtataatcggatcagatatgaacaaatattactcgttccatatttgttttcatattttcccttcagatttggatacgattaggatattatataaaattgcgttgaataagatttgaatagatatcgacatcttaaatatacaactttgataatacgaatacagataaagattggatatggatcgaatactgagtacccaaactcggatatggatcagatctcaaccctctttagacgaataggattcgaatacggacggataatatccataccat

SEQ ID NO: 3455 - DNA, 1031 bp, Zea mays
  misc_feature (1)..(100): optimal_loci_217939_G1, chr6:67227678..67228708, Cluster 21
ggcagaagggcttgaaccctcgcctgtgagaagacttggaccatccgcctcgccaatgacctaacgatatgaggggtaatattcataccaaaaagggtgctagaaatgttaatgtgtaagaagaaaatggtatgattacttggaagcacgctctagtaatataagcaacatagattgtctgatgtgacataaatagttttccctatgataatcaggccgattgaaaaattgtacatgtaacactaccacctccttagactataaaataaggtgatggagtgacattcaaggcaggtccacacaaccaacctcaagataagagaattgaagatagttcattcaggctagtagtgtgagggggtggttaatatgtcttagcttcatactcccatgagaggattccatctctcctcacttgaggcttgtaaaattgtacactaattttatgtataaacgctccactagaaagaggacacacgatattacgtccctagccgttcgaacatatctaaaaatctctatcatcagttgagttactatgataccaatgtgatgatatggtaggcaaactctatggaactagggctcactccctactcgcctgattaattcatcattggtaccttgggtaccctggtgttgttaccatgacatatagcaatttagcttggcaatcaacacgatgaactatagtatttaaagaaataagagatcgaatttcatttgccatactaagaaaactgggattttagatggttagctattgttagagacaggcttcttgaggccgctttttgtagagccaatgatagctccaactctagctagattttccatatagtacaacaagaatatgtttatctctctcctttcaaaatcagctaaccttcagcgaaaccattgatttttgtttcactagcttcggcccctctgtgcactaatgcactaaaatcggatactagagctcacactcccgacaaggagcgcatatattatacatagtcggcacataggaagggcattacactatc

SEQ ID NO: 3456 - DNA, 1248 bp, Zea mays
  misc_feature (1)..(100): optimal_loci_110554_G1, chr3:115307502..115308749, Cluster 21
ctttgtttctagagccctcgctcttgttgtcattctgtgcaagaattacgaaaagcatcatcgcacaacttacttcttttaaaagtcgtatacgagaagagtagtatacaacaacatacataaaaaaacgcacacactgtacagcatattgacactacgagcaacagattgacgctaccagagctaaaaccacccactatatcaccgaagcaccggcaggactgcagtaactgtatattgaaataatccagtgtttccttgcataaaggaaaataaaaaaaacgtggtatattcaatctgtagtagatagatacgttggacaggaaacatgcgacacgaaacagttaaaataaaaaaaaagttccattgccgggatttgaacccgggtcgcctgggtgaaagccaggtatcctaaccgggctggacgacaatggaatcaattgggacttttacaaagtctaatctctaatcttgtagactagcgcctcagctcatgtttaatttccaaagcacattttgcgagtttcagctcccaaatcatcaaaacttccggtgaatcttagaagactagactagcctcctttctcaggttctgaatctttgaagacagttgttctactgaaccaatatcctaaaccgaaaatcggtgacgatattctcatcggcttgtacacgtgtgctgtggtattattgctggcagattttgtaccaccgtacttcgttttccctaacaacacctgctctattattggactccacgtggctgatcgagacccccaccttgacatggctatccaatccggctcgtgttgtctgaattgaatttgaatcggacctagttttttcccctgcacggccaacaggcaacatatgtcacgcagggtcgcatgaatggaaaaaaaaagttttataggaatgcacgaaacgtggaaggttgacgtgtacataagttggaacatattgttggtctcaaatggtgtgggtgtgcgtgctatgtagtatgataccgaccctattttgttatatgtactctagttctaagttcctacttatcgcttcgttttcttaaaaggtctttctaagaaaataaatttaccgtttaaattattgtttgagaaattatttaagcaaaaactgttttctgtacaacatttttttgttatcttatatggagagtcatcttcgtcgttatctttgttagcaagaaatttagagtaaatgatatttactgcccgttcgttttagatt

SEQ ID NO: 3457 - DNA, 1112 bp, Zea mays
  misc_feature (1)..(100): optimal_loci_114664_G1, chr3:140106950..140108061, Cluster 21
ctttgtaaaattgtaattatttgtgagccactgaaaccgtcagaagttgagcaaattttaggacataaagttatgctaatagtaaaaacaagctcaagatccaagtcagtttcacagtacacaacaagctggtttgcagggttaggtgtcttctacttctttcttgtcttgtgctctaaatttgctgcatcaaatacttttaccttgagtaaattgcaaaagtggtcatctaatttgggccactgaacttaaaaccccagcaaattggacgatctaactttggattagctcaaagcggatgccgacttggcgtgtcctattgaagcatactaatgaaaattcggaaacccaaatggcacatgtcaaattcgaggacacaagtgatataacctgacaagtttgggacccaagtgactctaatgtagcacgtcacgtcgataattttgagctaatccaattttgaatggttttactcgagctgataaaattatagacctgttttgatggttttataagttgagtgacccaaataattaagcgtgccaaattgaagaacagctagtacactctaaaatggtcacgccaatcctgctaagctgtcgtgactgttcctactccctagcgcccaggtctaggcctattggagaactgaccaagcctgttttcttgcctattttgagctggttagatttccaattcatctataaatataatgtatttttgatgtggaaaaatatggaaaacatgtttcgaatttcttttctattagtttaagatcatctccctctatatagattaaaagataaccatcgattgaagataactttcaatataaaaacataatatatacctttttctctgatttatctctctattttattattcgtcatattttcggtgagttttgacggtgttctatatagctttgtcgaccttagaataatttctagagtctaccatgcaaaaaaatgaactcaacatcagtctaaatgacacatcgaccggtttcatcgatctattattggggcatgtgcatctctaagggggttaaataaaaaaacaacaatatctttgtgaaaagtctgtctctacacgactctctatatatattg

SEQ ID NO: 3458 - DNA, 1064 bp, Zea mays
  misc_feature (1)..(100): optimal_loci_115303_G1, chr3:144356477..144357540, Cluster 21
ctaagaactaatattgacctattcaaatttgctaccaggtacttaggtgtgaatcattaccattatcatttacgttatatttcgtgaaccaacaccttaatattaccaatcatcttttctattacaagcactcaggtgtgaatcattatcatttatgttatatttcatgaactaaacaacaccttaatattaccaatcatctttcctattacaatggtgcttttggttgctaccacttctaattcttttctaagtttatccttttcgttcttagttttatcaatcttgtagaagcttgttactgtccacttgcttttgctttttgttattgttaaacaaataattatataatcattacatcaattttagcaatttggttaaaagtaatatgttttactagactagatgagccggtggtggtcctgagattttaggggatgaaatttcaaacagaagtttttttaatactatatataaattttactaataaaaactcaatgtgatcaattaaaaatcataaacttgaagttgtttttgctcttgtgagagtgttgtgaggtctttcattgctgtcagttattacatataaattttacaataaactcaatgtgatcaattaaaaatcatgatcttgataagttgcttatgctcttgcaagggtgttgcgaggcgtctttcgtcgttgtctcaactgatgtgatgtttttgttttttgtttgagaagtcactttattctaaatgagttgatttattatgggctcatcatatgaattttgataaggttattatttttatgctagtaattattattagctagtaaggaatgcggtaacaacaaattaatccatttaatttcaccaacgaaacaaaaaataataataagcaaaaggataatatattacttattcatctaatagtatacactatatgttcattatatacataaatagagatattttatgctattaaaaatatttgtgtatgatataaggccccatagtgtgagggctaggattggacataccgtccgaccccctcaaggtcgacactaccaagagtttacc

SEQ ID NO: 3459 - DNA, 1344 bp, Zea mays
  misc_feature (1)..(100): optimal_loci_117502_G1, chr3:157926213..157927556, Cluster 21
tttagtgatagaaatctttgtttctcatagaaaaggttaagggttaaaacccacaatattgtttagtttttaatatttactatttgttagtagaacgtgaataatggcccggtgaaaaaatgagaacccgagtaaaataatgacggaaacggaagtcaccatgaaaaatcttgtatcaaaatcagaaaataaaattgggatttgaaacagacgggagacacagaacggaacagagaaaacggatagttggcgcttagatttgaccgataaataaaataataaactatattttttggatttaattaaactttgccatatttaaatcaaataaataagactcataataaatgctaggataataaaaagttaatcaaatacttcctcggtattaatttataatttgtttaacttttttgtgccaaccttaatcggttcgtcttattcatttttttgaacaaacaaaaaattcaaagccatatacctaaagtatattacatgttaaatgttattacagtaaaagttaataataattataattttttaaaataagaagaaacttaaacttgatgttaaaaagttaaacggattataaattagaactataaattagaacggagggaaggagtatgaattatatggatacatatgatatcagattgactcaatttaaataggcgtacgtctattataagtgtaaaaaagatgaaatgggataagttacacacggtacaaatgtgatccgacgacattcagaacattacatcattagattggtgccagagaaaatttattttgtaggttcaaacttaaaatggaaaggatgggagcaatgaacggcggcgacacaatttgaggggttgccggttgccaccgtcgacggcggtggggacgcgtgggagggggagcggtaggatcgcgggtgagaggggaaggatgagagatatccaaattatttattggatttgagtcttaagtgagaatgaatgatcctatgatctgaactgttaattttgatggtgtgaaaagtctaagtacaatttgtttagtaaatatagtatatattataaatatgggagtgatctagttgggtggattttgcaaaatttaaatacggtgactaactcgattgaatgtatttattacttaggtgacaaatagcgctccttatatacgactcttggtcggtcttaaaccttatccaagtgtttttcataaaataactcgcgagaagtaatattgttaattaatatttctaattatagggagtagaatttttttctgtacataaactatatctgtatttaatactctcatcattctttttatttgttgtgtttagttaaa

SEQ ID NO: 3460 - DNA, 1237 bp, Zea mays
  misc_feature (1)..(100): optimal_loci_120314_G1, chr3:175677119..175678355, Cluster 21
gaggccttgtttagatgcatggaaattgaggaacatataatcacttgctagtcatctttgactagcaagggattatatgcccctcaatcctcgccgatattcacatatcaagcaagctctaatatctaaaagctagtgaacatcactaataacttatctcaactaaaaggctaatagatgagttattttttttattaaaaaatcagtcttctactagttattacccaattagacaaacggattcgaataattaggttactttttagcttcaactaataactagctcactcatccaaacatacttatcatcatggcaccttttcaaaaatggatgctcttgaaagttcttatagttgaaaaaataaaagtcatagtttttaagttattcacccctagttggcataaactcctttgactattcgactatagagggggagtagcgtccatcatgagcagaccatccgatcacaatgcataatcaatagacattgtaacacataggacatatgatattatcttgcattgatagcttaagcatgcctaaactctcgtgtctttcatgcattaaccttcaattctcgatatcatgatacatgtcctacataaattcactcctaaaattttctcaacaccttagtcttggtatactatctattgagaagtgggaatcataagttaataagtaaagaaatttagaaagtaaatttttaagcataaggaaagtaatatgtggccaaagaaaagaatgttagattgatctaacacctacatacatatctgatctaagtctagcgcaagagaaatgaagggaagatcgctgctctaagcaaggaagaagaggaggaggaaagagcttcctatggccaatatattgaacaccaaaagtataatacattgttatttcctgataggtctcattgagaagatccatttattctatcattggcatgatccttggaaccctagagagatgttggatgcattgggtgttagactcgttggattccgatggtagggtttgagagtagaccaatttttttgtcttcaaccgagatgacaccagcgcgtgatcgcaaatattaaggttatcagctgtgagaagctgtaaagagtactctgccaacataaagttagatatacagtaaaaaattgttgcaacggtgcatcttatcggaccctaaacttaggaatacaaagaaaacgccatttacagagtctatactcttttaccctatca

SEQ ID NO: 3461 - DNA, 1129 bp, Zea mays
  misc_feature (1)..(100): optimal_loci_120569_G1, chr3:177114747..177115875, Cluster 21
acatatttctaccaccttcagcagtctctatgtggaagacagagggatatgccttaggtgatgttttcattgcgaacaaaactgacatgcaaaagaaaataaagattgtttggatggggtaattttgattgctgttatttggtagttactttattattagctaactttaatctaggattcaacttcatttgttttcttgatagttattcaaactggaaggacatgatgataagcctcgtctgctaacaccggtatgcatgtatcaaatgctaatacttttgtgcatattggctttcaaagtttgtaaagtttcaccatgtatccataagggttttatgtggatgtggatcaccacacatgcaacaagttgtattacttcttatttgtttctaccatttttagtggccctagactatatttctagattgtttactaaccttcttttctctatcttaatgcaggtgttgtcacttgtcagtgacagtttataaccaccataaagggatctattgtgaatcactcatcggtaggtaggttttgcatcagctggtaaataaaataaacatgtggtcagtagggctgctgcagattgtagtcaaagcgattcttgcacgagggataatggcatggtagagtttgagaaaaccaatattcttgccatgggaccaacggggtcagatacatgctctttatctttgactacgttagtgttgtattttgcaatcgtctaacgctgtccaccaatagaaaatgttttgaaatcaaccatgtacttaaaatttcattttgcaattttgtgttggcattgaaatccttgaaaaaggaaacatattaatagaagcagactatatgctcagctctttgaaaccaagattggatttgtcaggtatccctgaaactaatcatagggattaattgtttgaatttatacagatcaacaccttagtaacagtctttaagaattaacaccgatatttgtttttgtgtgactgcagaaagccaatctactatccccgatggatattcttatgaatgagaaattgtatgaagcagctttgacaattgtgttcaattttttgaagaggtcaggaataaaaaaaaaagtactccaattttcttgcttttttac

SEQ ID NO: 3462 - DNA, 1284 bp, Zea mays
  misc_feature (1)..(100): optimal_loci_122582_G1, chr3:187271052..187272335, Cluster 21
tagaacagtacccatttcccggcctcccgccgaacccaaccctaaacccaagggagagagagagtaccatatatttttatgtcaacttttatcaaatttcattgttgattatacatgaagtatgatacttagcaaagcaaagataaagaaatttttttatgaaccaaccagaagtaacagagggagtaagtaacaaaaaaggcatacaaatcagacagtatccattgtagggtgaaacataactatgcagtggacactatcatatgcctacttttcattgccaaaagagcacccaaactggatcatacctagaacgcttccagttacaatatccaacatgaatattttatgtctatcttggttgctgaaacaaatcatttgtaggttaaaacttttgacaaaatgctaaaaaaggcagacaatgctagctgcagtttcattctttgcccaaggaatcaacagaaacacttcgtccagctttctctggtggtgattaatgttccttctgtactgtttaatgatatgaaaaggattctcctgtgggtgtcggggtgtctgaactctgaactgagatcaaacacatctgtctcagtgtctgtactttgtgctcgctgttaggtacttttaagattaagttaatgtttaaaacaatcaatacataaattatggataaatcatatatagtaaataaccacacgcaaaagaataggaactgaaactaactcagttacaatctaatgaattcagttccgaacttgttggcaaagtcaaaagctgagtcgattaagatctctatgatctgatagattcagttctaaactccgttgtgtaaggcaaagtcagattcatgagtaagcctttgagatttattctgaatttattgctaaacaaatagcgctttcaaaatgacatcaaagtgttttatgcattctaccctaagttcaaaagatctttgctttgctaagttatctacctcatacaatgattcgctgtcagagtctgactcgctttcaagagcatgattcgctgagatggttagcccggggctagctgtgaccagtgcaatacggcaggtgagcaatacttgacatgagctattttggatgttttttaaaaaaatcatgcatagtttggatgtgatagtagtactctaaattggttcggctagctgttaacatatattcaaataggcatgtttagcaataggattcatgtgcaaactgtcataaatagttgatggttgtggtgtcataattactttaccctttgtacagaggtcacagc

SEQ ID NO: 3463 - DNA, 1225 bp, Zea mays
  misc_feature (1)..(100): optimal_loci_123955_G1, chr3:194720070..194721294, Cluster 21
ggcaactactccatggttcatgaaagcaatacaccgttcatttaggatacatgcctgccatcatgacacgccattgcaacatatcattcgaatcataatatcacactcgcaacatcgatggtgaacaaacaatgttatggcgagacaaaggcaaaataaaagatctgatatactgtaaaaaaacttgactcataatctcacccttttcaacactgatggtgaacaaacagtgttatggcgagacaaaggctaaagaaaatatctgatatactataaaaaacttgactagtaatcttatgctctcaacaccgatggtgaataaacagtgttacggtgagacaaaggctaaagaaaagttctgatatattgtaaaaaccttgactcataatatcatgctctcaacatcgatggtgaacaaatagtgttatgacgtgataaaggctaaagaaaagatctgatatactgcaaaacaaaacttgactcataatctcacgctatcaacaccgacggtgaacaaacagtgttatggcaagacaaaggctaaataaaagatctgatacactttaaaaaaattgactcataatgtaatgctctcaacactaatggtgaacaaacagtgttatagcgagacaaaggataaaaaaaagatttgatatactataaaaaacttaactcataatctcacgctctcaacattgatggtgaacagacaatattatggcgagataaaggctaaagaaaatatctgatatactgtaaaaaacttacattaaaaacatagcttcgatcatccatatagtagtgttacaatacaaacaacatatggtacatttattttggcaaacaacttaagcagagaagtgtcaaggatgtcagcacgattcgttgcagctatgaccattatcatctcaacatggttgaatgcagccagttgattcaataattccaacattttttgctgaacttctctatcaccgctaacttcactataccaaaagaacaaaattatgaagcatacatcatgtaagcttcttcctaataagaatgatttgtttacactaaattgaaacaaaaaatattttgatcctatacaggcgattaacattttcttctcatagagtatcataagacaaaataggaataaaaccatgcaagagctgaaaatgtcataaaagacatacctatcaaaacgtttggtgccaatggcatctatctcatcgataaa

SEQ ID NO: 3464 - DNA, 1205 bp, Zea mays
  misc_feature (1)..(100): optimal_loci_124363_G1, chr3:196928115..196929319, Cluster 21
ggccactaaacaggaaaaataaaagaaaaataaaatagtaaaaaaaaagatagaaacaaggaaaagatataattagaaaggaaaaaaaagaatacaatacaaaataaaaataataattagaaaaacgacactacggccgtgtttggatgggatcctcactcgcagagctctacgaggcagaagcattcggcaatcggtattgatgtatggttcagagtcttcgtgctgccagtgtcttcagcagtttttattttaaattttactgctgttccgtttagatatcgatattagagaggatgaaattaaattagattcaataccaaattagatatggtattgaaattatatataattatacttttattgtttaaatgtcactgaattggaagatataattccgcgcaataccgatgggtgagactttatattgggagatgaggtttctatttatagtccaattctagagaattaagccattccaaattttaattccatactcaaccaaacaataacattttccaatgtgtattattgaaattaagtcaattcctttatgatttactcaattcatttcagtttttcatacgtttgccttaatagatgaaagtatatttgatcttggagtacaagtttgctgctatgtctacaaaaaacagagaacaagttattttatcctgatttagtcaatccatctttatatcaataatagcccatatacaagcaacagacaagtcaggacagacaaataaaaatttgctaataaatcaaataggcccaaatataaatcattttctttgaaaattcagggtcagacttgcagagaactaatcgaaaacatggatggcttctgatttttttttctggtaggtgtacatgggcagaccaagactcagtgagtattcacctaggaagctatcaggaaagctacaaccagcgaccttgttcccttcgttgtagacgcagctcttccgggattcatcacgtcaccgtcgggatggcgcagcagcaagcgatgggaatctcagatggacgccacagctcgcgcgcgatgcgatttggaggtgcgaaggcaggagaaaggcgcaggaaaaggaaatcgcgagagatttggagcgtcggcgtctgcggaaacatgtgtatgctggaggtctctttactcacgcgacgcgattgggacccggactagggatctattgggggtctat

SEQ ID NO: 3465 - DNA, 1238 bp, Zea mays
  misc_feature (1)..(100): optimal_loci_125456_G1, chr3:202918721..202919958, Cluster 21
ttaatgatattttaaccatttaaagtaggaattcaaaataaattctgaaaaataaaaaagatccattttataaataaaggtggggtgtttaggttcattcgcactttttgctctccattttatttgtcttcctccgtatcatagcctcctactttatattccaatattgatatcagacgaagtcaatactttgaaaccttcatcgagttgtttaatgagcaatctcaacaacgctttgagatctctgtcggtgtcggccatgtcttcttcaatgacctttcaccccgtacatcattgttaggagaatgtttctgcccatccacgtccactgagtttgcatcctctgtttccatatatatatagtcctcctctatatccctaccgaccatatgtggatgctcctcctccttccaataaaaatcctactgacgcttctcctccgaccaatgatgcttcccctccttaacctttcacttatccataacctctttcatactaatatgggtatctatatggtgctcctccatatggatcgtatagcactcctccatatggtgcttatcttctatttcattctcttgtaggtacaataatgccctaatcattgacagcaatgccgctttgactaagttcgcttactctggtgctccttaattctaatggcaaagggactaatgaatatggaggatgacaggatggtaagtacatatatatttttatgaactccatacatttttaggtcaatgatagttttttagctcataattttataggtttgtgtgtggctagtgcactttgtggaccctatcgatgataatggtaagaagggattgaccttctagggccaaatagtctgcacctacatctccaccacataatccccctcgctacaatacctccaagcagctaaaagatcagtggtcgacaagcaatcagaagatcaccctctttaatgccatataggaccgcttgtacacaacccgatcgagtggaacatatagtgatgtgttgtttgaagcagccaagaacttccacaataagctcaacaaaaccaacctcaagctagagcacatgtggcatgcttttcgctatcagcaatgtagactgtttatagagtggaatttgaaatatggagtgagataggaaagctattatagatagccttaataccagcacctccaagtaggagatcaggtccttaaacttcaatgatacactcactaatcacgacaacaggg

SEQ ID NO: 3466 - DNA, 1308 bp, Zea mays
  misc_feature (1)..(100): optimal_loci_126893_G1, chr3:209830501..209831808, Cluster 21
actttagcccaagatatcaaacaacccttaaaggggtgtttaggatgactctaggttcgagctccaatatgggattatagttcacaatatcaatttaattagttttaaaaaatattttaatttaaataataaacaaaatatgactcatctaaatgtattctaaagggttacaactctagctccacgattttctggagcacctaatgaccaactccaccaactctaccaaattttctagagctgaagctgtcccaaacatggcataaatactatagtttaaagaaaggcggacacaagtacttatggatgtggaagttctcggaaataagtctcattagtgctgctacaagatacactctccagaatatgtctttaactatttaattggtgtgatgttgtgtctataagaatggacccaaatattttttgacgtaacctaagatactatgttaaagcagtatcttacttgggctattctcggtgtatagtgtcatactcatttaatacatgttatataggatggaaagatgatgtggtatgtgagtaaacaagaaagagaataaagtagtaccttggggaataccactcaggcacaagatcataggggataccactcaggcacaagatcataggggataccactcaggcacaaggtcataggcattgaaacctgaaccatctaaatggctcataattcatacactcatacacatctagtatttaattgtcttataaggactatgaaacaacacataatactatacgttgggacaattgtatagttacacatgatgtggaactttggatattgtgacaaaaaacaatgggttgggaatagatttaatatacaacttttctcttctattaaatatctcgtcacatcaacaaaaaaatcttaaatcttatgtgacaccttatctaaacttagtcgatcgaattaaaaaactaacattagacagaaaaattagacaagttgtgatgtctttgggcatgtacaacctagagccttaggaaattgcatgatacaacctagatgtcctagatcataaatacaatcaagacacactatgtatagagagttgtgtaaacctgggctcgtctcttgatcttttttcacttacaccccctagagacccctcagagctagttgggtactctagtattgacttcaatccacatgtattgatgtggattagtgtgtaacttataataatttacacctcaatccaactcaacacatgttaaatactagattacctaaaaaaagcctcaagagaccacataatttatgggcttgtatatgtcttt

SEQ ID NO: 3467 - DNA, 1276 bp, Zea mays
  misc_feature (1)..(100): optimal_loci_128771_G1, chr3:219175736..219177011, Cluster 21
  modified_base (486)..(486): a, c, g, or t
  misc_feature (486)..(585): n is a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
tgtgatccccttactctcatcaccattcaccagtctgaatggcccaataaattaacatgtacgtaacgatgtccaacagtgatccatacagtattactctatcacctacaatatgatagatacggccataacaacgagcattatacagtcaaagcggaaaggcgtgaggtactccgatccgacccttggcagtactggaagcacgtatgatgcatgtgacgtgcggtccagcagcagcaggatatgccgcctgctgctcgtcctactgctgctgctggtgggcttctcgagagcagagcacgctcgctccgctccagtccaatttagattcccttcttcagcatggtgaccctgacgcacgtgggcctaggcccattcagaatgtccgccgcaaccgtccctacacctctttattttatatttattttacgtttcctcttcctagccgcgcagaatctccgtattgactaggtgttttcttcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgatgaatcagcttgattcgttgactatagctctgttgatcctcttgcaaaaatcttaaactatataatatatagtaggctacggctataaggtcatgtgtttgcgaagctcctgcgtgcacgtgtgaagttctgtatccagaagataatcataggttctgttcgtttttctagatgctaatataatatgagtagcactaaatataggttaattttagcctaataagagctaataaaggttaattagttgttttgtcctatttatattattaggctgtgtttattttctttatccactttcctaaactaaactatcatatttggtttccgagactaagaccgactaaagagcattaaatatcgcgtataaagacaaggctgtccctatttaatgcagatgatacaattccagagagggacagtgaagactaactgaagaacaaaacatgtacaaatataactttagtcacttttgtcaccccatagtgactaaagaactaaagtttggaagagctcctttagtcaccatgtttattagcagtttaagaactaaaattgactaaagcctagtcagtaaattttaggaggtggcaaccaaatgggaccttaattaagcgctaacccctattttctttgattctaacctcgaaagtctatgcttatacaaatagatcagtgtagttctgtt

SEQ ID NO: 3468 - DNA, 1362 bp, Zea mays
  misc_feature (1)..(100): optimal_loci_129463_G1, chr3:222809218..222810579, Cluster 21
tactatgaaaggcactatatatatgtgcttgtagtctgatattgttgcttgtagtctgatattgttgcacgccacatgaattagttgtatttgtttttaaatttttggccagatcgtagatgctactctattattttgtttcactgagtacactcatagatgtaaggacaatactattttctttcactgagaatagatatttttatttaattaacatataagctactttacgttgagtccattcatggggccactaatttgcatctccattatctttggaagttctgttatgtgacagtaaaaaagcgatgtactgaataataatgttgccagcctgatgtttgatgggaagaacatgaacttcctggaacgtgagataatgttgccccatatttattgggccacatatttattggaacttcctgatatttattgggccacatatttgttctgcaatgtgctcaataattttgcaagcttgtggttcatgtcactttttatctgcattttggccacaagcatcctagaaaggagagtgtttggttgtgcagcattcttaaaatggtatagctgattatatgcaagtgtttgattgtgcaatattctttattacttgggcgcaaaattgattggctgagccgaatagcaaggcattttgattatgtacaaacttgtttctcaatatggcaggcaggcaggcaatcaagtgaaccaaatataccaattgttgctacaataactatttgtacaggtacgtaacggcaccacatccttatcacaccggtagaggtagcgtgacggaaaacatggttttttggcacaagttttgcaccgtttttttaagacttatatcactattttttttttactctagctttcattttaattttaatacaacgtatagtacaaaaaaattgttggtccatgtagaagctgatcgaagccatttcacgtttagaagcccaagccgcataaacttaactttcctcggcattttttcgagcccactttcataaatgtggaaatagagatgaagttcatacgaattacaggaaaaatgccaccgagatctactcccatgcacaactaaagagaagtatactttggatatttgactacttccattctttttttttaaaaaaagatgccatcttgatctttgaatctacttttccaaagaagccacaactagaaccgtttttggagaagccaaattcatttgtatatagatgcatcatgcatgtaggataatattataatttttgaaaggaggaatagttatttcagttccttaattttggagaaccccaattatactaatgctctatttattctaaattgtaaattatttggacttttata

SEQ ID NO: 3469 - DNA, 1289 bp, Zea mays
  misc_feature (1)..(100): optimal_loci_130840_G1, chr3:229734695..229735983, Cluster 21
caagcaaacaatcaagtacatgacagttcgaccaaatcaatatcaagcaatctggaagatatactacgatattgcattttaagttcaaggtcccatgatcagatgatcttataatccacaatcacaattggccacaaggagtagtcgaaagcgaaaacaagggaagagttcagatatactacaagccttgtgcatatcaaaggttcatcacgattttgcaagccatgcatcagctaaaacattacaacaacactgaggataagcaaccccgaacttacaaatagaaactctgatacatctccaagaaatgtagtaactctgaagtttgacaactcatataattcaggcatgcacagaccaagacagcaaaggatctgtattgccacactggtggagtagtacattgcagtgtttgggatactgtgacattcgaaaatattgcaaagggaaaaactaaactttgtgtgtagtgtattaaaaaaactgaactttctgtcccatccaagaaatgataattggcattctaatttacatttcacatgtcaaagaagagagaaacagcacaagtaaagtttactgattattatgtagaaaaaatgaactcgaagaaactactttgaattaaattaagatgaagatattcatggattctatttgtagcactaatcaatgcacatgaaaggaaattcaaaattatgaaactgaaacaaatcttaagagatgaacaagtggtactcacttgaggcttgttgcatgaagaagaaaacacttactgacaatgcaataagacctggagcagattgataagaaaagtactaatagccaaagcaccccaaaaaatattcttcaacgagctcaaatacaaaggaacaacacttatcatgacaacccacaaagggaagtctcataatgagctgggtaaaaagagtatcatcaatacaaaagtcagtcaacaaaataagctgcaacacaaccttattgaaaagataaacaacaaaataaaaccatagatatgctcagatggaaaggatttttttaatccaagataacccacagaaagaagtgatatcatgacaggccacaggaagtctcataatgagctagataggaagattataatcaccacatactatttccttaacacattgttttactagtcaaaggacatcagtattagcatggttaatgtataccatcactgggaacaggagaagaaaccaaataacccattcatatagtttaagacacagtttaaatccatgctttggtgatgtatctgaaacataaac

SEQ ID NO: 3470 - DNA, 1104 bp, Zea mays
  misc_feature (1)..(100): optimal_loci_131819_G1, chr4:2941991..2943094, Cluster 21
gaattcaaaaatattattatactagacatggtcataaggttatcttcagctgccctatctcatcctctatttcattccctatttaaaatttcactctacaataattctcttttaaggtaactgttgaaattcttattacaaacaccacataattactggttgaaaattaagacaactgttgcaatgatataataaactgttttaaggtaaaagctatatatgtgtgccaataattctcttggaaatgaagtaatgcaataagtgagccttcgaggaaacataatccatgtacgattaatcctaacacacaatttgtatcctagcgactggttttgtcttgcaaccaaaactgcatcctagcgtttggacacagtcgtgctgtcgttccttgttcttccgaagatgcccaagcagattagtacttgtgcagttgtgcaatattgctgatttcagtggcttgttcttgtgcatggcgtcctccatatgtggcaataagaaatctgtctgaatttcaaatatgagttgaaattaaagagcgtcactgatgactagagctaaaagacggatacacatggaacacatcagttctgtttgtcttaatgcattcattgatcgttgaaggcaagaatacaagtcctctttagccaaaaaaaaaacgtcacggttgcaagtactgcacaagaactagtatacacctcgtagagcattgctgtcaacatcatacacctctagcggatgctggtacttcataatcccagggaccaccgatgacggatcagcagtagggcaggttgggctctagccccctatcgctcccgaatctatagagctctactgaaatccttcctaaattttaaatatacaaattattctatatgtttattatgagtgatttagtgagattatatcgttgtagctctttaaataagcctcaactatttttttcggactcggtccatgcctgatccctctcatacccaatgacaacttatccaatcgcatgcgtgtctcagatgggctacaagtagcccccctgtgtagcaagctggaaaaaataattatatacctatttagagcatgtgcaacctaaaaactcctgtttag

SEQ ID NO: 3471 - DNA, 1097 bp, Zea mays
  misc_feature (1)..(100): optimal_loci_132570_G1, chr4:5423988..5425084, Cluster 21
gttttttaggaagcaaccattgacatatgcatgtggcgccactgctcgatgagaccaacttgccattcagataaaacaaactgtttgttctataatctctaccacgttatcctgatcacttttgtcacgattcttaatgtatatttactttattgtattttaaatttattgtatcgttagcaccgacacgttaccttactatttgtaccctaataattatcagttcttgaattctacgcgatgctaatatcaatcattgttgtcctttgtttaagatctgtcgctatgtatatatagcagtcctgcagatgtgtgtaattgcgttgtaaaagttgacagataaatttgcagtccatcattgttttaggtttgtcgttatctaataatctaccactgtagaaaatgagatgacatgcatgccaatcagtctgtcctttcttttagatttatcgtcgttgtctaccagtactatctcactgctagttgtcacaacaagcttaccacacaattaaatattcgcgcgggtcaccagtatagattacaccaaacatttgcaaaagaaaagaaaaaaaaccgtcttgatctcaaaccggccgggcgatcgagatggcgatgatgtggacgctcgaccacaaatgacgaagacgcaggttgcctcctcagaacgtgtttcatacaactcatcacatccgttctttaatttgcatgtgtttcaaatccttttggcggagggaattcggcactaatttgactgtatgcgccacgtacgtaatcaatcagatggtacatgcggcgcaggattaaaaaaaatatagtatcatatcatgcatggattgttgtcgtcgtcctcgaccacaacattgcaatccagaaatggcggtgcttgcatcacgccggattatatattatttagactaatcggccgctcatctgaaggaaattgttcttttgatcatagcttaacttagaaccaccaggtagaaccaggttttattgtaaaatgtccacgtgtgactcgtgcaggcattatctaggactcccgacgacaatcccaacaaaatattagtatccaaaacaagagaattgtatgtaacgtc

SEQ ID NO: 3472 - DNA, 1143 bp, Zea mays
  misc_feature (1)..(100): optimal_loci_132738_G1, chr4:6172523..6173665, Cluster 21
  modified_base (790)..(790): a, c, g, or t
  misc_feature (790)..(889): n is a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
gcagtcgaccatattatggtggctgcctgcaatttgctgaacatgattcaaatgaaatttgaatttcagtttttctgccaacaaaccatacaacaaaattcattgttatcatttagatttcgatacacatcattcacaaccaaaaaatcatggcacaatatataaagtgttattcatccatatccacaatacaaagtttcaaatgtttttacatacaaccaaaatatatcattcatccatatagaaagtgtcatttatccatacacatatatacaccactagttttgtcatttattcatattcacaaaattagttcaaatgtttcaaaattataatatatgatgcttcttgaagttaatgagctctggatgatttgtcaatgatctgtcatggtcgaagaagagtcccgttatgtgtgtcacttcaggtcataagtgaaataaatttgtcatcaccgtcttgactcatgtgtcttccatattcctataaaatgtccacgtttctttgacattgtggtgctgatacaatcaaaacatagtaactataattggaatgttagtgaaaacaatttgctcacacgatggaccataatatacagatacgtagaacaacgttaaattacatcctcacgatttggaatatatatgccgggtacagcgaagcgcctcacacacataatatctgcaactagtgtgtaggtggttgcttgaaacagggaacatcttattatgaatcctcaactccttgacgttgtctagggtgatttcctttattattggggggtggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgatgaatcagcttgattcgttcggttaagtggaccgtatgcaaagaagagatgtttggaagtggctctctaaacatctgcttgcaaaaataggtggggttttagatgcagttctcttaagccaaccacatctaataatattgtttgcaagcggttgtttaggatccgggtgctcaaaacaatgtagtcaattgccctataaacgctgcttgaaaaacttggtggttgtaagggttgtttttagtagtgtta

SEQ ID NO: 3473 - DNA, 1076 bp, Zea mays
  misc_feature (1)..(100): optimal_loci_132949_G1, chr4:7029000..7030075, Cluster 21
cctgtcggtagagcgaggggctgacaggagttacatattcattgaatagactttgcatctctctcaattattatagttgatagtgtaagtaaaaatagcatattaattgaatagactttgcatctctgaattaagcttccacattttgtatattacttgcctaggttatgtgcttacttaactagtttatcttgctagactttgcatctctccaccctttgccaaactctcatcagactctccatgttatgagtacactagtttgggcatgactagatttttttgagccaaaatggtcaatggagtaataacattattgtttgtttcatatgtgtttgtggaaacaaagtgtggttgtaggaacaaccatgaaaagagatacaatagttcattgaaactgtagtctgacccaaccacacttagcatttggtataaggagatcaagcacataatatagcactgtcaaagcatgattttgatgcatagagcacggtcttcacgagctatgctacaacagttttatttgagccggacgctagggaaagagaaaaagaagcgagggaggaccggaggatcggagaggcgtgttcatggtcagcaactaggttaaaatatggaaggcgaggaagcaaatgggtgttgcgagaggatcataaccagggctaattaaggatcccatgtgtcagcacatattgaagtgagagtgggtacattgctaggggggtgtaatcagatcagatatagacgaatattactcgtttcatattttttgatattttatcttcgaattcatatcaaatatggatattatcaagttgtgcgaataagatttgaatggatattgatgtattaaatattcaactttgagaatatggatacggatcgaatactgagtacccagactcgtatactgatcggatcttagccttacacacctaatggtgagtgccacaatgttactatggctaaggtagatattcgaaagaaacaaggcaaaatgctggtggttgtggtgagctaaagaggaggggtgccgtgtaggagtgagttgtcgagtgtgcaattacctcctcagt

SEQ ID NO: 3474 - DNA, 1045 bp, Zea mays
  misc_feature (1)..(100): optimal_loci_133102_G1, chr4:7449239..7450283, Cluster 21
cttgtccatcgtaactttctgcatccagtctccaccatggatgctcaacgttcaccatcgtccccaagtaaaaaacggatgagggagaagctctataagttcataatgaagcgttatccaggccactattaataatgggcttcaagataggctattgctggaagaatagccggcgctcgatgtcctcatgcagctgtactacaggactcgcgcatagtttattgtgtatgctgtgtttactttccgacttctttaaatatttacttatgtcatttaattattgttcatatattgtttatcatatattcttatatgttgtgttgtacgaaacatactttagttttaaatattacttttatatatgcttctcctttgccgtaacttaaatttgttccgtcccgccaacggacagacgagcgcgtgaagcactgctcccaggcctccattatcgagttgcttaaagttaattaattaattaataaggagaatgttaaaagatatgaaaagaaaaaaaatctatctaatacgaaggattatttttttaaaaaaaatcttaaactatggtaaattaggaactaaaatgtataatactggtaaagtaaataataaagtatatcgatatataattttaagaatttttatgacttttgatagttcgattaaacgattattgtacggaaactattagaagaagagtttttttccaaccgtgaagaagcgctatcctaatctagttctatattagaagatgagattatatgatcaaatttgaaacgttaaaaatccttgtggggtccaatagctttcaatatgcggttgtcatcaatcacacccatccatctatgcatagcttttaggctaagatcatcggatcggctttgaaatgagtaaaacactattctacgctataggggatcggctttgaaatgagtaaaatactatagttgtattgtttatatactagtgtccgtgcgttgcaacaacatacaaaatatttagcaaaacattagtgtaacgattctaagacaacaacacctttattatg

SEQ ID NO: 3475 - DNA, 1169 bp, Zea mays
  misc_feature (1)..(100): optimal_loci_133502_G1, chr4:10046764..10047932, Cluster 21
ctgcggacagagacaacaacattatgagcttttcctcctccattttgcagaaggatcagacaccaccaagtagaaatcagtgaccaaaatcaaatctacctaccggctggagcttttgtaaaagaattggcatcaccaccagccaacgataacacaaaattcgactctgtcttgaagacatcgaacaatagatccaaatgcacgtggcagcacgatgaactcttaaatcgattgaaatgctagatgttttaatctcttatctggctgtgatatcacttgttagtaaataatgcaaatctggatcaaacacaagacacaaaattttatacgaaaaactcttgcaaaaaaaccaagagcgcgaaaccgacaatttttactatatgagaagggtttattgaacgcagggaatacaatgagttgtcgctatttccatgtgacttataagatgtatatatagcgaacaaactctagtccagtatgtaaacaaatccgctcaaagcttatgatataatttaaatcatattccaacaagaaatgaagtcaatacgaggagatttcgacgaaaataaataggccaacaaactattcaaccttctagagatagatttattatagacaagttcttgagttaggaacctatgcaagaacataggggtattgtgcaactaataatttattgatacttattttgtattataattaagaataccttttttatatgtttggtcaaacattgaatttaaaatgcgataattataatcttcatggagcgagtacgtatacaagaactgaatggaatatataccaatagtcatcgacttgtcgctctacatgcaccctttccaatatgatttcttttacgtccacattaattttgggaacatgtattttaatgagactttgttgaaacatgatatcttttctaaattcaaaatttgtttttatgaaatttctactttacaaaagggatcttagcttccttgccattctactaactcgagaacatccttgggacatcggggtcaatttcattagatgatataaacttttttgaacttgaatagtattttcttgaaggatctataatttttatcgagatcactgaccctaataaagctcctaaacttgcacctgcattgtgaacactcaggtgccgtttggttcacata

SEQ ID NO: 3476 - DNA, 1009 bp, Zea mays
  misc_feature (1)..(100): optimal_loci_136110_G1, chr4:22628103..22629111, Cluster 21
tgtaaaattctaccttgtaagtatatcttgaaaatcaccttccatcccttcatagtccgagccactctttccgtcatctagcacacatcgggctagcttttcccctaaaaatataaatcatttcgtgttttctataaaatctaaagtattgctgcacgaacattattttggatttcatatttcttaggactaagccatagacaaacaattgactcaaaattgtgacctacattccaaccaaaaagactatttagttaagtcgacaaatttttagctacacgatagtcaaacgttaagcgataaatcgattcttttgccatacagaaaagacaacaagtatcaaagtaatggttttggcttattcaattatctctagtgagaagtttttttataacagccatagaaacacatggatcatgggggaactgttagcctctacgccacaggaaccaaaaccaattggatccctctaaaactaattacaaaatataaagattgaaccgagtacatgcctttcgaacaaaaataccaattgatttggtcattttcatctaccaaattcactgtatttattatagaaataaaatcccaccacaaaagcatgttgttttcagagatatttcttctgaaagatagcttcgactccaccccatcccaaatatcactaatagaggtttcttgctcattattaattatatacaatggccaaaattgtgcagctaaacttgagtttccaaaccaaatgtcttgccaaaatttgatccttttcgcgttgacaactttccattttacccccatatgagtcgccttaacagcccagagaaatcctttccaaaatggtgaggttctcttttcagagcagcaaaatatgtttggatttgtaactttgtattttgaattaacaatctgaacccaaagagcatgctcattcagatgatatctacaaatccatgcaaccagaaggcataaatttaaacttctcaaaccaggaactcctagaccactaaac

SEQ ID NO: 3477 - DNA, 1015 bp, Zea mays
  misc_feature (1)..(100): optimal_loci_139634_G1, chr4:43603528..43604542, Cluster 21
ctctaatgctccatgcacaaacactatgagttagagaaaaaaattagggcacgtttagaaatatagtattttttagtcccaagacaataacgtggtatttgagcatatcatagtattttagactaaaatacgtttgagagtatattaaaaaatatgtattttaaaccatggttttagcaacactgtggtatttctagggttaaaaaattgtggtctagatcaaagttttttgtttgcacgcaactgcactcttctcctatactgcaactgaaataatgtgtctctaaatagctattgaattggattgatgtaaaacataccatcatggcatacaataaaccgttatattataaaccgtggttttaaaaagcatagtacctaaacaggcccagtactgctagttgcattggaggccacgagttaaggttaactccatggtaatcctcacaacacacgctatggggaaaaggaaaaatttcaaagaattctcatataaaccagcaacaattagttttaaatttggtagactctagtcattatcgtcaataacagttgtttaatctattcagatttttttaaaaagctacccacctctccatcattaaaacaataaagtaatccttaacttttgcatctgaaatgtccatttaagctattacggaagataaccgtaaatttgcatctaaagtgtccaactctatctctatgaaagataatacaaaataattactaaattgaattttaacttaccctcatctaccattataaaatataatatagattaatttctttattttctatctaaactatttatgtttgttgttataaaataaactaaaatatccctcaaatattgatctaaaaactaacatgagttattatgggtaaggggcgaaagggactctaggctagtggttaaagacttccgagtagcacctccaagtccccgggttcgtttcctatcggagacgaattttctgacttggttaaaaaatcctcttgttatgccccatct

SEQ ID NO: 3478 - DNA, 1026 bp, Zea mays
  misc_feature (1)..(100): optimal_loci_162852_G1, chr4:191522214..191523239, Cluster 21
tgccatgccagtgagcgtacgcacaagatcgcttggaagtgatgtctgatgacctggttcctcaaaacaaacaaaaaatggattcactctatttccctaaccaaacacaaagaaagaaccatccgatcctctgatgacctggttcctcaaaacaaacaaaaaatggattcactccattttcctaaccaaacacaaagaaataaccatccgatcttgtgagaaatgaatccattctggatcaactggttccggatagagtcaatcctctaaccaaacacgccaaaagttcttcggtagtgcctcagtctaatgagatgatatcatattacgttaccatgttttctcaagtaggttcaattgtcacaaagatggaccataatccacaggaaaaagatggtccgtaatccagggctggcaggagaaattcatatcgaaatttggtaaataaattagtataaagggcgtagcacaatccatcccaacctataccatgtcctgttttgatgtcacaaagggattatgtgatgagctgagtataattattgggagatattggtggagtcatcaggaccaaacaaataagattcattggctgagttaggaaaaactttcgagaacaaaaaataaataaataaataaaaataaagggtgcctcggtttcggcagttacacctatttaatatggctatgttgaatcgacaagcaaggagatcgcttacctatcctaattctcattgtgctaaggttttaacgcctcgaggaacaaacatcctatctaaagtgagcgagcatattaataatcttgtaacaggtgtgttgggatgagcaacttataggagaaatcttttggctgaaggatgtcagtgagatcaacttataggagaaatcttttggctgaaggatgtcagtgagatcctaagaatcccaattgtagataatttggagcattggcatgcatggtattttgacacaaaggtctgttttcagtaaaacaaacatcctataacttaagtgaatttggctttc

SEQ ID NO: 3479 - DNA, 1334 bp, Zea mays
  misc_feature (1)..(100): optimal_loci_163706_G1, chr4:195553031..195554364, Cluster 21
ctacggaaggttgatgtatcaatcgaggatttgttccttttaatgtgctaaacgatttgttccatgtgacatgttcaaattcaattatatagttcaacttgtaaccaatttttaagtgtagggttagtattgctatatcatccacattaccacatctaggactgattaataattatctccacgtattgtccttagttgttgttacaaatcgaaggcagtgaattgagaaaataatctttgtgagagaagcaacaaatgcattatgtttataagacattccttttagttctagaaaacaatgtcttcgtttatctgtgacaaatggaacaaatgaaaaccatgacaataataaacccaaaatagcaaaaaaaaactcacaacccaagtatttgagctcctcatgggtgaaaatctgaattactcgtttatgagtagaaactagctagaatcttgttgtctcaccctagacacatcatagtgcattagtacctgtataagaatgtctaggacttgattgttctatgaccccaaaacatctaaaactagtgacctaaagctcacaaaaatggtgaaaatgtgagaatctattcgattgcatgggatgccaaaaatctacataagaaaatgggcccaagaatgataaaatgtggctgagtggtagaataaaaaaatcctagtaataataaaacctaaaatagaaaaaatatgaccttggctatttgagctcctctcatgtgtagaaaatccaaagaactcattgtttgtgagcagaaactagctagaaaaatgttgtatcggatacaccctagtggccttaatagttgcctaagaatgtctgagactcgatagtctggtgtctccggaaacacataatcctagtgtcgtatagcttacgaaaaacagtgaaaacttataaataggttcgagagcatgtgacataaaaatctacataagtaaatgggcccaataaaaacaacatgtgtctgagtgctagaacaaacaaaaaatcctaggaactttatgagcagaaactagctagagcagaaagtagctagaaacatgttgtctcaccctagatataccatagtagccttaatagttgccaaagaatgtatggaactcgattgttccagtatccctaaaacacttaagactagtgagctatagcgcatgaaaagtggtgaaaacatgagaatcagttcgagagcatggaacgtaaaaaactacactagaaaatatactcaaggaaaacaacatgtcgtttagtgtgcgaaaaaacaaaaggtctatgaataaaaaaaccaagatcctaggtatttgagctccttgtgtgt

SEQ ID NO: 3480 - DNA, 1065 bp, Zea mays
  misc_feature (1)..(100): optimal_loci_172656_G1, chr5:1866625..1867689, Cluster 21
agtgatgagggagaaacgatgattcaaataatattggtcattaaatttgagtgggtaaaaaaagtagttcccgttagttctgatggcatgtttatacgtgggtacaattgtttggcacatttaggagaggttatgagcgcgagagtgatttcgttggatgggttttataaagctataactgatgagttatatagtggtatagatatatataaaaagagtgacgatatttcggctgctaggtatttagttattttcacgtttgattatattgctagtagtaacgttagaagacacgtatgttaaaaatataccctcttcattgttcaaaagattattttgttttgacagatattcatacaacgaccacatcggagtagtgataacttagggtctatttggtttctctttggatccccgattaaaacatttactaaagtaattaatgttgttcaaaaggaacaaaattcgtatctaaacagtgtcctaatgattcttgttagtgtttcttccccatgcatgcatgcatgcatgctccatgccaaatattatcaaacaccagatacgttcccgttcatcatcaccattcatatgattgcaagatgcatgtatatatgtaaaggcggcacatggtatgtatatatatgttaaattattagatgcatgtatgtatacgcagattacacatgatagacggatccaaatatatacaaatcgtaagttcatctgaacaggaattgaaaggctctatgatgaacgaactgaatactgtatataagtccggatcgaggaaatggaatacaagctcactgggaatgggaattcacgtgctctccatgttgagggcaaaaaggcgaatcatgcacgtgtggaggaccgacagcgagattgaaaaaagggggcaaatcttgcacatgtggatcaataccgacaacgagattgggataaatggaaaaccaataaaactttcgctcaatatgttcttgactgtcgtttcaacaagaacatgaaaatattatttgtatcatttgcactgttttataaaaatacattttgcactgtagatta

SEQ ID NO: 3481 - DNA, 1112 bp, Zea mays
  misc_feature (1)..(100): optimal_loci_178120_G1, chr5:31558491..31559602, Cluster 21
attttgatctctgttggagttaattgatatacaattatatggtgcaagcttttttttattaatttattgtttttgctatacacaaattagtatacacatgggtatatatcctacgagataagatgtaaacaccctaatatcttattttgggatttaggaagaattttccaaaaagattaataatttaaatgtccttaataaggatttcttttcctttggattcccctcttaaaatgaataaataataataataataataataatagaatatttgtagttaaaaacttagacctcaactttgaaaactagattttcacttggaaaaaagagaaagccttacaattcatttgccaaggtggagtatgcctctcatgaattatatacttacaaatactctttaagaatatttgaatgaaagtttctcttgataagagattacacatttaatttttctaaataaacatatgaatatttaatattgataagagattacatatttaattttgtttgaattaaagtttctattgataagagattaaaccatataatgaaagtcgtcaaggacgctcactactgcatttcaaccctagacgagagaggagagcgccgtgacggaccgtaccttctgagtaacctatcactcatctttcacagtcaagtataccctcttgaagaaaagatcactcgctctgacctaacaattggttaaaaacttcagcaggtgcaccctattgattaaatcatattgtttttcttataaaggttgtcccccgtttctattattttcatattgtatggtttcaacaaatactcaagaagaaattcatacgtctggactttacattatattataagttccctgagagcatcaactctgaaaaaaaacttattttagctatagataaatgtcacctcattgtaaccccagagagtactatatataacaccctatatgttatgttacacacgtgtcgtatgtgccctatttgcttctacaaattcatcatgaacgcaagttattgtgatccaacaactatatggcccatgatgaactcactcaaccttgtgtgcaaatgggaccatatatgtccggtctcctttaatttgtccca

SEQ ID NO: 3482 - DNA, 1228 bp, Zea mays
  misc_feature (1)..(100): optimal_loci_186743_G1, chr5:87912915..87914142, Cluster 21
atggctcacacctccaaatcacggtagtcgcaacaacactctagtggcgctggcttggacaaaggcgagtccatctgcaaaagctagacgaagccacaaagacaacaatcttggatcatggtgtgtagaaaagaagaagttgttgtgagggtatattcgggagattcaactccctctttgttcgaggggtggagagtttttaccatcaaaaacaaagaaagttatcaggaactgctggagcaagaaaagaagcatatcttctctaatatgacagatatataggaataaagagtctcattgaagaactgttgaagatgctctaacaatcatcttgtacggtcagagcgacattttgttatcatgaaatagagtgacatgtattcactgaagacatgttaaatgcaattaaataacaattcaatacttaattagggtactctcatcaccgtaaaagagagcaatccatatttgaatcaaactaaatgcacttaaataaattaagtcacattgaactgtaaaaagcagtgtagcctataaaaaaacaatagcaactcccatgattaatataaaaatgtattatatgtttaaatgcttccaaataaattctatgattaatgtagtagcgctgctactgctgctgctactaataataataataattattattattattattatttaataataataataataattattattattattattattacttcctctatccgagaaaatgatacacatatttttgttatgaaaaaagtcacatatgacagctttcggcgattaatatatcatactatattttttaaaaaaaatcaataccatcacacgatcactttgaatagagatctatttcaagcaagtattgtgtcctaaacttctgttagattcgaaaagttgttggtcaaaatttaaatacgtatatgactatcgtttgaaggcagatggagtaaccggtattagaagcatcattggtttttttagagatttaaagccagtttagaaagttaaatctcctcggagaatctatgagattaagaagggaaatgcctttattttctcaatctcatggatttccggtggaaatttaagtttttaaattagctcttagttagattttaaattatttaacggaaccccacatttttcccggaagaggttcttcttcaagcgaaagaaaaaaaacaaaaaggagaaaatttttatgctgcaacatcacatc

SEQ ID NO: 3483 - DNA, 1092 bp, Zea mays
  misc_feature (1)..(100): optimal_loci_192638_G1, chr5:131563124..131564215, Cluster 21
tcgtgtccgccgtacgttcccaccgcaaacttttcctctgcttcacatggtctccgctatacgtttaggcagcttaaaaaaatttagtgaagttggtggattagatcattagatgctgtaaaaaattatagagttaaagttgtaagtctttagaagacatttagataaaccattttatttattatttagattaaaaatatttttaaaaactatttaaattgatattataaactatagtttcacattggaggtggaagctagagccatgctaaacatgcttttagctgttcaagcgcagttttgcctgagaggattttgtgctcgtaaatctcagttgctcaaattggagaagcgtgttagagtttggtcgtatgccttctctgccttaggaatttattgttctgtgttatgtaaacatgcttgggtcaatagtactcgctctgttacaatttttaatccattgcccgctcgtcttattcaaaaaaaattaaaattttcgtaaatttttttaacaggacgagccggccaaactttataaaaaatcaaataaattataaattataaattgggacggagggacctggtttaattttctgctatacacattaggtgccatctgatttgtaccgaactaaacatgtacttgtgaccggtagccactagccagcagcacggtggtcaagtcattatgacttcttcacctgcctctcgctacggctgggttacgctaatgagtggtcaagctggtgcagtgttcatgtctcctcgattataaattgaccactgcgattatagctgcttccgtgtccatcatcctctgccctacaagaaactctactatcacatcacactcgtactaccagcgatcactcttttgtagattatttaaattcgggatttcgtagtatatgctattaaaaaaatcgtttacattaatattttggtgtaatttgtagatagaatccatgaagcaaaaagctcgagtgtggtgtagaaatatttcacccaatttttactacacattaaatttgggtgtataagctcacataatttgagtgtaggagataagttttgcatggtaactggcaggga

SEQ ID NO: 3484 - DNA, 1154 bp, Zea mays
  misc_feature (1)..(100): optimal_loci_202126_G1, chr5:186231963..186233116, Cluster 21
ctttttgccgatggattcgtaacaacatcagttttaaattacctccacaccttgcaattaaagggtggtgttttctacctttattttaagtcaaacaccatataaagtttaactaagtttataaaatacacatacatataatattaaataagtgttcttgaattcatcaaattatatattaatgtcaaatgcgctgatactctttacttagttgaactaatatagttttgcttataacaaaattaagatgccactttatgggacgggaataatagttttctatcgaaattggagatattacaatttctatcttcaaactaatttcgtttctagtatatacttcatataacaaattgaactcttataggctatatatttgtgaaaatgaaaaagatctttacacaaacactttaggacaactattacttttataaaaaggaaacgcataattagtgcgcatgtgtatacatacggaatactcaattaccgattaccgataacttatattatggccactttgagttaccataacaactataccaatttacaagattcttgtaactctttctaaacgatttattgtaacattatatgatggtatactagtagtaattaacacaccataaatttgtacaaacattatatatattatatgtctatgaacagaaaaattgtcaaaccctagtagaaactatataattatttatgtaagctttaacattctttgctctgctgagtgagatggcacaaacgaatccaatagtagctttggggtgtgtgtgtgtgggggggggggggggttgcataattaattgcccgatgtgctggtttttataagtatggtggatccgccagtgaaccatgttgcattgcacgtaagagctacttgtatatatgttattacgtcaatacaatattccctctatacaataataatacagaaaatgcaatcactctatcctccaaatatacacgaccagcaaatatttagtttcagatatgacatatatgagctatagaaattaattaaccacttgctattttggacgcttcacaaacttgggcagcactcagcagactacgcttattgatttaattaaagtacacacaagtattttaattttctaccaactaccccctgcgtccgaaataag

SEQ ID NO: 3485 - DNA, 1069 bp, Zea mays
  misc_feature (1)..(100): optimal_loci_203330_G1, chr5:192875930..192876998, Cluster 21
tatctatttagtctctgtataggctctgatccacattgttcggatcctgtgtaacctcctctccttaattgtcgtgtatatctgattgcatgtgccgccagaggcctacggtcatctcggctccttctgttgtactttgcctatttataggaaccattgaatgaatggaacgacagcagagcgacagctttcagaaatgacaccaacagaagtgacatacatgtaaactatacagtgaaatgaaagcacgtacattagaacacacttacttggaaggttcctcgtacaaccttcaatggccgaatcatcattgaaggaagttcaataataattcgctcattattagtcttgtaaccaggtgtaactactgtggatcgaatcaagttgcgaacaccagaaaagtcagaacttcttgaatctattgatcctgtaaaaatctgatcagttgttgacgaatctgtcagttgatcatccacactgctgcagatattatcactttgtctctgcacaatttgttcatgtacttcatctactgtaatcaaagaacttgcaggaagaacactaagtaaagagtctccatcttctgagtggcatgcgtctgcaccatcacaaagaaacttctgctccacataattagcagaagcacccaagtgattcaaccaattgtagttccttttcataaatcttctcattcttaacgaactttcagttaagtctaacttccagaaaatctgtgtaacagaaaaaaaggaaaggcgcaaaatagataagaaaacaaaattcatgcatgccatttagctttacagtgcgattttttcctgattgaaaaaaataaatggttcaacatcatcataaagtgatcagaaaggagaattgcttttcataataatgtagtataacaaggaagtgtaaaggaaacacagaactgtgaccatacactatcgggactacagaggagttctccaaaaggtccgtagagtctacttgtctctatcaagcagtgaagaagatgctgccatgcccgaagtccaatagacatgcaactgcggttcaatatttcgacttgtgt

SEQ ID NO: 3486 - DNA, 1023 bp, Zea mays
  misc_feature (1)..(100): optimal_loci_203333_G1, chr5:192881369..192882391, Cluster 21
gaagtctcgagttagaatcctgattagcacaattaaataaaataattgttgctcactcttattccacatctaaggcctgagagagcctcaacatgaggagtgttaacatatcataagataacctactagctacagacattcctgttaattaagaacctacaagctacaagcagggtgttcggtcataatgcagcctcttcagaagttcatgcttggttcccgtaatgactaagggccttactgattacaagcttaaacaaatagtattgtttattgcttcatgataagttgttcctagaagttggacttcaatcttctatattatatattccctaacaatactatagtgcttcttacaaactaaaaacatttagatgacaccagcaaattcaccgatactcaagaacatagaaagaagtttgacatgtaatgatgtaacatgatgaaacattgaaaggacattctagatatacatacatcaactggaagaccaccagcatcacttgacaaagactgtctcgagtccccagcttccaaatgctcactgccagttctactcaatgaatttgacctactgacagctgatgaagccattgaagcaggtgaggcagcactatcagctaaacaggccatgaaaaattgttgactgcgtgacctcaaatgatcttccacaagcatcagcagaacaactgcattctcagccaacattactgagagattggcaactttctctgcatgtacttttgtttctttaggcactaaaccctctgctgcaacaccagctgcagcagcagcaatcccttcagtttgctgtaaagacaaatagtaaaagaaatcattgatgtggtgaacagagaattattaatttcataattttaattaacttatgagacaccatttgttatgtcatagtactgaactgtgagacatcaagacaagtgtaggtcactgcattaagagtatataacaaccatgatctctagtaatattgttgacgatggaaatgccacagcaatatattac

SEQ ID NO: 3487 - DNA, 1156 bp, Zea mays
  misc_feature (1)..(100): optimal_loci_203668_G1, chr5:194569550..194570705, Cluster 21
ctggagcaccagatgtacaaagatactacaaatatatactatggcacccgcaccgactagacgtctgcatctgctcctacacaaacacaagcccaaagtctcgtgtttgtcgtgcggtttctattaccctttgaataacgacccattgcctcgcgcgatccttgtctagggaattgatttgttcctttcgccccttgctgtttgaaaaaccaaaggttttctcattaccaagttgaacttcaaattataaacatgcatgaaaatatatccatgagccaacatggataatcatctgtacaaaatatcacggtatattttgaatatccacattaagatagaaaaaagcaatgtggctgatggatggattgtgatctttgggggatagaacacatgagcactaaggatctattttgttcagatgtatattcatgaaaaaactgattctagctgtgtgagatgtaaggaagttgatgcgagatgattgttgtggaaaaactaaaatatacgtggtcgaataatttacgatagtttcgtgtaatacggatgacactatatatagcacaaatttggaaaatctggggtagtggtgatttcgaattaaactacagaaatctatttagaaacctgttctgttgttgacttgttgtacccatttgattgcaattacaggtttttaacagtgaatttagtttaaaaaactgaaccaaacacgttttaaatagacggcttctctttgtatacgggtgggctggctcaaccagatgcatccaacttttctagactaatgggcttctaaggaacctatttagcccagtgagcttctaaagcggcgtttaggtatccagtttagccctattgctcacgggcctcagtatctttaccttctccgataaatactaatgtgggtgggctgtgaggaactccatccactgcgctttactacattttacgaaaaattgaacaggcctacgctacgcgctcacgacacgagtactactcctaagcctctactctagcagtggatcgggttttattaggaacggaacggaatgggccggagcgattcgctcgttggggtcggcacttcgaacaccgttgagacgctggcacccagtcgatcgtgttaagtaatactagttaatatgtgggtaaatac

SEQ ID NO: 3488 - DNA, 1345 bp, Zea mays
  misc_feature (1)..(100): optimal_loci_2065_G1, chr1:10837095..10838439, Cluster 21
ttttttgcttctataactggagtcttgtcatcgtaccccatgtaccacttaggttgatgatagttgacgaagagtgtgccacatgtgctccaacttaaagttggttttatcaggcttgtttcggaagctcttcttggctgctcatgcagcatagcatcatctgctccactcagtcaagttgtatacaagtggttgtagattttttgttgaagaggatgatcttccggttgctctcgaccactgatccttcaactacttgggtgtgatagcaagaagcttctatggtggagttgtaggtgatggctatttggacccaattggctgatacattcttgtcattaccatcaatagggtccatagagtgcaatagaaatgcatggacctataaattttaaaactcagaaaaagaactatcaacctaaaaaacgtgaaattcattaaaaaatgtgtgtagacttagggacaaggatggatagaaacatcctttcgacgatgatgtacgaaagaaaggtcgtcgaagaatacatgtccacactcccactggcgtgggatccatattggaatagagtgggaggctacaataaataaatcctataggatattagagaaccaatttaagggacagctcgaaatgaggtatctgtgaagttccaagaatatgtaatagataaaattgattaaacgaagaccggtgctagctttagaaaagcatgtcaatatgtagccgaattctcttgactgcgataggtatgttaacatatgatcttttatctcgtgaatttctgcctcttacaatgtcacattctaggaaatcctaaatgaatctaaagatctttatatctaagactgctctaatttatcgtattttcaaaacttaaaactaaataaatatatatttcacatgttacctctggaaatgatagaaagttaggaccattatatgaatatatcttggcatttggcatctaataatgaaagttcactcgctcaaactgtttgctttacctgtactacaattttgccgcaaaaatagtacagtactattactatgttcatctagaaaagaatataattctaaatgtatttttagtcacagtgtttaaaagtttgactaaatatatatgtataaacataaaactttactagtttagttgccgtgtgtcactacatttcctatattattcacaatatttacaatatctatcttttatagaacacaaattgatacgagcccggtgattagaaactgtgagtgggggggtgagggccaccacaatttaaaccctagatagcaccacactcatttttggatggattttgtcgcgcgtggggcgagggaatcgtt

SEQ ID NO: 3489 - DNA, 1274 bp, Zea mays
  misc_feature (1)..(100): optimal_loci_210577_G1, chr6:16278839..16280112, Cluster 21
ggatggattccggacgatagaaactgctaaatactagtgactggcgcgcgccaacgcgcgcatgtaagcattgtaatatttattataataatattataaaaatacttttttaagaaaatgactgaataaagatagatggtaaattacctagcatatgttgttgattgacaggaacaaaaatatatctgattttaggttgtaacggttaagaattgataatagatagtttatcaatatttgagatatatacatagatgcataggcacaaaagattgtctcatgtagctaccattaaaaagaacatataagtctggcataatattcatggaacaaacactgttttgtcacatatttacatctaagtaggttgattatcactacatagtaacaaaaaatggttgtcacatatttacatctaagtaggttgctcatgactatatagtagcgaaagataattcgaagttactgatctattatttattgaatggagcgatcatggagtcttgctagcgtggcactcatccaatttgtagcttgaaccaagcttcttgcgtctacaatagaaaattaaagttaaatatttgtaaacttaattggtacatagcaggtcattactttagtgatatataagagaagatgtgtttcagtacttgttagcatgcaaatcgtaagcatgataatttgatttgtatgtgagcagttttgttggaagtattattgcaatacaaaaaataagagttgtttagaaaggaggggcaataagatatatatttatataatagaaggaaatttgttttgcaaaaactactattgcaatgcatgttgttgtactccaatggtaagcgcaggtcttagtagtgaaggtgaagatttgagttgaatgtgtaatgaaatgaatcttgaccaagcagcattttccgtgaacaaatatgtagaagttaatgatgctcgtgtttccaaaccaaggattaggatttactgtcaaataacagtaaacaaatcagttagcagagaatcatacaaatttaatatttgtagtaacatgttaagtgtgcatcagtatgaacgcaatgtgttaggaagttataaaggaaggcttaatggaacaacctttatgaagcagtaaatttctatgtaggtctgcacatgttaataaagcatgtattgtgaaacaacagtttagagtatactaccaaaaaagcaataaaattaaaacgttgtgtacaatattatagaaaaatgaatattggcaatctccacatttggttatgatc

SEQ ID NO: 3490 - DNA, 1108 bp, Zea mays
  misc_feature (1)..(100): optimal_loci_211853_G1, chr6:25281535..25282642, Cluster 21
catgactcaagaaccgcttatataattcttggcattggccagagctttgcaggaaccatttacggagattatgaatcggttgctttgctagttcaatttcctcaaccacatgagatccccgatgcaaaattcaaacctagctactgctcccacgcatgcaaaccaaataaactcgagaaaaattcctcgattgcctctgaaacttgtaacaatctctatgtcccatccaaaagtatgttccccttcattaccatctgatcatgttatccatgcactttggtaccattttttgtcaatccatggtttaatgttgtcatggtgtatatcggcactaacgacatcttgcacggtccgagatgaggtataaaggggacatgagaaggataacttgaaatagtcgactctagctagatgcggctgcgcgcactagtgaaaaactagtgctgcataaagaaaccaaataaaaagcacgtggaaaacacattagcataatctgtagtagcacctgacacattttttcttcattttcttgtgaactagtaactagatgaaagtaatatatattgctagtttattaaactcaatcaatatggaaaaaagccgaccgaaccgtaaagatgaatctagagaatgaagaacaacacgcgtcgctatagagaagcggtgggatgcgttggtagcatgttgacaataataacattgtcacggatcttagattcgaactgtcagtaagacggaggtgtgggtaggaggtagaagatctattttcgaatcctttgcgcaaaatagaaaagagacatgaaaaaaacaatagcaacgcaatcattattcgttacaagaggtagtgatttagagcttgtttgaaagcatttagtttctaaataaactaaccagagtggttccgaatataccaggtcatatttcattttatggaaactggattctcggtttcttaaaaatcaagaaggtgagctagtgattaagtataaaaaaactagaaactgagtctcaaacacttacatccaactttttttataaaaatatttttttagaaattgaggatagaaacgagtttttttaaaaacccagcagacccttatattaaaaa

SEQ ID NO: 3491 - DNA, 1137 bp, Zea mays
  misc_feature (1)..(100): optimal_loci_212593_G1, chr6:30095954..30097090, Cluster 21
gtgtgggttcaaacctcagctcttgcaccgtttttaatattttacactgagttgatttggaagaaatgtagtgacttttttgtaaaaagatgacgcggaactatcgttgaaactggtgctttaagtatagcagagacatataaaatttagttttatgaataccaatactctgacaaaactgaattttcgttggatcctaaaccgcgtgtgaatgtgatccacatccttcagtaccgtttcccacattttgcggcagtgtgccgctacggcatgctacacgctacactgctctggtcagtgtacgtgtgttgcacatatatgaaggtagtgaatgcaaacccagaagatcttggggcgaagctactaattaacttccctaacgtaaatactctttgagtcttgtcaagttgtggtacagaatggtacccacacacacacgcgtatattataattatatatatgttaaatgtgcatggtagacgtcaacacaaactatacgatgttttttaaatacagatatatagtacaaatccaacaatgattatgacgtactgaaccacacaatctgtgccttttcgtatgttagaattgctctcgaccctagttttgggactctaataaaaagttcttccactattacgtgatttctttattttgattaatatgacatcacatacttactacgtactttgttccaaaaaaatgtaacgatgtaaattagctagaacgtgcgtaggaaaaaactattggtcccacatgtttgagctaatgcttaacttcgtgatattattggcctagctacccttgtcgcaaagaatataacctaacagagatgggcgcggcaaaaaaaattagaataagaggtctagatgagatggacaacctctacttcttggagcgtaagacattgacaaatatgtttagtaggaaagtatctagatagctagagaaggatgaataatctattaaaaattataaacttcacaacacgggtataaagagggttagtaaactaactagtcctaatagtctcgatttgcacaatcactactttcacccaagcaaacatcctacacaatctagtagcactattttctcattctagtcacaagcaccaaactagagctactcctagca

SEQ ID NO: 3492 - DNA, 1083 bp, Zea mays
  misc_feature (1)..(100): optimal_loci_220783_G1, chr6:84664173..84665255, Cluster 21
ggacatgggcctcgagagttatggtcccagtatagtgggctccatgataatttattgtaccaagatctttgaatatatctttacgcttgctattcagatggtggcaactcactcttttaaactttaagctattctaattttcttacagagccaaaagttcttaattttaactaaattttgtaaaaaacaatatatatgttaccaaatatattattcattaaatatattctcatacacatatttgacgttgtaactttatcattctttctataaagctaacattttacatgggtgttttttaggcagtagtatcatttgaccctacaagtctaattacatgtgctaacgctacgatcccagggaggggaggggaggggtatggaccggtggcggtggcgtgagggagggttcgacaacgatgatggcacgggtgatgggaggaggaggcggggtcgctgaggtgggggcggtgagatccctaagagaaggagcgagagggagtatgatccaaacaacattgaacattggatctaattgagtaagagagatgtatattaatctagcgatttgaatcattggttataagtgtgtgttatttgtaggtgtaatttttttggtggatgcagaaaggtaatgggtgtgggagtgattttttgtcatgaagccaataccgattagcagcatgcaggcgaatgaaggactgaagacttcggtggatgctgaactagtggagccaaagaggacgaggaagcccagctcagcgtattttggactagacttgtctgtagtggtccgtttgcgcccgagaggagatagggtatttagggcttgtttgggatcaaaggtaatgtgagggattctagcccctcaatcccctccattaccctttattccaaacaagcccttagtgtttcctgtacggtaaggagtgtgtcatggtgaacaagacgctggttggctgcgtccaaagttcttctatgttgtaatctggacttcgtgagaggcctgagcacatagagcagtgctcatcatcataatcccacctaagcatattacattttggttgagtgtgtttaataaaat

SEQ ID NO: 3493 - DNA, 1031 bp, Zea mays
  misc_feature (1)..(100): optimal_loci_224166_G1, chr6:104448229..104449259, Cluster 21
aaaaagacgatgcaatttggtggtgagctggagctcagatctttgttctcacttaggtcatcgtgggttccacatgccaatttggttggcatagtttggaaaatgtgctgcagacgagcattaacaaaggaactggcgaattgctgtatgcctgtatcctaatgtaggcgcacatagagttcgttgtcgccattatatatatgtttatctaaaaagtcgtagtgcaagaaaaaaatcgtaatgcaagttgcttatttatctagaaaatgtaatcgtcctactttccgttattctcaatgttcgcttccaacgaactgaatctctgattgaacagggcggttggcatagtacagctctctaagctgattaagtaaaaggtttacaagctgatgtacagctctagtgctggtaccacttggacattcgttaatcagtgaaatgaaacacataatgtttggttaggcttaattactagtttactactctgtgctcatgcttgataccataaattgtggctattctttgagctatggaccactgatgaaacaatcaaacgaggacaataaaaattggaaggtccatgcaggctggaattgaggtgtccatagggcaaagggcatgtttaggagaaggggatttgaagagcaggaggaatccacttctctgaaacaagctctaaaggatgatctgcttgcatactaggattatatttttgtctgtacaaatgtccttgctgcttcacctctagtagcattagataggttggttctaatcctacaggtctctcaaatcagctattgatcatattgttgactctatcaattaccgtctgttcacattggttttttcttttacagattttttacataaaacacgtcgttttattgaaataaaaatatattcgactatataaaatctacatattcataaaccacaaataaaaattacatgatttatataacatacataaaaatcacataatttataaagtgtaagtaaaaatacataattcatgtgaattttaaggacta

SEQ ID NO: 3494 - DNA, 1111 bp, Zea mays
  misc_feature (1)..(100): optimal_loci_227301_G1, chr6:121325651..121326761, Cluster 21
ccagcgtggccaaccccacgcaatcgtcccccacattcgtgaagagttcacaatttttcaattaaccctagagactcattaaggaaccctatatatattaaatggtgttgtatatgccctttgtgtatagagagctagtcaaagtaaaagattgtaccgatttgcttaaacctaattgctatagcattaagaccgctacaacaacattcgctcatcaacacataaccaataaaaagttgatgacacactaattaaataagcaatattagtgcatgtacaacctagggaccctcgataggttttctatgtacaatagacagctaagagacggcatgatgcaacctcgagcctttgatgcacgaatacaattaagagacccacaacaccatatgtatggagattcatgtagagacggattccatctcttgtatttttttcaattaacccctatagattactcaaaagactttatattaaatataattatatatgccctaagttatagccattgtacaacattcactgccaagcacaatatcactatctcaatttcaagttataagaccatctccggcaacttattcatactcatattcatattcaaactacaatctacaaataatacaatctataatacaaaagatatttttggtgaccatatgtgtgaactattgtacattgcacctatatgatcattaaaagcatcgttttatatcactttacattatatattgtattgtttatatagtgtagtttgaatattggtatgagtatagataagttgctggagaaggttaagacgttctacaattttgaatagggagagtaggagacgttgtgactctagcgcctaggagaggagagtgccctcccgctttttattatgaagcacaaaaattatgtgactgattcgtaacttgcttcttcgacgtcgagcattctagaggataggatgactggcatgccatgccatgctttccttccggggacgaacgagaattctgttttttttcccctggccgaacggtgaagcgacgaatggaatggaatggaatggaagcttttccgtgtcgaagagcccgaaaggggtttggcacatgtcccctccggc

SEQ ID NO: 3495 - DNA, 1053 bp, Zea mays
  misc_feature (1)..(100): optimal_loci_227473_G1, chr6:122079518..122080570, Cluster 21
ctctctatcccctttgtgttctttacttttacaacacttatttgctcatttggtatatctagggtttgatatctagttatcttcgctatattgagtgttgtgtctactagttattagattttaccttatatcaatggaaatagaaatttactttatctacttgctacacattaactttcaagtgaagcaagcaacttaggtttgtgcggcagtgccatgcattgtccagaagtgctaggtcacggcagtgccaggtcgttgtagtgatgggtgtcaagtggcactgttgcttggttactactaagtgtttaagctcaaatttgataggaggcacatattcaccccaatctcgatgtactagatccttacagtagttgccaactatgttgtagttgatgatgtggacgcttatactcgccattgtgacatatcacattcactgttgtggcacattgaaggcatgctccatgtatgctacaaatatgacaacatatgattagttggttctttattgggtagggctcgctatccatatagggacttaactctcttttacattgtgctataaataaaggtgtagagtaacataataaggcttttccctctctcacttttggagtcttaaggtttctagacttcactttctcaatagctacgcgatacatatagaaagagctatcgtacgagtctgagctccctcacccaactcagtagtaaacatcacaatggacaattagggctctccttacttgctagatcagacatcatctgagcatacattctttgtccatatttgcatctaaacatcaaaacacatacaagacgtatacgcttaggtggcccaaacctctataaatcctctatatgtatacaaccatgtcgatgccttattttagcaatcttagacctacccctctatgtctctagttttctctgatactcttggcactatgttgtagcaacatgacaacaagatcctatttcattatgatggacgatgtttgttcatggtagccatagccacggggacgagttcatcgtgttgggtaccta

SEQ ID NO: 3496 - DNA, 1080 bp, Zea mays
  misc_feature (1)..(100): optimal_loci_227900_G1, chr6:124472498..124473577, Cluster 21
atgagatttgcgggagggggaatgacagcctaccgccttaataatagagaagagatttaagaaaagaaacatatttttgagttatgcatcaatcattaaaatataaaaaaaacttaaaacggttagtattacgatgaacctcacttcgattccatcgatttttttcttggaattggtttgtggtacagaggcattttagtcattgacatcacaaaccgcttttctgcctttttgtgatggtgaatcaaagaaccattaaccatatttaaaatgaaattgaaaacaaatcgaaaaagaaaaaagagtagaattcacaggaggaagagaattgcgaagggaaaaatacatagttaacaacaactaagggtgataatgaatcatgatctaaatatttctttacagtaaattagaactttcataatttttagtttaaaaatacataaaaatatagatcaattttaattcaattcgatacataaaaatatagaatttattatcattcctaccaacaccatactatatgcatatgcaaggaggaagagataaaagggaatctgaaaacaaggctgaaaataattgctcctatggtacacgtacaccaaaaacaaagcttggtatcatttttttcgagattcttcttgtttggttgagattgagatgtcaaaaaagctgatgttaaccgtgaagtgtcaaagaggtgctataagctatgtgctatgaaaaattctaacgatttttttcatggaattggtttgtggtacaaggggcattttagtcattcacatcacaattctaacgattttttcatggaattggtttgtggtacaaggggtattttagtcattcacatcacaaatcgatctcgcttttccgcctttttgtcacggtggatcaaaaaaccattgaccatgttacaaataaaataaaataaaacaaatgatcgaactctgaacatatgcatatccacatttacattcgtttgtatgcatccgaacaccaccagcactgctggtggctacaagaaaattctgcaagccactgtagtcttacacgcagggtctgcttctgccgcacgtagga

SEQ ID NO: 3497 - DNA, 1195 bp, Zea mays
  misc_feature (1)..(100): optimal_loci_228254_G1, chr6:126085629..126086823, Cluster 21
gaaaataattatcctcgtcactatcattagcttgaagaataagttgatcatgtgacagaactagcataacgggttaaacattaaccactagcatcagagcagcaggctatgaccaagttgaccaaccatttgttgcccctaattgttgcatgtgcaacttctagattctaattgactaaatcttctagattttcaccctcatcttgcaaattctcatcatcatctagaagtggatgtggattgccgttggggggagctcatcttccgaaaactcaagcatgcccaaggccattacccattggacaaccattaacgatgttcagcacataagtcagaaccgaccaagaataaccacgaccaaaatgatcatcctcaaaagatagaacaatgcttcgagggactttgagaaccgagttgtagaggcatttgataagcacatatgacttaattattgtgctattatgccatctgattaaccttccaaaaagaagccactgcttgattaatgtagatgttgtgcatgacatgtagagggaaacctagcatataagagatgctctgcatgatcaatcagatgaccattgtcatccaccccattctggtatatgagatttccctgaagttcattgccctatcgttcctaatcaatcggatgacaatctcatccacttcatggttgttaccactcatcaaatgatccctttgaagtaaactgtccaactcaaaaatccctagcccaaacggctgcctagcaacagtgaccacttgaatcctaggatcatcttagataaagtcccaaaccaaattgattaacaattcgatgtcaacttgaccatgagcatcatccacatcaagcgcaatgatgaactcttctctctagttgtccagagcatccgtgaggtgaactctagtccttgaacactattgcaagccaccatcttcattttgcatttttggtggaatgtaggcttgagggtctagagggaagttcaccacattcgagagatggacagtcgctacaaagacgtgggtggaagatgatggtgtgttgagcggtcggagggaacaagagagagttggggttttctttatgcgggaagacgaacaattaccaatatcactcagggcttgttttggttttctagtattcaccccaatacacatgggttgagggggaccccaatcctcctcaaca

SEQ ID NO: 3498 - DNA, 1099 bp, Zea mays
  misc_feature (1)..(100): optimal_loci_229771_G1, chr6:132942122..132943220, Cluster 21
atcagactgtgtgctttggtccaatagtggtcgttgaactagtctgacaggtagtggctattgttaggtttgtttacaaaggtcatcataccttgagttatttggtacgatgatcatcagacttagggcatcagaccatactgttataggtggtagaatctaagtgcatcagacctgagctctatgttccaacgctagggcatcagatggtccaacgacccatagactacaccgacttagttccgatctctagttgacccttggacattaaatgaatccgtaagatcatggatatcataaccgagtccatttccttcatttttgtgtgccaaattctctaaataatagaaagagagtgtgtgttctccctgaaaggcatgagaaacaaccaatctactatgggttagagttttagactcgtatggtgagacatttggctcctccatccctgacacccacatgatgatgatggtcgaagtctagtatttctgaaagcttgatgtgctgcatgggttagggtgaatcggtttttggatagcgatcacatgactgcttatcgagttggtctgcattgtgagatctactgacttcaacaacaccgcaaacttatcttttaccatgatgctagagtgattctcattgtgactaataatgagttccttgctcatgcttatgttagatgtgttcaagatagattcaatccgctacgtagatatactttttattttcatacgtgtggtttatctattatttatgtaactattgctttatgaattaatttaatgttaaaagtttgctatcttctgacaatagaatgcaagcgttttctagtagatagttaatctttttgttaccttgtagttttataaactctctagcaggtggtacacagcttgcccgagaggaacttcgtctatgtactaatcattcaacgcacattaacacataagtagctaggtacctagataatgctaaatctttgtatttatttatataatcatagtggctctctgagactgttaagatattaagtggccagagacgtggagtactcggaacttacatcaataaccttttggtcagagcatttctatggggg

SEQ ID NO: 3499 - DNA, 1327 bp, Zea mays
  misc_feature (1)..(100): optimal_loci_231344_G1, chr6:140540627..140541953, Cluster 21
ccgttctcggttcacacggaatagaagactgaaatagttcttacccaaattgcttctttaatttgtataagttttgaataataggaacaatttttggtgcattcctgcagaaacgaacagccccttaggcatatcgggaccttccgatgccaccgggtcatccgagaccgtcgagacaatctagagttgttagggctcaagggcatcggggatatctgaaatcgttggagccatcgaagttgtcgttagggccctcttgtaccgttaggatcgtctcgtggtatcgccgtatcggcaccgtccaaaggtttcaacaatcgttaggatcttcgaggccgctagacgtgcgtgtgccgttactgtgtatgtggctggtgtacgagtatttctgtttgccacctgagttagttgaaggaggagtaaacatatggattgatggaggtgtaatggatctataatggacgaagtaatgtgcctgtgcgcatgttacgacaattactccatccttccgttttcttgaaactcatggcattatcagctatttcaatcacacaagaagtcacagatcagaatgagcacaaaaaaacatccatgacttctcggttcagttgcaagatagagttttctagtttcaatcctctacgtgcatagagttaggaggacatgactctgaaaccactattccgcattgaagacgtccgctagaattttagggagcgtttatgtgactgcttgctaattatcgtcttcttttaggtgttgttttgtgggacggcagtatgaatatttttctgcatcaaatatggtttgctaattcgaccaatgcataggggcggatctgaaggggagctacgggggctccagcccgctacatacatgcaactttatcggagaataggtcgagggtagaggagaaagaagaagagataaaaatgagcctccactccattgaagaaagaggtgggtacatcagaaagagagagtaagaagcacagagaaaaaaatgggaaaaaatgggttgtaccatcttgtggtgcctctagtactgatcactcgaaaatcaacccctcttgagcctaataaacctagatccactaatgtcaatacacgatatcaacttgtgtgaatgctcgataggtacattttgatctctggctttaaaaaaatcagtattatatatatagtaatagcatgtgttcgttatatattattgagagtagcacatgtatatacactactagtattacaaatacgcatgcgcacaatgattatatgaaaatgagcaatatatatattaccatcgaccttaatatcttataaattattt

SEQ ID NO: 3500 - DNA, 1130 bp, Zea mays
  misc_feature (1)..(100): optimal_loci_231467_G1, chr6:141057373..141058502, Cluster 21
gttgtagcggtttaatttagtctctcctaaattttttctagctccgcctctgagctcaggtaaaaaaaatattggaggctacacatatcaattggataccgcatagcatataactaaaatgtcatacacatgtacaaacagaggtggctaccatgccgatatttttaatattattatgcttcttagagcattctggtgctgctcacgtcgccgaccgtgcaatttgaccaaggcctgacacgattcctggggccatttgtttacgcacatctcgagagcagatagtgagaagaagagtccaaacataataattgcggagcatgtacgagacgattggagtgtcgctgaaaatcaacggtgcccatgacgacaatgcaagccctagctagctaacccaaaccctagaaatcgaagagggcgacctagaccggtgaaggctcgacgtgaatgtttgtttcggagacattcacgtgggcactacgtttcctcatctcttctcccgattaataagaaataataactagaattttaacctgtggttaaattaaacctccctactagtatacacatagggcacgcaggtccaccttgtgagtggacaactggacaatatgtcaatatatatacgtgaaaacatagagtaatatctaataatacaaatttagatacagttagtggtgaaatgatttttttgtcctagttctcctgctccaaatacatgttacagtagttactcgcccaaaaatgttaccttttcctttccattaacaccgcgatcgatgctattatttatagttcactagacacactactgcagaaacaattttaggagacagtttattatttttgttttctgaggcaggtacaaaatactattgtctcctaaaataagttacaacttttggatgcgtagatgctttatttacggagacgtaaaaatttgcccgtccctaaagaggatttagctaggaggtcatcctttaaaaattaaagctacttagtcgttcaaaaaatctaatgaacaatattatttggatcgtcacttattcatccattctcccataaccttcctctgccccctccacctcactggtgtcgccgctgccgccaccgtcgccgtcaaccactcc

SEQ ID NO: 3501 - DNA, 1052 bp, Zea mays
  misc_feature (1)..(100): optimal_loci_231516_G1, chr6:141225704..141226755, Cluster 21
atcttagtgaaagaatgtctctagcacgattctctaaatctaatatatggtttcactcatacaactcacataaatgagttgtgtcttgagatgtcctattgaataatagacaaggcttagatagagttgtatgcacgagtttcttatatctatctagaatatggagaaacataatatagtatttaggttgtgtatagcttgagtagaggactctttaactatatttcacaattgaatagtttgatgtcctattctcggtgctagtctcaccattttcatgctcaataaataggtggcacatcagcaaatatgataacatgaggagaattcaattcttacatcagcaaatacggtaacatgaggagaattcaattcttaccactaggttgatctaagtaatgccattaatcttaatagaggtccaagatatatcactcttaaatcactccatcttcatataatatcatgatagctactatttcatctttttatccactcttaccaagttttaacattaaattttacatgctttgactgatctgccccttactgtacgaacctagctgcgtgcctgtttgaagacataccattgaaataatataatataattagataaaaaaactaaaatattaaaacatatgaaaatacacaataccaaatataattaactaaattccatcctataacttgagtaaaggctaacacaatatttcaatattttagatacatctaatttaacatttcttagacaataaccaaacatctccacgacataatagtaagatctagaaaatgtttaaattagatgcatctaaaatatcaaaatattgtgttgatctttactcaaattatatgatggaattttgtgaattataattgttcttttaatctacttatattatagtatttgatgtggtgtctagatcatgttttttcttatgttccttcacaataacacgcaattgtgtgtttgtatagtgaaggacaaattggataaatcacgtgaaatttagtgttaaaacttgattgaagtggagaaagagagagattaa

SEQ ID NO: 3502 - DNA, 1365 bp, Zea mays
  misc_feature (1)..(100): optimal_loci_231942_G1, chr6:142957358..142958722, Cluster 21
tacgaaaaaaactagaaattagacagaaacgggtaatatcaatttcatccattcttatgggatcttacttttatctaattgaatccatatttatcccttatttgagatatcatatcctttatttgagatattagggaaaaacatattatgcattattacataaactaaagttatattcttatgtgacaaattatagcataattggacattctagtcatctcctctcttcaatgacaagtgacataaaaagcctcaaataatatcggtcatagctacatgtacactactagcaagcaatataacaattgaatgttgtctccttgtatctatttatttcacgttattatcctactagtcaatcaccaatcacccatcaacatcatacgtgtttgtattaaattacgagttttctgaataaagacaaatatcaggcgaccatgtacaacttagtgctcgttgttaattgtaattatatacgttgaacaaaaaaatatttactagatgatagattttgcaatacttccattaacacatatgtaccgacaccattaacaaccatgaccaggcatcttgctcctttgacgtggcaaaccgctcctggtcataggcatccacaaggtacatcattggatgtacctaatcagaataaaaacaggaaggttgcaaaccaaatatagaaaagcacacattattcagtaattgaaactaccgtgcagaaaacaaaatatggcaccatggtaactccatacgactttgatatctcatgatgttgtttagttgaaacctgaaaataagtcatcagtgcaataaatcaccaataagtaaacaatggtatcatcctaattttgttggcaataaataattaataattactagagataaaggagattgaagtaacctctgaatagaatgggcatatcaatgagaaaatgaagtaatgatggaccattgaggactgaggagaccaaacacggataggtgggagccaatcaaattttactgctgaacactgaaaataagcacttcacttcaattgaaataaagtaagcactcaaatcaaaatcgcatcagcaaattagtgatctcatgatttcaaaatgttcctaatacccacacaagatcagcaaaacaaatggatcgtaaatcggacaccgaaaagtctaaatcagtccaaaactgtgtcgcgaacgggtgctgatttcaggagcatgaaattttgttgtcacatgcaaaactgaagcaaacaaactccaattgagatgaaattctgtacacacctggaaaaatatgtttccaaggtctacacaatttttgagctcaatcggacttgtgaatcaactacagatctgaaaaaactaacaaaat

SEQ ID NO: 3503 - DNA, 1044 bp, Zea mays
  misc_feature (1)..(100): optimal_loci_232742_G1, chr6:147254418..147255461, Cluster 21
tgcttgaaaggaatttctcaaaagtaaatgcttaatgtaaagaaggattagaaacaccttgattttttgccacacccatgcaaggtgttgctcccccatgatcctagcacagaccaggtgttcgatctctacaagttagttattttcctctccgttgttgttgtgaaccactcacaaccgtgtacacaattgagtagggtcacccataagatctctagttgatcaccaaactcacgatcaccactaaaccaactaagtggtgccaatcaccaagggtaataaacacaaacttcccacttgatataatcaaggataatgacaataacaggtgcacattagctactctcaagtccctcactaggtaaaggctctttctcacactcaaatgggtttcttcggttgttagaatggcaagagagctataatggatgagttgggttgtatttataacccacatccgaccaactagctattatagtaaatattggagaaatttgtagttgtcaaaccattgacatcaatcagatgagacatagcggtcatagtgacctcaccatgttaggcacaactattagagtgtactgcattcagcatgtgatatgctgcactttgtcggacttgtctgatgctcatgaaaccactctagtaactgtttggagaacatcataccaagacccaatggtttgattgtcaccctattaatagggcccaatgctcttataggaagaaccttagttgctatagatgcaccatagtccaatgactcttatcaaattagcctcacataccctagagctctctagtttgattttgtagaccatcaggctgatctatattggtctgatgaccatgttcatagggttcgacgatcattccattgcttgcatcacatgtgaaagtgtcagaacatctccaatggcctaacgaccctcattcttaggatctctttcctctaaaacttcctaaatgctccactttgtgaatgaggtttttccaaacatcttttggacctcatcaaatctatttatagctaaagacaactag

SEQ ID NO: 3504 - DNA, 1210 bp, Zea mays
  misc_feature (1)..(100): optimal_loci_233124_G1, chr6:148787900..148789109, Cluster 21
gaaaggatggtaactaacaagtaacatggcagcaatatcacgaagcatagttgaatgatgttcctgcctatgtactactagtttcgctctcttttgcctatgtactattattttcactctcttttgacacacccttttttttgaatatttttatattttatcttaatcaatagcacataagatggaaccatactaagtttgagacttttttatgcacggatgtgtcctgtagaaaatttgaacaatgtgttgaaactttctatcatgatttctggaatcggaggacaataagatttgtgttcgacagggatgttagcgcgaactcacttcaaatggtgagctacgaggggctcgagggtcgatatgaggcgagtcggttatactcacgctcttattactagaccttatattgcgtccaaggaagtgatgtcctcatcatgactttcccattctatgatggacctaggtgaagtcccgatcttttgttagacaagatccatcattattgatctatttcagatctagatcaccaaaaacctgaaaaagagaccagaataaggatgagggagcgcataacaaccttctatatagtgtcctccttcgagaaatccaagaacaaaatcccttctcccaaaataattagtttttggagttctagtattcataccttgtcaaaaaatgagcgggtgaacccgtagatgaagaatatgggggtggttgggacacacatttaaaggcaaacgattaatagagtcgaacattataagaccaatgacctctattaatcacatatattaaccgagaccttgtgcactactgtagtagtttctttcccggttctagaaactaagaacgtactcgtgcactttaaatcttgttaaaaaatataatcatatatgatcagctttttatggttccaacattataggtatgcaggaagtgccgaggaagacagatagtatgcttcttctgataagaaaggctttctcaccctactactatttctcctggtcttcggccacaacacatactaataggaggctaggagcaaagcaaagcatccgatctgttgttgttccaaatcttcgactacaattattacgacgcaacgcagatggctgcgcattaggcgcggtcaatggccgctcgacaccgcgcaccaattctcgtctcgacgacggtgaatttcaatttctcacggctcggtgaa

SEQ ID NO: 3505 - DNA, 1077 bp, Zea mays
  misc_feature (1)..(100): optimal_loci_233222_G1, chr6:149131581..149132657, Cluster 21
gacgtgcacagtgcatgactccacttctacgataagatatgagtacaacaatgtagaaggggtccataatttggtgcacaaaagtttaggcaagtccacgactccaatagatccaactaagccagccaattaggattaggctaggtctcttaacaaaaccgaagtagagggtgacctagtaggtcctcctactcacagaacgtctgagtgtgtaatcttcgtcttcgcttctaaccattaatccaccataaagaggatacatgctattacgtttccacagcttcgacctctataaactgtttgcatgcttatagtcatggtagcgccatgatccaacgagcctccagccaatgttccctcgctctcctcctaattctactaacttctcaggtacccacgatagactgatattgttacgtgacgacaatctactacttcaaacataagatttaaattcaaatttttgattattgaaagtttcaacatccaaaactatgaaagtattacaaaaaatggtaactccattcaactttctaggtccaattttgttgcactaacatcacatattgtagtataacatatcacattatagtaaggccaatcttagtggtgagtttcatggtattgttataaggaccattatgtcagcttttctgttagtaagtgtgataatcggtttagctagtgtttgtagctaggatgactgattttagtcagatgaaactctatctctctcttcataattaatcaactaactcgacaaatatgttgatggatcgtactactaattgcaaatgaaactttcaccgagattagcctaatcgatggaatagaaaccaactagtacaatgcccatgcgttgcaacaacacataaatattcgataaaattttaatgcacagtgaaatatgggtaagggaggctcacccgttgatgtcctctatggcggctcacccgatgagatatcctctatagcggtgtaggaaaatatgggtaatgaaggcgaaagcggaaaaaagacaggaagtggatgattaatatatgatggcaacaacgaggaggaagaagcggtatggtg

SEQ ID NO: 3506 - DNA, 1312 bp, Zea mays
  misc_feature (1)..(100): optimal_loci_233395_G1, chr6:149700503..149701814, Cluster 21
atcctagtctatcaagccctcaagctattcatgttggaactttgaagtcttcttgagtctccaggtgactaactagtagaatcaagcaatgaccaagtatcttcttaatagaagccataaaacactattgaagttttagttctaatcttgtgcactcttttaaagaacatctattgggtgtagcccccaagcctcatgtttttagcacaaaaagattgagagttcttgtaatcttgtgatttttttaaaaaaggttcacctaggacatttatccaatagccccttattctaaaaatcaagtacatgactaggaattgattcttaggatcatagacatcctcaagggtatataaaagtcatcaaccaatcataatggccgaaagaacgctttgttagtgagtgctttgttgcttactgtagtcacgcacacacaatataggtatcttgtattgttttctatggtaattttgtcaagatgccttattttttatgttgagtgcactaaaagttggttaataattggcctgagcaacacatgaacattgtcctcgttgatagacaatgggctataataacccatggtaagctcaatgcaggcttccactagtggtaaccaaaaacttagttttccagcttaaacaggatagtctatgagatgtcaagccacctagtatagttagaagattgaagatcttaccttgcaactagaactcttgtgatggctacatatagagtttgagtgtagtacacttgttcttcaagcctactatgatttgtacctaagaccagcctatggtataaattagaataggtattaatagacctagagtatatcttggtaagctgttcgaggtagcattttagccagaagtctcattggttcttctagttctatgccaaagaggagactactcactctcttgctattgagggtacttatggaatgctacctttaatagatcaacctctttgacataccttgatgcactatcatcaaagtcagtgttaccattgtggtaatacttaaaagtggtatcagccatgtaccttcattgtatggtgttattggcaggcattattctgtgttttcgatcatcaactatccatatgatgagaatgatttcatggacaaagtgactaatattgcgactaattgagttccacaagttttgtttagaatatttgaatgcaggttgagaaaacatgcaaaaagaagtaaaaatggctaattaagagtggaattggctaagttaggggcacctcctagcaggtcggccatcccctagccacctggccaccctagaggtcgata

SEQ ID NO: 3507 - DNA, 1247 bp, Zea mays
  misc_feature (1)..(100): optimal_loci_240012_G1, chr7:15677053..15678299, Cluster 21
cgcttttgaacactttcgttaagttatttgtatttcgttaaagacttgctctataataagagtttaatgatttattatataaaaaattatgttgagatactaatgatgcaaactgtgtatgctatttttatcatggcatatatagtttgcacatgtctattgcttcgaaaccaggtgtgaaaattagcaattattgagacaagtatatgatccgaagaacataatataataagccatctaatctatagttttagagagaatcttgaaatcctagaactatcctttgtctctaccaaaaaacaaccattgaaaccttagaacgttttttctcaaattaagatctcatgcaaaacgatatacgagaggtattaacaatcttgaccaacctcagtagaacaaatgaagacaaaccctatcattctttatctctttttaaacacaacaaccatgaaccctaaactaaatttgccttgaattgagaacaaaacatataaacaagatataagacatcaactaagctttctcgagcaacctccttcaaagaaatgatgattgtaatttcttgacctccaagatcatcaccaaatgggacaataatagattggatcactagacatgtacaacccatataaatgatccatatcttaaggagtatctaaggggtagagtgcaaaaaacacaagagacatatcttggtgaaggaacgtctctagcatggttctctaagtatatgatacggtaccacccatataacacacataaataagtcgtgtcttaaggggttctagttaataagatataaggctttttagatacattgagttgtatgaacgagttttttagatgtatctattgcaacatatagtatctaggttgtatatctcattgccatgcatgtgtggtgtgatggcttacattggattgtcggttatgatcgtgttacaaggggagtatcttgcctcagtttgtcagcaaaatttcaaataaagagtgataggtattctaatgttaaaaaaaggtcaagttacaaaaatctggctatagttaattgtggatttgcacccacccaagaaacccaacttgcagtgctgctgcagcgacctagcaactacacacctgatggagtaacaaacagataatctacaataataatacatcgttattgtcattaaaaagggcgtgaatatactatggtgcccgcaggttcgatgtacatacacagcatcatgcccacgcattactattcc

SEQ ID NO: 3508 - DNA, 1182 bp, Zea mays
  misc_feature (1)..(100): optimal_loci_240735_G1, chr7:19361992..19363173, Cluster 21
tagtcgttgcctactagcgtgttcaccaatggatacttcatccttgtgcctccaacgaagatgagcatgatacacaagatataagatacatcgctagagaagtattgtaaaaagtgtaacatgtcaacgatgtcgcttaaaaccataaacctacaaatccaggggaccgaaccatggcctttgacaattatatgttaggttgatctcacgtcattcttgattagaggactgagcctaactccaccacatgcatcgatggaaggtgcaacaaccttttggttacttattcccgtcatgttgtgtataaccaaaaaagggatgaggtcaacacagaccggcattcataggtacctcctaatccctacacacgcgatgtgatcccttcctatacaattagtaagggaaagtgtcaccaccatcgacacactaactccgatgctgatcatcagagtctccctacccatggtgacctcctcctccaatcttgaaggtgatttctttccccactctctcggttctaggttttaggcaaaggaagatgttacattacttgacaatggtattaaagacgcagtttgcacctaaaccttaccctagaacccaaacccatcgtgtatttggatttgatggagccaaatccatatactggctcttatctggatgatttttagatctataacaagtagaaagaggagaagggacgaaattgtggctcaatccctaagcctaagttggaatccccaaatagtagcacatcatttaatgttttgtggtcctccgagaatggagtggttgaaatttgccgccattttgagataaaagtttagtgtataagtatgacataaatctaaccttaaatttaaaaataaaaaatttcatattcaaaattccaaataaaaacacttattatcaattgtttgcaaatttgccccccacgttgatataaaaggttagagtataagtatgacataaatctgaccatacatttgtaaaccaattgtttcaaattcaaattttaaaatacttaaaatttaatgaaaacaaattaaatttaatgttatattttaacgatattttagcagcattttaattataatgttgtaattaaatggggttttacatgcccttatctaaagtgtgtatatatatatatggattggtgtgaacatagaacgagtcatg

SEQ ID NO: 3509 - DNA, 1401 bp, Zea mays
  misc_feature (1)..(100): optimal_loci_251281_G1, chr7:91867522..91868922, Cluster 21
gggttcagtgggcaacgaacgagcaagacagaggctgaggagaggagcaacgagcaagacatgagaggagcaacgagcgagacacagacgacgactagggttcagtgggcatgcgtcgaaaggttagttgtttttgggcccaaatttcatttggcccacagcgcacagcagcagctcctttagcaggctaaatgatgtagtgtttagctgttttagcgggctaatattcgttattagcggttctgtccgtttagcgctaaattgtgattatcttatacccacccttctccagctattttaaacattgattcagtatcaatcaaccaactctcaccaaacttcagcttagcagtctcttggttggtatgtgaaagaaaaacttgaggactgatcaacaacattaatccagtgcatatacttcataattcaatggccgagtcacaagactgaaataaaactaaaaagaatcacaaataattctccagtcttcgtctccccgcaaagtttattccagtaacacggaaacaaacaaatgaggggggactaccattatgacggatacccgaccatacacagcagaattatgttggtcagtgttttcaacacaacttgtacgagaccagtgtttttagagcatcctttgagtagttttaagatctggacgaccccagatcatgtttcgtgtgaacgtgaaattcatggaactaagatgtttaacctttcaattggtagaacatagctgtttttttttaaaaaaaaatctaggactgatggagctctcctagctaaatagcctttatatatcaatgcctaaaaagataagtagatcagattagagctcagttgtggtagtacagatctacgaaggaatacattgaaattgaatcccgatcacggttaggcgtccgcgaagctccacacacaaatttcaacagtcttagcttagttggcacctttattcttaatctcatgtctatgacttaggagcacaactatacttatttacgctgaaatcatgttaactgtatcaagttgcttaataaactatctctgaacaagaacacataaactatttgccaaatgagtccacatccagtttacctattctgaaatcaattaatgatggagaatcttgatgccgataaaagcctggtgatacaaagcgaaaaacagattctttcaagtctaacggaattgttctcaaacgtaaataaaaagcaaaaaaaaatagcaaggacaggactcgaatccatccacagctatgctcacttcctaaatacattttagaaaagagaagagctgtactaaaattaataagttttgattttgttaaaacccagcctttataaatttgttaaatatggaatagaatcaaacattcttatggtttattaggttacg

SEQ ID NO: 3510 - DNA, 1321 bp, Zea mays
  misc_feature (1)..(100): optimal_loci_251605_G1, chr7:93736492..93737812, Cluster 21
gtcatcttgatgattgggcaagtctaaaatttttgcatgtcagtttatagcagatatatggaatggtaagcctacactttatatgattcagaaaagtcttgtcaatgatagaggtttaaagtacttaagcagattaagttaaagaaaagtgagatgggaaaagtaaattaggaccaaagtgaggtctaaaacttcaataattgcatctgacacatggcaaccaaagtgggttctatagaatcttttgagtacgtacctacacgtcttccaactacatcagctatacctgggattgcaaaaatgaacatcagtagcgtatggccatatttaattctcatgtttgtagcatgaaactatttggaatacctagaaatatgattttgcttttatgaactaatgaggggaaaattaatgacataccatttaaaaaaacttcattaaaaatcaagaatttaaggtgcctagtacactatggaatttacatcccaaagctagtagggtttctatgcaagcatatgcaaagaagaatgtaatagaatgcagcaccgcataggaagcaacaaaatcaatttttgtatgtgtataaaaggtggatggtccaaaactgccgcatgattttagaacaacaatattatgacaagcactaaattatatatacacatgaaaaacattgaatcaactcaagaagttgagttcatgaaaataaagtactagttccataaactttttgtattaagtggactttagaattatccatcacatgtgctgtcctgaaacaaaattcagagatggttcagagtttttaatgaagaaaacatgaagatggatgcaaaaacaactaaaagaatagcaaacaagcacttcatttggaaaagaatcttttatgcaaagcttatagtcaacaaaataagggatctgtcctagcagattaatcttctaatgagtaaaaggggtaatcataagttcataactatttaatcaaagaggcattgatacaaagaaattgcacaatacactgaatttgttgcaaaaatagacggatcgcgaagacattttcttgtaatttcagtgatgccataaaaaaggttaccatatgctacatgaagcttctttgtattatggatacaaaaaataaccaattactccctgctctacccaaatagtaatctggtaagcagataatctacgaatccacaatgtgaataacttacatgttaggttaatacttggttatgcacatgatataattggaaaagtaatgattgtagcaagaagataccgacggtgtgcaaaaatcaccaaaaatcacatcagagtaata

SEQ ID NO: 3511 - DNA, 1032 bp, Zea mays
  misc_feature (1)..(100): optimal_loci_254413_G1, chr7:109527173..109528204, Cluster 21
tgcaagtactagcaaactacctagtgtgcatgtaactatcagtttgggaattgggcatctaactctggagactgacgcgctcatggttgagcaagctatgagatcagatacatactcctatttgtttgccggtggtctgatgcatgggaggagctaaagtctctagcggattcaaatttcttaagttttgagtgtgcgtttaaacctagaatttgtaatacggcggctcatgagttatgagttagctattctaggtttgggtaacgttggaacattacgtgcaatctccccaatgacgtcgttcatatagttgcgtccgtttccaagtgcacgcgcctcagccaggccgagtagcgaaccttgcctcccacgttcgtcttcttgagtttagctcgcgggacggggtaggtgcgttggtcctggctgcggagccaaatcaagctagctaccaatcacgtctatatttatcattgatgatatatcagcaaaaacgaaataaatatcgcctagtttggaaaaaaaacgttccctgatttattgtaacaattaaattgtatgtttgcatatgtttttttttatatttgaacacatgtaaaataagacagttcaagttattagcccaatcgtatatatgtggccacgccacgcctccgaccattctccctcctaaatcccacgttcatatccgtattttctatttatatttaaatattttctcctaaactattcttcccctatgctccttctctctaatcattctctctattcagcccccttactttttaactgagctactggacttttatacattggttttttgagttctaaaaaatactactatatttgtagtaccataatacacattttatcaactaattaaacttaaaaatggttaatttcataattattatcgttgattagtggtaagggaggcacattggatcgttggaggcagcctaacatggtaaaaagttaaaaaagaagtttgacttaaggtaaaggttaaactgatttacagtagagtactctctt

SEQ ID NO: 3512 - DNA, 1083 bp, Zea mays
  misc_feature (1)..(100): optimal_loci_255775_G1, chr7:117265313..117266395, Cluster 21
cgtcgattttacgttgggaaaccgaattttcaaattcttcgaatttgaaatgccaaatcaatcgatttttagcggtttttcgttgaaaaactgtaatcgacgggggacgatatttgaattcaaaatggtatggtgaactcaaacatggtgacacatgtagataaatctagtggtatttttaagcttgattggttggtagccaaaacttagggcaagccaaactatctggtctgatataccaaatctatagtaaatatttttgttaaagttttaataatttatttttccttttgccaaatcttggaaatttaaaagcaaaaatttggtcatgcgtctcgtacgcctgaaatcgtaaattcctgacgtgggtgaggattcgaactattcgttcggctcgaagcatttcattcacttctaccactataacacacatatgtttatgttatataaagaaattatatatattaataatgtgaaaataaaaatataaccgtgtttaaataaatatcttatttgagcatcatatgatatatagaaaatcatagcaatacacaagcaactaactattttagatatatacaacaatttttggtagccaactaggtcctttgtctcagcatcacgacaacatccgcaaacacaacgtacgcacgtatggtaagcaaataaactaagacatgatttacaccctgtttggatcctcctagttaattgtttgtcggtgcgtgataattagccaacaaataattaactatcaacaactagttaggatatgtttagagtcttggctaatagatgtttttttctccttttatgatctatcaacacccattagcaaggtcaataactaatgaacaaacaatttgtcagctctctggataacaattagccaatttattagacagtcagtttagatcccaaggtactaaagttagctacaaattgtttacataatggatccaaacatgcccttagattgttcagttctccttgaaaaaatagaacagcttagggcctatctggttatacatactcttgtttctagttacgatttctatatagggctcttgtttctagccgtat

SEQ ID NO: 3513 - DNA, 1030 bp, Zea mays
  misc_feature (1)..(100): optimal_loci_256135_G1, chr7:118928110..118929139, Cluster 21
gaatctgtcccttaaaatctaagaattagaaactgttaaaagctaatttagaaacctaaaaattagtctctagaaacctaagatgatagattatagtgaaaatggcccgattcgaattaggataatttatcatcgagttagcataatttaaaaatatttaacaacctaagaattaggaactgttaaaggctatttttgttcctaagaatttagtaagttttttagaaactaatggagatgctctaattaacaaactaccccgggatgacttcatttctcctttcaaaacatataacaaacagaccggccctatttgtcaaacattattatgctcaatgacggcctacatattacaacgcaaccaaagtcagcgtgcctgcacaccaatgacgcatcgacaacagcagtattaattaagttattttgtcaagtccacatgcataaaattggatccttatcattgggaaacaaggtgatgatctcacgtacgtacgtatatacatgtgcatccactgacagctaatacagcacaagctatatattttgattcacgctgtgattagcatataggcaacagtacatgcatagagtgcactggttaattatttagactaacatatatacaggcacgcactggctatatgattggaaaggagaatttcttccgagagaaaaaaaaggcaataatttttcaggataaagaatgccgtattcttcatttcttcatcaattaaggttaggacattttatttccaccagttttctgctcaggtcctatacacatttctttctttagtacataacaaaaaacacaaaaaaattgtgtatcattgtaattaagtagaatagtttaaccatacaaacaacacgtttctggtgagtttattatttggtagtataatatcgatagcttgttatttataattagctaaatttaagatactttaacttttactcagtagcatgcatgttggaattgtacaattttatagacgagagggtaatataacatggacaggtgacaataaat

SEQ ID NO: 3514 - DNA, 1331 bp, Zea mays
  misc_feature (1)..(100): optimal_loci_260238_G1, chr7:141449491..141450821, Cluster 21
ataaacataaaatttccattgtggaggcatgtatgtttttattttttagagtctagtgcagtctcataggtagggtatctaagaaatcagttcttttgtgtattatggaggtattcaagaccttcagtttcactgaggaattcgttagatcttgttcagttgtacatagatcggagagattaaatctctttcttttcaattttgactaggaaagattttaattccttccggttcccttaatccctatgtaaccgaataagtccttagttgtctctggataaacataaaatttccattgtggaggcatgtatgtttttagagtttagtgcagtctcatatataggtggggtttcatttactgtattgacattaggagcagtttcttggttctttgttttggtgtgaccgtgtgagtttgtaataattggtccaattcgccctcctagaggaatagaggaacgatgaagcctatttttttgtttccattatctagaaagaagtgtttgcgaggatggtacgggaggaaggggcacctaaacaagttaatacattggcacctacccaatcttcctcaacaacgtccaccacacaaggatgacatggttccgagaactctaatcagtatacatgaaaagtagcaacttgagtagacgatagggcaaccacataaccgtaatcaatatatgcatgttgtggccctaatcaatttgtctgctataaccttagctggtatatgtgtatgtgttccacctcttaatcagtatggatgttttaacccaaatccatatacatagatattggggaatcatgtttgagaattttaaaatgtagcaacatgagcagacgatcgtaactctaattactatcccggttgcgacccttaattgatatgcttgctgcaaccttaattggtatgaatgctgcaatctcttactcggtatggatactgcaatactaatcaatatgaacaagtgagcgtatgatacatgcttgtgaaatctaaaaagtagaaacgtaagcatatggtagagcaaaccctataattctaacttgtatgtctgctgcaacccttaatctatataacctcaataatcctaatctctaagtatataccttcagtaatcctaatatctaagtacaatataatatattatggcattttattagaaaaagaaaggacttatctaagatggatcttggatgagcacattatctctaattcaccatatttcatcaagcgagaactatagaaattcaatccaataaagttctacttttgattgtcatgccaatgtaaatctatgtggtgatatgtctaccttgcttggtgg

SEQ ID NO: 3515 - DNA, 1005 bp, Zea mays
  misc_feature (1)..(100): optimal_loci_262980_G1, chr7:156659636..156660640, Cluster 21
taaaacaaatcagcaccacattcgaagccgattctctactaaatccagtagaagatccaccaaacacttttttttataaagaacaattctttatatgaagcgtttttttttaaaaaaaataagactttatatatgcctttaactaatataacacgcctacgactagcaaggtgattctccatcgtaattttaagagtgaaattaaatataattattttttagccacggaatcacgtctctagtagattcagctcctctaaatgagtcagacttaattacgagaagctctagctacgaaacaaagaaatacacatgcctagagactagagagtactttactatacatacggcgtttcctcttgaccttaaaacttatactccgtgctagctgtttccaaatcctctggccgcgaagccgtttccttttgctctcatctcattgccttattgctactgctcgtacgattaagcactgccttggcacaagagtttgctatgcttggtctatttatttagtaataaaaaccataataaatcgtaaaggctgacatacagggcggactcacgttggggctgagtaggggcacgggcctcactcaaatttctggttttagtagagtttttatcttattcattgtagctataaaagtccattagtaagtagacttctatttagtcacccaatcaggttttaggcccacactcaaacttgtggccggttcgctcctgctgacgtatgaatctaactttatattaaagataagttcaaaaccgaatcatcagaatgcagagagcgtaaccaagtcattttcctacttcagaattgaatccattaaatcatggagatcgtaaccgaagaagttttagtttactatctttttcgtgtgtttatctttaggctagtttccctacatatactactttattaaaaagttaatgttggcaagattgagcactttgccagaaaataccacgacaggaagggcaacaagatgatatcatttt

SEQ ID NO: 3516 - DNA, 1074 bp, Zea mays
  misc_feature (1)..(100): optimal_loci_263669_G1, chr7:160091804..160092877, Cluster 21
aatacctgaacattaatgttctactggttagacagattcgtttagtgcctttcaccttgcttccattagggtgtgggtttaaaccccacctgctgcactgctttttactattttagtttgagttgatttggaagaaatatagagattttttttttaaaaagatgacgcaggacgaccattgaaactggtgatttaaatatagtagagatttacatgtgaattgatgtataagttaaattaatttacactttaattcatctcaatctatctagattgaggtgaataatagagtatctaaataaggtcttagggatgaggatagaattatttcaatattgtctctagttatccattaaaattgatcactagctgtttcaccaccaaacacatggactataacaagtcaagtgatggacacatagaggaacgtgcaacgagcatagtaactggatctggatctatgtataatcattatttccggtcgtggaattattgtcgtcaacataaaacctgtcccacgcgacaactcctgtcagagcttcaaagaaggctgcgggccggactgatatgcgagcatagacttggtagtcgccgtgcgctgccgggcgcggtagttgtgcttgtgcatgggcacggtagactcttctgaatgaagcaattcgccttgatgcggtcgctatacgcactcttcgacgctgctgaaacagaaacagtgagcagcctttttcagactgattggtggagtgttccaaatggtccaatagactgttctttatgttagtgtcatcgagaagtttgacgccgcaatggaatgaaacacagataaattatctgtttttttatccgatagttccatattctatggcttcatatacatctaattaatttcataactgatatagagtggataatggcgttaaaaaaagtttcaccatcataacacttacttcttcttctctctctttttttttaaaaaaaacattatctcatcgtcaacttcccgtgggagtcagagactatccctaaaaagcacccacactggttgttccgcccttggattggtacacccacttt

SEQ ID NO: 3517 - DNA, 1108 bp, Zea mays
  misc_feature (1)..(100): optimal_loci_265520_G1, chr7:169909996..169911103, Cluster 21
aaagatgaattacaagttcagtgaacaagccacagagcttttaacattatatatttctttggatcctaacgattctttcagttcattgaaaattgatgatgtatgctctctacctgtaaagttctaccatatcgatattttagagcaagaaagaagtcgtgaggcttcaattataatattttacatttcatgtgcctacatattttattttacaaaatatgataatcattgtcgattttcgtcagtgaccaacataaattagaacatcaggtgaatatgattatttgaccccttcagggtcgtctctgagttctttaggccccattgcaaaaattgaaaatattccctataacctatagtatatggagataaaagtattctaaaataagttgttttatacttgatctattgttatattcttgccctcttatgttatctattttaaagttaagattttatagtttaatttacaaaatatcaaacaatatttgcattttatattatttatattgagaacactcaaaaaatgatgcccaaaaagttaggggccctgtgctgttggctgttgccctaggtggtagagaggcctcgcccctttatattttattcctagctccgctactatgaccaacacatcaccaacaacacctagatccatgttggaaatgtcacatcagcaaaatcactcactaaaaataccgatggattatttgactgattttataaagttgaggggttaaataactaattttgaagatgagagataaaatagattatcctttaaattgagaggttatatatcttttctgttttagggtcaatataaaactggtttcatactttttgaattaaaataaaatttagaacattttttagtattaagtatttttaaaatgtatattatattctcgaaaaatattgattatttttaaaattattattattgagtcgacaaataaaaaattatttcatagttgaactaggttaggtggactttttctttctacggctgaaccgctcaaagtcacggaagcattagagagcccggcccacgcaaggcccaaccatctctccatctatcatcctccccgaatcgccctcagtcgcc

SEQ ID NO: 3518 - DNA, 1062 bp, Zea mays
  misc_feature (1)..(100): optimal_loci_265967_G1, chr7:172385791..172386852, Cluster 21
  modified_base (345)..(345): a, c, g, or t
  misc_feature (345)..(444): n is a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
atatggcacaacaactatgacaagattaagtagttgaacctctgttaggtagggcccacggtccagacatgaatataactctcttcttttgtgttgtagaaggaaggtgtagagcaatgtacaaacaagtttgtcattaacaacatgatggttggtgaatagagacactagggaagatgaaaagcatttaagggttgctttagtctatagttgcacctaagtctaggagtctctaggctcatagttctcacttgctaactcagtcatcatctaagctctacccatggttgtatataaatatccaccaccatagaggacatatgggtattaaacttagggcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgacatatggttttaatataagacatttggtactttgtatatcgtgtgtgttcatatgttgagtcagcgctctataatggtggtcctagcctactagacctacaactatctctataattctctctggtaccctagtgtcacatcccaatgatatttggcatgttagatatgggtgtggtgtgctttgttgtgttggcagacatggattcattaacacacccagtcgattgagcagttgcctttaacactagctccaacaatcctaaccatacaccacatcacaaagtatgcagcagccttgcttagtctagtccttttattgccttaggcaaggcaagggctagatcgggctaatcctactcttctagctttgctagaacaactccctctaccaatatagtctagtaacccctcaacgtggtcccatggcgatgctatcactagcaccgcttccatccatgatccttctaatgcacataacacctcaagatggacacctccttggacactggaagactgccatcctcctgcatgtgttactcctctaactttgctttggagccctacaaatggtgcctccaagcatggtggcttgtctcatcagtggacatcatgac

SEQ ID NO: 3519 - DNA, 1010 bp, Zea mays
  misc_feature (1)..(100): optimal_loci_267530_G1, chr8:3874851..3875860, Cluster 21
cattttactataatacattatgaaacattgctatttcaatatattattatattttaacaatcatattatttgaattaaggaccaccaatagacgtttgataatttcgaagtactttttgtagacttcttgctggattagttagaagttggttatatataattatgttctctatcaatctatgtgtgtatgtgatcaactatatgttactaattgtattgtatgtcatgatattacattgatttaaaatatttaagaatggttaattttattcgatccaaaactatcaaagctattttcctattggatcagcgaatcaatgatcttatgaaatcgctatccattttcatcgtgacttgaacggcagcatgtaaaacgctttcttatcctatatttagagaagattctctcttctgctccacagttctctaaggtatcctctaaatatagaggatgtttctcaatcctctcggtacagagaatctttcttatctcgatatttatattttagataatggattaagcaaaactaatatatatatataagatatttaagggtatgataaatacatacataaaaaatataagtaaaatacagaaaatgttttatagaaaataaaccttttaataaaaatatgtaaattataaatatagagagggaaggtaaagaataggtttgaagacacactatggggttgttcaggactgcttcacgtagagctgtattttaggatataaatttgaatagtttaaaaagtatttttaatctaaataataaacaaaataatttatctaaatatcttttaaatgtttacaactctagatctatgattttctatagcaccgagcacctaataacatgtttcaccaaatgtactaaattttatgcctcgagaaaaagaaagagataaagaagagaaaatgtctcaagaagatccaactgtctctatccttgctttctgatagactgctccgccgagtagtggaaactcgagggaggagctcgacggtt

SEQ ID NO: 3520 - DNA, 1163 bp, Zea mays
  misc_feature (1)..(100): optimal_loci_267534_G1, chr8:3877808..3878970, Cluster 21
aagcatgtttgtttgggataatccaacttatttagtttcaaataaattagattatataaattggacatattataaatctcaaacaaacataccctaagtcggctacgaatttaagtatgcaatgtgccctatctcctcttctctatccttcaccttagcattttgggggtgtttggttcccgcctcctaaaatttagtgactaaagtttagtcacttttagtcctaaaatatcaaatggggtgactaaaataggtgtttcaaacaggatttctaaggagtaaagtttagtctctaaagtttataagggtgactaagaggggacatttggtttaaagaaccaatccattctagattatgtggtgcatcatgagtctatttgataaatttggtgaaatgaattgatttcttatattgttactaattattttttatgagaaataggatggtgatgaatcaaccgatttcattttataaaccaaacaataaagtggggagtgtgaagataatagaatacctcattagtcaaactaaaaggttgtaaaggaaccaaacactctcttagccatctcattatacttgcccaaacggggagatgcttctcgatgcaactgctatcccggctgactcatcatcattctatacccttttcgtgatctgtcctgattattgtcagtatcatatcttgctccccgtcaaaaagcagagtcgccactagtgatggaatatgcaggtcgaaaagcgagggggaaagaagaaaaaaaggtgacgggtttggccactatgccagcacggacaggtccacggacacacacgagagacgagcccatccgtgcgtgttagctatttcgtggttggccctaatcgtgctcagcgattttattgattatgggtgtgaatggttggccctaactcagctacccacccttttgtttagtcgtctatatcccttttattgtgagctgatgcaaatagtgcacctgagcgaggctacgaaagaactgtcattttagtcgtatgcccgtatgaacacagctagactgggcataaaaaccaagacctggttttaattagttttattgttatatctcttgattaatgaatcaattttacttttgcgtttctaatatttttatgagcaaaaatgcatgtcactaactatata

SEQ ID NO: 3521 - DNA, 1243 bp, Zea mays
  misc_feature (1)..(100): optimal_loci_269959_G1, chr8:16834229..16835471, Cluster 21
catccaagtcactcgacgccacaccatgacatatttgttgttagttgctctaagctctttctcaaccaactcattggcaacttcgtatcatcggcaataataacatcaacaataacgtctcttcctccgtagttaaaaggtgtacactccatgatccatttttttatattatgtcgtctgctatatattgttgttcatgctatttaatctaactagtatgcgagcacatctagtattagtatttgtgctagtgttgtttgatataactagtataaaagcattgctaatactagtatctgagattgccaatgttctagttttaatccagaagtgacatatttattcaacatttgttagtatgtacgagtacaattctatatgaagggtgaaatatataggtgactataataatgtcatatctagcaacaagtcatataacaacaagattactagattattagctaatcgagatttgacatctgaaagaatcagtcagtcaagctgccttcgtgtagctttcccggaattcaagtggatggtgtgatatcacgaccaaaagggtgtaggccagtatggccgctcaacgtttcttatcggtctacatacacgcacaatgcatgcatggttttaggtcacgaccccacaatttataatatgtgaatatgtgatcatgtgcatgatggagaggttaggtaataacgaacctaggtacacatgccctaaatatatacgtccttccaaaacaaaggcttgcaagagacaaggcacattccaccaattattcctacctcagaccagcacacatacgcagcgcgtcttgaattataactaatgtattctagctagtacccctgaaaagaagagctaacaacccatatagcaatgactcgtaaaactaatggacatatttatgcatgcatgctctatttcacactagttatattatataccatgggcttaccgcacgtaagagatgattcatcgcgcacattatattgcttctgtcattttgtgcgcctacagatgatgcgccttttgagatcgatcttgttgcttgtattttcacgatggtttttttagaactctattctttttttattttgaatagtgagagaattttagccccttcaatttaaatgtagttttctcctgtgcattaccattcttgtatcgatagagagtattcatatcaccattgaacccgtgtccgcaatgtcgtgtgtggttgcaacgataaaaccat

SEQ ID NO: 3522 - DNA, 1025 bp, Zea mays
  misc_feature (1)..(100): optimal_loci_269960_G1, chr8:16837313..16838337, Cluster 21
ttattttacataaaaaggtggaaaacgctcaagaagaagatgaatactaaaagataattgaagaacatctcatttatactatctaaacatacaagaatacatcattgagtataacatgtaacaaggtcaatgaaattaaaaagaataccacatgaacactatttgaacaatctaaaatagttgaagaacatctcaattattgtaattgaacatcgcatgaaaacatattcaaataatatctcatttatagtacataaacatctcaaaatacatcacaaagtatcatgtgtgtactacataaacatcacatgtatcaagttcaatgaaaatttaaaataacatcacatgggtactatttgaagaacctaaaatatattatagaatatatgatgagtattgtgtgaaataattaaagaacatctcattgtcgtaagggaacatcaaataatacatcatagaacatccacatatgtactacgtgaacatcacatggaaacaattattgtatgaatagtaaaagataattaaagaacttctcatttattgtaagtgtacatcatatatgtattatgtgtatatcacatttattatgatcgaatattttgatatcatatggaactcacacaagtgcaaaagacacatcacagatacacatattatttctatatgtaagcaaattcaaatattttggtataccatgcaatagacacaaattctaaagatacatcataaataggcagttattctacaattaaacaagggaaaaggaatataataaaacaaaaaaatcacatctactaaatgaaaataaaaagaatagaacatggatactagtgaaaaatatttaaaataaagtataatacgttaaaaaaatatgccacaaatacatgtaaataattaaagatacattatagaatattttgcttatattatgtgaacatcttagaatacaatatggaatgtgccattaatatagtatgaataaacaaaaaaatacatgacaacattacatggatgctacatga

SEQ ID NO: 3523 - DNA, 1209 bp, Zea mays
  misc_feature (1)..(100): optimal_loci_269962_G1, chr8:16839586..16840794, Cluster 21
ctgtggcatcgcacgggcacgttcctagtaagaacaaaagatcatagaaaataaaaaatagaaaaaatagaggcaagcaaacaaaacaaaaaaaaaaggaaaaacgcattgttgctacgtattgctgtggcccgtgaacatcgcttgtgggagttagtgggccgcgagccggcacgctcgctccaaaagcttcgtgggagcgtcacttgtggaattggatggtgggccgcgctctccctaggaacggtggcatggtcacggttgacaattgacatgatgctgactgccgagtgccgatcggtcgaagcggatgattggcgaaaaaataacgaaaccgacgcctaaccaagtaatttaggcccagttgaccacataagcccactacaatctacaggccaggaaaatctttggaaattcttttttgagaaaaaagcgaatactaaaaaatattattattattaaaaaataaatatttacaaaactaagagctggaataaaaaattgcagcataggattctgtcaggagttatatgaccaacaggatcctaatcggaagtcgagtgaccaaaaaattatgccacgtgtttaagatcacatccatatgtacatagtttatgccgacatgggaatgtagattggccttatcggcaatccaaccgctgataagtacctccaaaattacatttcagtttgaaattaaatttcaatacagtaatcttgttttgaatgatttgattctgaattcaattttaaatttattttgagcaggtgctttgttaagaaactttggatttcatctaattgtacatgtacaaaaattacgtgacaaaatactacttactgaactattaatttagatatttttttgattttttagataccgttatagagctaaaaacttaccaaaaaactcgagcaaaacattacaaacaattataaaaagcaatggtgccagcaaaatatgttgtgtttaatgttacaaaagcaattacatgttgtgtctagatgttttaacaaaaaaaatgaaggtaaaggatgtcggcttatccgcttacaacattggtcttctctagtcttatctacgactagcaaaaacgggggagtcaaagaagtgtacaaagagagcttgtttgtcctttggtgaaactagtaaaaaatgttcgtctcttatcgctactcgtctcccttcttcaggcactcaccttaacc

SEQ ID NO: 3524 - DNA, 1002 bp, Zea mays
  misc_feature (1)..(100): optimal_loci_277848_G1, chr8:72418965..72419966, Cluster 21
tacagaatcgaatttttaacctcaaattttgaaaatactctgttttttgcactaagacgatttagagggcggttttgtttcatctgatgggacgccacgtcagttgcgaggggtgtaaagtcaggctttgttggtagtttgtgtttacggattaaaattgtagtgttggtctagtttttctatgatttaaatatcgtcagttataaaattgttaagaaataatgtattttttgttacatgtaatacaaaagaaatcatcagctagacagattcttcaagttcccatagtttaattatcagcgacatttgaccttttttttgttgctaaaatcttaatcccacgttgttaaaacgtatttttgctccattttccaaacaaccggatgtgaatgttcacccgcgcgtgtagctgtagctgtagtagattcgatacgtccatatatcgtccagcatcacggccaactactttccataattgggttagaaacatgttactctcagtcacaatccaaacgagcaaattgcacgccagcgtgcgactggtgctgccctcgtgtcaaaaggatggtggtgtggagaaatttcaaccaatttatttaatagcggctcgtcaaatatcgtaccatcaaaggttggttgtactattaactcattaaatattactgttttttatcatcatttttttgcaaaaaaatatagttccacagcatataagctatacactttgtttttttctattccacaaagaatgcaaaatctaccacagtaatagtaacatgtttcatcatcttattaagattgaatgactgtagataataaaccaataattatagtatcgaatgttattagactaactgcaacatatatcatgtgataaattgatctagagttgtaaatataaattatacacaataaaggtgatcgaatttaaatcattttagttggcacgtaaccttacttgcatttttttcgaggcacagagagtgatgccagagtagttct

SEQ ID NO: 3525 - DNA, 1283 bp, Zea mays
  misc_feature (1)..(100): optimal_loci_282950_G1, chr8:104274024..104275306, Cluster 21
tccaggtggccacggtcgtccagggagattttagagcacagcgactgctcgctgagccgctgacaccgactgtgtcgatgtcgtctctgcttcgccatatttcaggacctcctgacgccgactatagccgaccgatcagcgtctcggcggggcccagatgaatgcgccacggagttaaagccctcaaccgtctcggcgggcgacctatgcatggacatattcattcatcatatcccaagatcgatatatatgttatatgaagaagtcggtcgatcccatcccgatcggcgatcggcccgagcctaataatgatgagctctctagtactttgtcgataatggcgtgcatatagtctacgagataaccaccaccaagttaaggacatgtttctttctagattatataatgcacctaatctaggtatctagattacataatctacctaataatatatgttatttatttgtcttttaatctatttaagctgaattatataactaaagggtaagcaaacagtaacctaaaaaactcaaacgtcaatttgttcaagtagccaaggcgtccagtccaatctagagagtattagagcatgcttgtttcgttccaggattatataattctagtcttctagtagacatgtttgtttacttatttggatggattaattggtagtgtttgaccgcaaaaacaataataacctatacgttttggtgtttcacattatttgtttactcagattatttatttttctctttttcttttatatttattagaaaatataaaagaaaaggagtaaatcacacaaaaccagatacaaattattagaaaatcctagtaaatcacacaaaaacataaaataaaaattctgattatgttaaacttcacataagcagatctatacagtgaatatatgatatggtcgtcccacgagtgaaatgtgatcaccggtcttgccttcgaatagcatggtgccagatcattcaccaaatttgacggtgttgtggatcaccatgtcgatgcgagtgaaggtgtgccaacatcctaacatgtttggcgatgtggtccttgccctttgacttgttacaacaactctagcccaatggccatgtttggcgtagcgctttcactagttgttgttgggggcctgtccaccactggattggcccttgtagacatcacgcgatgcaaatccaaagctctttccattgccatgcccacgacctcacccgtggccaccaagcttcttgtcgctagcgccactatatcaactccggttgcccctc

SEQ ID NO: 3526 - DNA, 1059 bp, Zea mays
  misc_feature (1)..(100): optimal_loci_285395_G1, chr8:117200954..117202012, Cluster 21
tccaaaagaatttaaaagaccttgatatttcagaatttaaaagacattgatatttcaagtgaattcccagtacatacaatccactattgccatcgggtgcatgaagttgcttcctctatctagcttcagcttcttgtcctttagcaactgctctttgcatgtaaacaagccatcacttagattgaataagaaataccgagaacagaaattggtaatgtagattattaacagtgatgatttctgagagggaatcacctcctgggttcttcacatcaaagcttagcatcatattccttgtttgggggatattttggtagatttgatggatcgcaggcataatactttgttataaagaaccacaaaaagaaaacaacaaattaacaaagcagcactaaaactgtacctctgaattgaacaaccagatccataagaacagcctggatgtaataaacacataaacctaagaggctagtatcatctccaacgccttctggtctagcagcaaaaaccaaaaaataatattatcttttaaaaaatatcatggtagttgatgcaaacaaaaaactataattcagaatagggagtgtagattttgacgacctttaagtccaaaaccttttagcctggtattttgattttggttagcagagtttgtaaatttaatttaatatgattttgatgcctattagttgatagcaaatggtgtggttaaacaaaatagatggctacttgcaacactgatacgattacgtaacaaatacatgctcatattacaatagtacaataataatcacataatgtaacacttgaagagcacttttatgtttctctggatctaaaaacatattatttgtttgatttctgttggtactggtatgcgctaaggacgtagatactcaagaattaatagatagagctatcactaatatttgaggtaaagtttaaactgaaagcgacatagtaaaataccagaatctatgtagttgccagtagtaaccaagggataattttatgtagttgccagtagtaaaataccagaatctatgtagtaaaatacca

SEQ ID NO: 3527 - DNA, 1253 bp, Zea mays
  misc_feature (1)..(100): optimal_loci_285630_G1, chr8:118385439..118386691, Cluster 21
cgcgtgggtgcggacgtgcggtcatccaatcagacggatattgtcgattttggaattaaattgttgctgaaattgcttaaatatctcactaactctctctctctttgtcttcgtctacagttgttcctagctagctagtacatgcatatgctctcgtaaatggtccgtactatgatatcatagcgcataatttcagaaaagtaattagaaatgatcttggtgacatgcatgcatggtcggaccccggcccgcaattaaattcgctcctgaattattgagtgctcgctgcactggagggaaagaatcattctcactcaacgactctgggtgaacgttaattaggcctatatatgctggctattctatatcttatatatccctctgatcttgtatagaaagctattataagaatatagtacagtactctctcaaatataaaatggataaaaaaataaaatagtacatacaacatgcattattatatatatatcctgtaccgtttcctatatatgtgccaaggaatttacggggcacctaaaatacaaaaaagaaacaagtgtggtagtacagtggttgatcgagctattaatctgaaaggatagtaatgggcgatcaaccagtaccactaataaactcctagtcgcttataatttattggattacacgtctctgtcaaatcttaggggaaaacaataatagagcaaatgagccactagatagattgaagtagaaaccagaagcgtaatggaatgtataattctactcctctatcttataattaataaaataaccagaagcgtgatggaatgtacggcttttaaaagcaacaatatataaataattacgtactaatgtattctacttctctatcttataattaataaaataaccagatgcgatcttgccttatatattataataacaagcgtaagatagttgcgtggtcacctgcatctatattactatatatctccgagcaacaccaggaagaataaagtagcaattaaaaaagcaaggtagctaccaacaagatccaatcagctaagggatcaagtggctgcaatataataaataccatagggcttcaaatcacagtagttcctaataatggctctgacgtaacaaactgtttcaaccggtctcaactcataaattgaataataataagaagcatcatgatatgcatgtagggtacatgcggtcagcagactgtcagcctcgaattagaagaagaagaagaagaagaagaacac

SEQ ID NO: 3528 - DNA, 1049 bp, Zea mays
  misc_feature (1)..(100): optimal_loci_286790_G1, chr8:124477633..124478681, Cluster 21
ctagaacccttagaacggttttttaggtacaaaagacagctaaaagattacatgatacaacttcgagctcttatatcattgatacagttaaaaaacaatatgcatcaaaggtcgtgaataaccgtctcttgatttttttctcacttaacctctaaagacctctcaaagaccattcatttaatagttatacatgctctaaggacatgtaaaccttagtctttagatcgatttttcaaatataaaatataactaaagtctctatgatataactctgagtgttatcataaatataattaagagataatataaatataaattgtgaagtcttttgaattttttcacttgacctcttacagattcatcaagagacccttaatcataatattttatgtatcctcggtatttttcctcggtggcagagacgtgggggccatttggtggccggcagcccggcacgttcggcactcccacctcgcctaccggtggcagcttgttaacttgttctttccatttcgaatgaagccggccgacggccatgctgagccaaatcgcctcacgcttcatgaaggttgtcttagggtatttgggaacaaagtattttttgcagtattgaaggtattgagtaataatgtagtattatatatttttggtgtttaaaactcatctgaaatctctatatactaaattatagtatttttaatactgcacttgttttgtagttttggaaattttagtcccaaccaaagtttttttgtgtaaagagagcgttgatgctcagtcccactctagccaattggtctcaaccaaagttttcctcaaacaacttgatgtattgtatattgtagtattcgaaaactaaaatattttaaactacagtaatgacacgagtaaagtatactaccatatttttaaaaaaaaattgtgttcccagatagggcctaaggtgcaggctttggttgttctctgtctgaaaaactatgtgctgtttgggacaacttttttcatgaatagcttgacgatctcagtgttttgataatctagttgtcaca

SEQ ID NO: 3529 - DNA, 1212 bp, Zea mays
  misc_feature (1)..(100): optimal_loci_288522_G1, chr8:133998499..133999710, Cluster 21
tttttgtaaccgcatatatcagcaatatataaacacagaccgtgaccctagagggcatggagcccagccaattaacacttttgacctgtacatggcaccgctacttgcacacttgtatttttatacaacaatacatgaaaagttcatacagaattttattccaggggatcaagtaggctactcacttgtatttgtatacagcatacgcattccatacgtgtagcagtatacaatgaggtgaaatgttagtctggtgtatatacaccggagccaatgaatgatctagctgggttcttgtgacgcagttggaatagaaaaacaacgctagctagcagtaccatgacagcaagggaattgtttgatatttgactactcgcagaccatgttgacatataatactgagaattactgatgatgaggctgctcatgagtcatacatagtaccttaattggtactcctgaactgctgatggcgacctcaatcttaaccatcccagcttaagcttgttcgttaagctatccataaaaaaaaccgagcgcagagtttccagtgtatctagtggcatctcaaggtctccatcctatttccattctgatggcgtcaggatcagcatatgacaattcagataaaagtgccagccgacgatggagtgacaaatcctagctagtttaattcctcagaaatgatattttttagctcacatagtggtgacaaatcctagccgatcgaaggacttctgaggatttcaatgcaaactcttgccgagtttttttttctttcagattctcaagtttcaaacgaaacccaatttgaacatagagtgaaaaaaacagttgtcagtgcagttttttttttatttgaaagaatgtgactcagaggattattgcaattactgtgatctacaggaaggagatgtaatcatctttataatactcatcgcttacaagtgcacagttgacttagagagagagagggagagagagagaggtgctcacagaatatatatatacaccactatgcatctgtattggatgcttgggcatgattagactgcatgctcatcctagattctgcaacttttgttttccttcatctattcctgctttcacttttcctttctgcctattcttaggttcattcaatagaaagcatattacgtgatgtctctctctcaccctctggaaaagagaaacgaaatctcatttcaagtt

SEQ ID NO: 3530 - DNA, 1204 bp, Zea mays
  misc_feature (1)..(100): optimal_loci_289955_G1, chr8:142470200..142471403, Cluster 21
aataaaaattcttcaaacttataataaattcacatcattaaataactaaatatcttcttcatttaatttcccatgtcatttatgtaggaaaaccattttattttaaacccttcttagaaattaatatcaatcatttactttaggataatattccttttatgtttacctccaattccatgtttctcatatatttattttagcaaaaagtaaatattttcaaatgtgaaattttaattgaaaaaatatataatttaaatctttaggggatttatcctactgtatagtcccacaaaatattaatttaattcatgtgatgattatctgtttagtcaatcctatattaggaaaccatttatttaaatcttacagtagtttccccaaaagaattttggggtgctacagagagctatgatcttataggtcaatctctttgtatgccccttcaggcttggattttggcgaatcttgatgtctggatgttctgcttgctcattttagttgagctatgatgatccagttgttaatgttcagccatcattcttttgcatgaacatgctaagataactcaccatgttgaaatactgcaaacagaatagccaaaggtaaagaaacatgtgtgcgccttgtgacactatgtttcttgaaaggatggggatgttgtctcaagcgggtaaattggcgtttatggaaaaatcttgcacaattcaaagaagcggattataataaaggttacacggatttgtccataacttatgcacgtatgtgtaatttatgcagagatctgtgtaggttacacaaacagtcaatagaaagctcaaaagattacacttgcgctccaactcgtgttcaaacaaaacttagagatgtgtgtatggaggagtttattagcaagccaacgaagcacctttactcaaaatagatacaatcaagtagatcgaaagtgaagcacaaatcaagtaaaaaactcaagagaaattaaaacaaagtgaagacacaataatttatttcccaaagtttggtatctttaaaggaaagatttactgatagagttctaattccaggatttcactaggtcctcaattaccatctggtaacttagtcatagatggatacacatagatcttatttctaaaagatagggatgggaggaacttggtgttataccttctagactgatgttgaaggtggcgttggctattgcagt

SEQ ID NO: 3531 - DNA, 1225 bp, Zea mays
  misc_feature (1)..(100): optimal_loci_290508_G1, chr8:145368992..145370216, Cluster 21
tgtgttgttggtgtctacaagagttgtctactagtggtgactttttagaacatttttggttgtgcaaacattactatttgctatcgataaagtattgcacttttgatatatccactgtgtgaccaagctatacatgtgatttcaatacatatgtatagtgagcataatttgttgactgctaattaccgaagtttggccacagagcgtcgccgctactaataaactaaagattgaaggatgtggtgtggtagatgagtaccataaccaggcgaacgcacggtaggagtattcttttttgattcttatgtgtgtgaccactttgtatatttggtatatggaccatgaaaaatagtgaaggtagtgttttggtcacgtatgactatagccttaaattattagccttagacccaaatttgcccctactcgtaatgtagtatggaatcagggaatgtcggttatagaaataaagaaataagttaaatatatcgggctagtttcactgtactcaacctgcttaggttatttacagtctggtgtatcttcacacaatacctaatgctgacaatgccatgcatatgaaattacataagatataactatcctaatgcatgataccataggttattttttagtcctctataaaatattaaatgctagcatatagtatgagagtatgagatgtgggccacttggatgtttaaaattttaatgtatatgatcccgtacacagatagtatctctcaagatacaactttcttctcttttctcttaactcccttgtcacatcattaaaaaatgcttatatgtgaaatgcgtaggttactgtggacggggaataaccttaccaagaaatatgttgcggaaaagtaaagttatttggccgtgtgcgcacccgtccaaatgttccaggatgggtcctgtgattaattggtaattcctccatcacacaaaaaaattacaattctaacggtattatattttagtattttaaatttaattaattataaataaatattataatatttaataaatattgttaccctaattataaaatgtgtgtttataataaattaatttagaactataaatccaaatactatttactaaaaaaattcgatcaaacgtaaaactatttggtacatactccatagttgcatcgactactagtgcgtagctagatggcccgccatgcatttgccaattcctacgaggcaaatgtgcacat

SEQ ID NO: 3532 - DNA, 1180 bp, Zea mays
  misc_feature (1)..(100): optimal_loci_298702_G1, chr9:8021623..8022802, Cluster 21
aataatattttggcacgtgttaaagagagaacactgtcgtatcactaaacactagtacaatgttcgtgctttgtgatggcagacaaattatttgataaattgttagtacacgatgtgtcttaaaaatatgcttcaagtatgtatttttgttatgtgctcttccatggaggttgctcactttctcgtggatgcatatcagttcatgggaacccagcgctgccatattcggcctataaaacaccatccgagccattagtgttagtttgagagttataaaaccgaaggatattggaggaactaaaatctccctcttatttagttttgaataaaaagggattctagcctctccaaaaccactccaattttatagatcctaaactagctcttagtggatgattgtacaaactgggtctgaatccatgagcttaaaaaaggcaaacagtcatcgtgcaatttaatacaatggaagaaagatggcgaatcaaataaaggttagagcactcaagagaccagtgagatgtgtttatgttttttagataatggaaacaaaaaagtttcagccttttgtagtctcctacatacgaccttatagatcaaaacttaataaaaacacacaccataaaaatgacatccttagaaagaaacacgttctctaatcaagcgccatctagtcttgcattagactttcattcatgtcttgtaaagatctctattgctaccatctctaaggattgatataccgtaagaaccttgtagtgagcttcttctttctgcaacagtctccagagtctgaaccagtatgttcctctggaaagaacctgcaaaattgatgttattggtttaaaagtaaaggtcacctcattgcgacaaagccaaatagatcaaaacattactgccactctaattaatagtttttttcctatgtgttgttcccttgttaacagctcaactcataattatatgattaacactgttggaaaagcaaagtaaataattttttaaatatttttagcaagatagctgaatagactcattttggttacataaccagaacttccgttccgtttgtgcagtctatactccagaattacatttagaatggaacaattgcgatagtttctcgtaccgtaattacgtttaatcgatcaatttacaaatcacccaataaggatggatatag

SEQ ID NO: 3533 - DNA, 1271 bp, Zea mays
  misc_feature (1)..(100): optimal_loci_300068_G1, chr9:13906192..13907462, Cluster 21
  modified_base (1002)..(1002): a, c, g, or t
  misc_feature (1002)..(1101): n is a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
ccccacaacactgtgaaggtcagtacagcttgttttaagctcgaaaaaaaccttctcaacagctggtgttgaaattagatttgcactggaggtaggttcttcaagtttgcccagaatctcatgtgttttttcttctccagctgtaaattttatttcatataaccaattattatagactatgaagccctgaccttgtgaacaccagaatcacaacaaattggtaaagtaaaatatctagcagctagcaatgcacataaagacctagagctggcccaaaagagatggaaacccaatctgctctgcacggaatgcatagaatcacaaaatcaaatagcaacattagccgcagagaaacaaaaaagacactaaaatagctgatgtaatgatataaagccattaaaatattgtagtagcaccgtcaaaagtattcacaagaaaatcatgtagttcgatctacgataaacaacaacctagaagcagcaaaattagcaagtacactccaaagtctgttcgggacagctttaactcagggtggtttcagatagaacactttaaggctgtggtttcagagagaacactttaaggcaaataggtatccagagttccagaccaacataaatatgccctctaaattcccactcaatattcccatttttttattatatcactaaaagacaaaggccactacatgctagttccctgaattgcaccacatataaaggaatctactggaatcctacgccacatatgtatctaccaaaggtccaaaacaaagctgagtaactcatccaactcattgagctatgctgctgcaaaaaatataatgtggaattacggtcaatatttttttttgttgaaagaaacaacagggtacattgcttgtgtgtaaacttgagttgcatctgcgtttattgtatgctatgttctctgctccatctgggtcaggatagagaaaatgtacgaaacgaatcaagctgaacatcgaataccgggacccatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgttcccggtatgaaggagattgcgagagcagaacatttagagtgctaaactcgtcaataattgattgcagaaaacaaataaataaagataggaaaagcgttgaacacaagaaaaagagtcgtataaaggtaatgtagtatctcaaggatatggcacatgggaacta

SEQ ID NO: 3534 - DNA, 1269 bp, Zea mays
  misc_feature (1)..(100): optimal_loci_300564_G1, chr9:17014391..17015659, Cluster 21
ctggtacagtgatagtagaagacttgaaatgagagaatataaataaaacttctcttgatggggtacaaaaggtacatatagctacaatacttgtgtaaattcatagttgaactaaccaaacataaaaaagatgctgtttcttaggttcccaccgtctaacgggtcggacaaacaatttcagagttacatcgctataactcatagtatttaagacattttatttacatctaagtcattgttgttattgcacagctaaatttaagccattcttttcaaatcacagtttctaagatatttttatattgtgtccaagttattcaagcattgcaggattggatttaagtcatttcatccaactcacggtatttaagacattatatgttgtatctaagtcatttcagtatttaagatattttatctatatataagtcattgcagccattgtagagttgaatctaagttgttctatccatctcacatcttctaaaatatttttatattgtatctaagccattcatgcattgcaggattgaatctaagtcatttctttcaacttacaatatttaagacattatatgttgcatctaagtcattccaatatttaagacattttatttacatttaatagcttttaatattttgtttacatttaagttgatactactattgaagagttgaatctaagtcattttttcaattcatggtttttaagatatgtttgtattgcatctaatttattcatacatgtactgtctagattaaatctaagtcatttcttccgtctcataatacttaagagattatatgttgtatctaacttattctagtacttaagacattttatttacatcaaagtcattcctgctattatagagttctaagtcattttttcaactcacagtttctaaggcatttttatattacatctaagtcattttttgcattgcaggattggatccaagttatttcttccaactcataatgtttaagactttatatgttgcatcgaagtcattctagtatttaagacattttatttacatctaactcattcttattattgtagagttgaatctaagatattattttgaactcatagtttctaggatattttatattacatctaagcccttcatgtattgcaagatagaatctaagtcattttttctaatgtataatatttaagatattatgtgttgcatctaagtcattccagtatttaagatattttatcgttcttgctattgcaaagttaaatctaagtcattc

SEQ ID NO: 3535 - DNA, 1075 bp, Zea mays
  misc_feature (1)..(100): optimal_loci_311848_G1, chr9:89011077..89012151, Cluster 21
tatgttgaattattgacgtgcataaatactggatcgtcaatcgtgtatgtttaaactttttattatgtccgtttttccaatacgagctcttttccgcttaaggaaacggcagctgaccttccaaaaatttgaaagcataagcaaaaggcagctaacctgccaaaagttgagcataaaaccgatacgagctcttctgtccgcctgagcaaaaggcagttgacctgccaaaaattgagagcttcaagtgcatattctatatatccgatctgtgccgtctcacgtaaatgatcagcgggtcagcgcaaatataatccgtgtgttctcgaaccggaataatttatatctgcggaatgagtggttgctgtacttaaagaaaagagcagtggttctgttagttgtcaataagcaccgaaattatttatatataggaaatgggtggttgctgtacgcctgtatataaaaaaaggagcagtggcgctgttagctgtcaaggaaaggctgagagaaggcacagggcaggaaaaataaaataaaacgtagaaaacaaaaaaaatggggcattccgagaattgaactcgggacctctcgcaccctaagcgagaatcataccactagaccaaatgccctatgttgataaataattatataacagtattattaccgttgttaacgtgtatgtagttgtaccgtcctgcccctcgtttagtagcttgtacagaaaataggcgtatattgacgcttccaggagccaaataacattgaagctttttgtcaattcgaaacgagaggtgttttactcggccatttctctcctcttctaaacccgaatttatcttccagggatagagatttggaatttttttgtgttagatcaggattttgggtaggagtctgtattttagacttcgtaggggaaatcaggatacaaatgaaggagcacatgactaaaagcgggtgaatatgagctaataaaattccactcaaaatgatatggatttacttcctgatttgaccaaaagagcgatcacatacaccaaaaatcctgtgaaggagaatacatacacatcaagtagtg

SEQ ID NO: 3536 - DNA, 1132 bp, Zea mays
  misc_feature (1)..(100): optimal_loci_313743_G1, chr9:99701540..99702671, Cluster 21
taggtctagacttatcatatatatgctataaatttatagctgtgcaatatattacggtattatatataataaatagttagactttatatacacaccaatttttttttaccccttatcaattttgaatagccattttttaaattttgggcccgtccctgtcaacatgtccggttgtatatgatatgttgccatgttaatttccctttaaaaattgttcattgtgttgcgcactttaacgaatagactgcagccccatgcattcgatagccctgtgtagtgttgggtttgtggcgtaggtcattgactcattgcaaacaaaacgcattagcagaacatgtataaaagtaattaaagcttcacacttacaatgtatcatgcgggtagtacttaaattacagagaaaacagtgaacatgcactacagcgcgatatgcccatcttatccatctatgctaacagtttcaggaatttagtttattgggttttttttattatttgaattggatcatagatttttttatgcaaagatatattgttagtaatcgaaaacaatagaaaagatatatcaacaataggtccaaaaacaaaaatagaactaatatcagcatacacaatttagatatattagaaataaaaatataaaaggggaaaatatatgtcaaaaatatatatttttttaaaaaatagtatataaggtaggaagatatgtcaagaatcgttttgaaaaatagaaatagaatttttagcagtatatacaaagtataaaatatattagaaatataaataaaaaagagaacgtatgtcaagtaacagaaaaaaatatatgtcaagaatgggatttgaacccatgccctttcggaccagtacctgaaactggcgccttagaccaactcggccatcttgactacatgctgatctcaatttatttttctatacatacaaatatatttgagggaagataatattgttcattactgcagttgcatatatggcggtggacattcccccttcagtaaaactcaaaaacgaaaataaaaacagatggatccttagttggtttttctaatgaagcgtatgaagtttggatggagtttactacttcaccctaaaaactctttttggtcagtttagaa

SEQ ID NO: 3537 - DNA, 1105 bp, Zea mays
  misc_feature (1)..(100): optimal_loci_319475_G1, chr9:130807254..130808358, Cluster 21
ccgctcctgttgaaggcataaacgacgtcccacatttgaaggagggcaattaaggcctagtttgagtactcttagattgaaatggtttagagtgattgaaaagtgtttaaatcatcaatagatcaaaaactcccgcaatacatcttaatccactccaatccctctcattcctagagtagttagaatgggttaattatgggtgtatgggcatttccaataataaattcaacttactagctcatataaaattttaaaaataaatacacagtaaacttaccatgctagatgaaaaatatgcatatgaattattaaaatatgcggcctatcattctcgcctcttttcattgaataaaaccaataataaaatattttatgagtcagccctcttaacatgtgggtacaaatatcggacataggaggatagcggttaccatttgggtgcaagtgtgcaacggaaactggctgaagaccaaacggagccaaagttatttttctagatttcctcttttatttaaggctggagatagagatcatttgtgcgttcccataagtcactaataccctagctacactagtcttatactagagaccgacggacggagcaacaaatagtatcctagactgcatgtctggagatgccttctttagattctaaagaactaattaattagtaaacaaatagaattgatattaaataaagtggcagacgtatatagaggaaaagggcaggtagctcaaaattaaatctgatcgtgtcataccttgcttgattcctgatcgtggacttcgttaattacgtgtttaaattaacatgtgcatgtacgaagtggccttaacattaaccccccaccccagcgaaaattaaagaagtgcaaccgatagagttttcatttgccacttcgagtatattaaattaaaatttaatccaacttgctttgctgcccgtcagatgcgagttgacttgctaaagtatacatgaattatagattgcttgattgctttctgacggtcgtactaaacagcgaacgctcactagacaaataatatgtgagaaaatcccttcaatgtcatctaaaactataacaatctcttcaataccatcgaa

SEQ ID NO: 3538 - DNA, 1326 bp, Zea mays
  misc_feature (1)..(100): optimal_loci_320616_G1, chr9:136147305..136148630, Cluster 21
gcttaataaaaaaattgaaacgctcaactttagctaaaattattttaaaatttgtaaacccaaacaaatatactataaatataaaatataagtaaaagaacgtatcaggtgtaaccaaactgattgatacaaccgtacaaccaagacacaaggatgatagcgatagaacctttttacaaataccatttttttttcataacaactgtcccacctctttctgccttttacctccatccttgtatcttggatgcaccaattagtttggttacacatgatacattctataagtaatcaaaatattgaaaagttattaaatattataagttttattatgttattatataaatttagataaactcgacaccatttgactatcggaaacaattgaaatctcgtataaattttggatggaaggcattgtggccatttattggcaccaaatcctgatcgaattgatgctagtatattgacgaataggctcaacataaggaagctatttagcatacgtagaaggataaggtccaccgggtgtgtattttagataggactcatattaggttaaaatcatttagaggatgcttatcggtaaatcttatactaagcattgttattagcaaaatttatactaagcattgttatctgctgtgcatttacgttcggtcgctgacgtgcggacccaggcggaggctggccctgcatgtcaatgacccggctagctgcaggctgcagctacgtctaaactgtagaagttcatctttatgttattgaattgaatttacattgtcaaatatgtatctctcgttcactccatgacgtatccaacatatctagtactctgtcttatatgctttggtcgtattaattattggagatatggagccaaagattgcaggctgacaacggcacggcgtgcctgctacggcgaccggtggacggtgagttgccatagtggagcacacgggtgcggcgccagaatgtccacagctggagacggccgccgtcgcgcttttggttctgcagtgcacagagcaggggtagttggcgggcgctggtcttgcggtggatctggactgacagtgaaagaaaagaggcgctaaacgccgttttttcaagttaaaacaaaatcaatggtgtactcctgtgcgcagaaagttacgtgcaagcaatttgcaagtgtaaaagaggttacgtaacagccaaacagatttttacgtgttcgcctcggcgtcgtgtgaactgtcgactccgatcccgacgtccgcgtctcgttatccacatgcagctattttatataccattttctctatttcaatgggacctagcaga

SEQ ID NO: 3539 - DNA, 1108 bp, Zea mays
  misc_feature (1)..(100): optimal_loci_320619_G1, chr9:136154618..136155725, Cluster 21
taatgtaatttttatccatgagatatggaattttggatacccattgtcaaatctacacgtcccaccgaatcaggaatagagccatatatatatctcgtggaagacacggacacgccggcgcatatgcagaccacagcgaccttgatggcctcctgcgcgcttgacgtcgctgactactgctccatcggcgtcgtgtaaaaagttaaaaagtaaactgccaaacagatctttacgtgttcgcctcggcgtcgtgtgaactctcggctccgttcccgacgtcccgtgacgcaagcacgcttcagcgttcgccggtttgacaacgaatagtcgaatatatactagggtatgatcaggcgatcctgccggatattattatcatattcccagcgcaagcttctactagtagagatttccggggtgccgtccccgtcaagatgcgtacccgagacaaggtgcacagcaataaatttaaagcgcggctccgtttgtgaagaatattcatcacgcacctagctcaacaactaacggtgcaagatcgaacacatctatacagtaagcaacaagtgtttctgtgtttgtataaatacgcctacgtgcttatcgtcccatccttctgccacctttatttatgtttaaattcgatcggagtatcatgcttacactccttactagttttgtttcaggtcaaatatttgtatctttgatcgtcaattttaaaatttttatatttgttagtgatataaaatttgcatctttagatttatttactgtgagaaatatttttataaaatatagtttatatgttggtgatggtttatttgatcttatgttattgaccaatatatgattttttttaaaaaaataatgatgatcaaagataaacatataataactaaatcaaaataaagctaataggacatgtatacaaaaaaaataattaggagtaatccagcgaagcctcgtggcaagttgtaccctcttttaatattgcatgtacagataagttcgtaataatgaaactacattggaccatgcatgtctggtcgcgctcgtaggccgttgaacggcgatcaattgcgccagaaagaaccggacaacatacatatat

SEQ ID NO: 3540 - DNA, 1114 bp, Zea mays
  misc_feature (1)..(100): optimal_loci_323309_G1, chr9:150195165..150196278, Cluster 21
aactgatgtgttgagggataggcacatcctaaggatgttgactacttgaacaaaccaatagagaactaccaacagattcctaccatctctggcaatgggttagcaactgggaagtagggtatggggtcaaatgaggctataggttcaccttctgactttactgaatgctcacaacatagtttgtcaatggatggggcaaaatgtggtctaaaatatgaagaaggaccaaaaccacatgaagaaataactaatatgaagacacatgaccaaggatcacggggtgggtctgcatctcagcatctgcaagcaagaccaaaaagaggtatatgctaactaaggaagatacatttgtgcatctaggaatgagtgttgttgtcaacaatgtcactaaagctattagtgaacctaaggtggtagaagtccacctagatctatatggggcggtgatgttcatgactggattcagtgatgaggccttaatggtggcatactcccacttgattgacagtaagacctaggggcgaggacgctacatctgttagtatgaatgaggctcatcgtgtcctctggttacacacattcctagctaaaaactgctacacaatttaggttctaaccgacagtgccgtttctagaaatatggggctccgaagcgaactcaacgataggccctaaataaatatgaaaatttatatatatgtatagtatagccaaagtatgctttaagtcacttaaataacttagatatgtattgttccatatcaaatactaatattaaaatagtaaatacggtgttaaccttatattctagataaaagcgccaacctcaaacgatgatggttcgatgtaattgtattctaatcaaatcactacgaattgagtagctattttatatttaactcctccaacctatagtattggatgtaacagattgtttggttgcacgattctgtgactgatttcgaaagataattataaacgatggaaatagatgctaaacgcgggccgcggatggcgaagccgctgtcctagatacggctctccatggacaccacgaagctcgaatccgttcacgactactgaaatggtgaactggcgacatacacattgcaat

SEQ ID NO: 3541 - DNA, 1293 bp, Zea mays
  misc_feature (1)..(100): optimal_loci_32355_G1, chr1:198533952..198535244, Cluster 21
cgcaaaacatttcgcctatgcttccttgctgcatcgcgtgcaaaagacaaacaattttttaactgcagatattgaatcaccttgttgatttcttggagcatgttagggtttttttttcctggttaatactagtgtgctaatcagcagcttgccagattcatacacagacaggttgccgtaacttgtatccctgcatcttaacggattggcaatacattgttcatcattcgtatgagcgtgatcatgctagcttgctctagtactcttgcaactgcaagaacgttccttgcaagtaatgtgctccatctctggcctatcgtctatatacagctggctagcgagaacaatgcatcaccgtcaaataattgtagatagatgattctccggccgcattgccttcctctaatataatctactcgtacacgctacatattttagataatctagagtctaaccaggcaatgcaagatactacatttgttgaattaattattagtgtttggtatgacggcgcaatgcctcttgctgccgtagtcgtacccacatcgcgacctgactgactgcccatttccagcagtgcttactccgtttggaactaaggaaattgcatgatttgtgatggtcgtcatgggtgtttgagaacataagaataatctgtcaaacttggttatagttttcctctttgaggctttgacgtgatcgtttctgttcgaagttattctccacccccccccccccctagtttaaaggcttgttaagtccattttacgaaaatatgggctaattatagactaatgaatggtaacaactgattagacatcattagctcttattagcttagaactcacccacatttagcctttttaatgggtattttaaaaagtttgatgataagaggggctgtgggtgaattgtacttttaaattgaacaaaacaagagcttatggaatcatcatatcatatatgatgactatttttatgtaattattgtgtactaacattttatcgaataatttttgtaccgtcgtaacacacggatattatattagtaccactctatttttagaaaattagatggttagttcattgtgatgtcatagattggcatgaaaatgaattagtttctaacttttcaaacgaaatggtataattctagctatatgggctaattgttagctcctgatcaattagtaccactctatataggctaattgtgagagggaaaaatcattgcgcgagtttatcgatagataagcacaacgacccttaccaatgatgcacgttgtgagacca

SEQ ID NO: 3542 - DNA, 1005 bp, Zea mays
  misc_feature (1)..(100): optimal_loci_325185_G1, chr10:3964515..3965519, Cluster 21
ccatattcttcgttatgtattggtgtgggataatatggcacgctagagaacgattttcactattatattttttaatctaaacacttttaaataaaactcagaaaactatgtacaaaagtatctttatccaacactatataaaaatatgtttttataagacggcaattaatatgtcattacaattttatattatttattttgcatctcaacaacctcgaatgataaaattcaaaactagaaaattatagatcacagctatactttttacatgaagagtatcttaattggagaccatataaaaagggatgaattttctaagacagtaagccctgatagctgctaaaagtttatattacttcttagcattataacgatatcaaataaaaaataaaactgaaaagttagaaaatcgtatatctgatcgagaactagaatcccccagtgtcatggccaaacagtacttccacacctactagaaaggtgcggtaaggtttttcacgtgaaaattgttgtccagcgtgacagatcatatcgaccgatgtacctatgtctacgtgattttgccaaaactgttagaaataaaaataaagagtggataagtaaaattattccctaccgcagacaccgctgctggatgcttggatggacggtggactggactcgaagggaaacattgccaaaagaaaatctgcagttgaactctgttgatgccaaaagaaaaggtgtgtgctgtgttctgtccaccatgattagcttctaactagagatagactcaatactaattaatactaagatatcgtttggttcacgaaatgtaacataaatgacaacggtaataattcacactctagtatcaacggtaacaagtataaatagaccggtattagtttatagggtggtatctaattacgattgaacttaaacaaacatagtttaacattatcagttatacattatgttacaaatatatgaactataaacaaggcactagatgattacagttgt

SEQ ID NO: 3543 - DNA, 1143 bp, Zea mays
  misc_feature (1)..(100): optimal_loci_326363_G1, chr10:9894001..9895143, Cluster 21
ttatattccttatagttaatgggtttagtctcaaatttaattgtactgaaacaggaaacaaattcaatcatttaacacaactatggttattctttcttcgtcatgcatgtcatgtcctcgattcctcataaatgtgtgtgttcatcaggttattagtgagatacaggaagaatatcaaccaccaaagagtacaggaaatagtttctctacctcaactactggcaaaaagtttgatcgcatgaggacaatgacactgaatgatgatgtacttgttgggagaaagactgagaaatctgaagttattgatttgattggtcaaccttcggacaagctctgtaaggtgatctctgtgtggggaatgggaggacttgggaaaactactcttgtccgaagcatctacagaagccaacagcttgatgactggaactggaagcgcgcttgggtcactgctacgcgtcctttcgacaatgaagtgctcatcagaaccctagcttcgcaactactccacgattctaatacagcaaatatgaagttggatgtcttaagaaaaaagatagaccagcttctactgaacgagaactatctcattgttcttgatgacctatcatctattgaagaatggaacttggttcgagaccaatgggcaaaggctaaacgcatcatagtcaccacaagagaatatagtgttgccaaatattgttcgggaggagacatgaacacgcacaaacttcaagtcctacaagaagaggatgcacttgccctcttcctaaagaaggtacttctgaacattcctctgtcaattattactattagtccatcaacccgtgctctcacaccggataaaattttagaagatataagtatattgtaatgccaaataatcctttcgttctaagttataacatattttgtgttttctaaatatatatgtttttaatatatcttgatagtacatctaaatatatagcaaaagctaaaaaacttaaagcatcttataatataaaataaagagagtacatttcactgataagaattacttattttttttatttattttctaatatgatagatataatagatactttatagtctatgtctagttatcatgaacatattaattactatatattttaaggcactaag

SEQ ID NO: 3544 - DNA, 1143 bp, Zea mays
  misc_feature (1)..(100): optimal_loci_3280_G1, chr1:17004831..17005973, Cluster 21
gccataatttggacatccatactattagaaactctggtgacattgcctgattggtgaatagaagaatgactaatattatcaggaatgtatcctcaccataagcacaaaaaggatatgactgtgacaaacaaatggaatcaaggctaaaatacaaaaaataaattgttaatgtgatacttacttggatgaggcgcttccatgacatcatatgtgtgtcgcgccattcaactcgaactggttgagaaactccaacattgttcgaggcagattaagcgtcagagtccactaccacatattccacacccacatcatggtcgggttatggagggtcatggggtcccaaatttcccaactctggtgaatacccatgaggattggaatcaatggagaccttacacacaaccatgttcaaatattgggactaagtccccatcactgatcacacataattctaccactgatccacataggcaattgatgccatctgccttataattgagcctttcaaacacatgtgaaataccctctcaactgagatatgatcatcatttgcatcacaaggtagattcttctagatctagcaaacaacaactgatcactaaatagcacaaactcgctttgcattctaacaaagaaaatatttccctagtcatttttgtgcatattgttgccatggtactatgttattagaatgtctatctatttcatataaaggaacaaacttagtacctttaaatatatttgagtacaagtgactaaatacaaactaaagactatcaaattaccaactaactaaataatatgtacctaagttttacctaattaactaactaaacaagacctaactatctaagtaacgaacaaactaacaaacaaaatatccgagttactaaataacactaactaagtaactaactaactactaactaggtagctacctaactaataactatttgaagtaactaactactactaactagctaactaataggcaactaactagctacattactaactaaataagttactaactaaatcactagttaagttattaatgcataaaaacaccttcataggtaaccatgcaaaggtgtgtgctataggcgggggatcgaacgacggcgtggaatgcgaggttgggcg

SEQ ID NO: 3545 - DNA, 1067 bp, Zea mays
  misc_feature (1)..(100): optimal_loci_337386_G1, chr10:79123407..79124473, Cluster 21
tagggacaaggatggaagaattttcttctaaatagggtgagtatggagagacgttccccatctgaattttttccattgccatgtctaagcccacgcggtcaggcatgtgacctagaggctagacgggcactgcccaggcacaacctatgcacctacaattagtgactttgtcgtgttttttgtgaaaacatattttttagagatagattagatccaaaattagattctaatatagggtttctaggatttcatggagaaatctttgtggtgcttttggaaagcattttgttcttggtatcaaatatgatgtttaaacaagattagtgtagtaatcttgttcctctttctgtgctcattatttgcatgtccagcatttgattatagattgatttgttaaatttcaaatgttactcttgatttatttcatttagattactgctagggaatcaagtcagtgacctgcaaagtttggtcagctaatcttttatggttcttgattaattgtgaaattaaggcttgatcaactctcgttaatatgtcaagatatggaagtccagctgatatgactttagttgggttagttgcataattttatctagtttagtttgataatgttttaggtcgatccaagtgatgtattttgaacaatatcgttttttactaataaaacaaagctgatcaattctcgttatactctatcacaaccgtcttgatttgttaatgtcacaacatccgaaagtccggtcgcaatggtttcagttgcgttacttacgtaattttatccaaatttagtttgattaaatttcagatcagtcaaagttatggattttaaacaatctcgtttttactaatgaaacagagttgtgtctagtttagagaaacgtgaattaacttgattttgtgattagaaaaaggtgttataattataattgagcttttgcgatcatccatttctttgattgcctatcgctgtatctttcaatcccacaaggggaaattagacgtgtttttcaaacctacaaggagaaattagatggcgtggcatagtggagcctcaaatggtcaaa

SEQ ID NO: 3546 - DNA, 1251 bp, Zea mays
  misc_feature (1)..(100): optimal_loci_345609_G1, chr10:124673488..124674738, Cluster 21
aaatagaggcggtctgtttgttttaattgacttttttgttgcatcaatatctcactaggtgctttcaatgtatactgaatcgtatattagcttttggtacattctgcaggagctcgaccaaggggtataacacgtacattgggtatattaatgagataactctttattcgacactagaggcgtaagaactttttatagagagcgccaaaaacaatatttaatagattatgactctgtttgggatagctcatgctctagaaaatctggtacaattagtggagtaggttattagatgcttcataaaatcgtggacctaaagctgcaagtctttagaaaacatttagatagtcattttgtttattatttagattaaatatatttttaaaactatttaaattgatatataactgtagcttagctgaaagctggagatatcccaatcaccccttatatatagaacataacttaatagactatatgtttttatcaaacacaaaaagaaagaaataaccgatatttattgaatcaaccaatgtttttatatacttaactatttaaaactagtagtaattaatatgtatttatatgtttgtacaaaccttagggggcctggccaggccctgccatccccaccatccccacttgtctaggccactgttcgacactaagctagtaattcatttattggttctcagtattaatctttcctattaacagcagatgtaaatttgattccctatatgctacaccacaaatttggactcctaacaacattaacttccatgctaaaagacgatttacccctatgaataatcatttgtttattcatgaatacttacaataaaaattattggtattctaataattatttgcatataaatacttgtgagtaattattacaattatttatacataaataactatttaaatagttattgggtaaaatcatatttttatatgaaaacaacattattagagggcagaactaatgatagtatcatatagaaaaaacaaatttacatggaatatcgaatagggaagataatattttcagggccaagaaataaatcaaaatttttaccggtgtcaaataaagaattgtttctatattaacaccatattagctcaatcaagctttgatacaatgttcaattagaaaatatccataccatatgtataactgtattactaggtaaaactacttgttgtgtgcatcaataaaaatgagagatacttaggttacaattcatg

SEQ ID NO: 3547 - DNA, 1165 bp, Zea mays
  misc_feature (1)..(100): optimal_loci_346552_G1, chr10:130364949..130366113, Cluster 21
cacagtccaaaatctgagtggagcctaatgtaggggcctactaactaatggacttttatatctacagtaaataagatagaaggttcactaaaaccagaaaattgagtggagacatgtgccctcactcaccattacgtgggtccacctcaggctactcatattgtactaacgtttttaccttcactaatacaatgttcgtgcgttgacggtacataaactattcgataaaatattactaaatatcaattttgattgtgttgctatgacacataaattgttcgataaaatattagtgttgacaatcaatctctattgttataaaacatcattttaccaaaacctgtagaaataattagattaagcatcattttaccaaaacatgtagaaattattagattatatagctgtcgtgttccataattgcgtacataatccagattagtctaataaagtccctatatttcctcccatgtacaaccaaaaagaatataatcacatttcttttcacaatctcgctgtcagcaccattgacctagtggttgtctcatgattttctgttagtattgtaattccatctctgtaacggacattcaaagccagtaacaaagaagctgttttaactgaatagtagtcatgatctgcagccaagagatacaatcaatttaacaaaaaatgatagttatgctagatgtattatacatgtaaataaagtaatgaacatcttctaatttttttatcacctcaatacaaaatgaaattataaaagtaccttcgagcattcaaataaacgacatatttgcagatctaaattaccaaatagtatggcagttgctcactcttttgccttatatttaataaagatcagatcgaaaacaatgtgccaacaaatcaaccacactctctgaaatctgaaactatctggaatctgaagcacacacaactcttatgaaactgctggaggaggacaaataaacaaaggaattagatatcaaggtatgggggttataatgttaataggtgtcaagtctagaggttggtaactgttgttggttgatgtcaagaggtgtctcttcttggtctgagcttcattggtctccaaagttgattgtcccaataccatcacggccaaagcacatcgagaaggaattagacgtcaggacttttg

SEQ ID NO: 3548 - DNA, 1314 bp, Zea mays
  misc_feature (1)..(100): optimal_loci_347364_G1, chr10:134592006..134593319, Cluster 21
tttattaagttcttatccatagatctaattaaatagatgtatacaacattaggtagagtgcagtttaaataggtggcctccctttttttgtcatgtactcttgtggtaatatactatagttactgtgtctgcacaagagacaatttaccaagccatgcatgcatgcgcagcagcaagctaaaggcctggcatatgtgcagaatgaccagacagaatatagtaaaagatggctgcacatacataaataattttaaaagctgcatgcgtatgcatttgttaatgtacgagtacgactacatatactagtatactactacccccacgcaggagaaaccggcgtgcctctgcctccatcgtctcttattttctaggacggtccatatacttcagttgtaatcctatatatagcttctggggatcggagctcgttggaagcgcattaaactcttttgttttaattacaatgatgggcaaataatcttgtgtatttaaacaaaatatgcatggaacaatataaataccttcatagatatatcgaaacaaattataaagccaatgaattgacaaatatgatccaagcattcatgcacgcaccgtattgttccattaagtatatatcatgtaccatatgttgaggaatgagctaggtctaggcaggcctatctttaattttatgaaaattttaaaacgttcaaaagtatttcaggtatacgtcctagtctaaaataaacttataaaactgagaaaacaaaggatacaacataacacaatggttcctttgaggtattgagttggatgttccacttccattaattgtccaaaaaaacgggtcatatgttggtatgaaactcatccggtcacattttcagctagctatgaaacaaaaccttgagaccaaatggaaatcagcaaacagttagtcactgaaattcataaatatcttacatgtctgcatcattgagtagctaacaaaaatgcatacatatggaaataaaacggtagactagcacacccagggaatcagatatgctacccaaattaactttggaaatggctaataactgaaactttggtagcaaacatgtttctaaaaggaacgtgatatgccaaaatattatggctgaccactatccttaattaggttagttatcaccatgtgtattgaataaaaatgaggataaatgttatagttagagaaatggatcatttaccaagcgcgcacaatagtaagaatacaaaatccaacataaactgaaaatgcaaacatccttagaaaacttcagcacgcgcattctccatcttgaaagggatacc

SEQ ID NO: 3549 - DNA, 1364 bp, Zea mays
  misc_feature (1)..(100): optimal_loci_347516_G1, chr10:135594838..135596201, Cluster 21
gatggagaggctccattctagagagcgatcgttcgagggattttggagagtcggatggttcaacacttaaacataatttttaagccattctatgctactgggaactaattcaaacaacaacaaattggaagcgaaggggttctgtcccaccataccccgaaaccaggttcatgactcctgatggataataatatcataaatttgagaatattgtagtattctaaataataaggtgtttggttgaactttgtaaaacactattttgaatacctcagtatagttaaaactgcactatgtttagagtattgatgatgcagtttagatcaaagttttctaaactatggtattattgtcacatgcaagtatataccatggtattctaaaatcatagcatccaaaaacattctagcaaacagggcctaagtagttggatgcagggttttagactcagatagcaaaaagttcctggcccgaacaaaatggatgaatcttgaaaaattttagactagtatttatttgtgtcgactactgaaattattcctatctagctaatgtttagttaaattgtagcaaaaaatgttgtagagacatgaagagaaaatcaaggaatatagtttgataattttcactactatataaaatgaaaaacttttgttttttaactctatactagattgaatttcaaattggagcaaaattcatgattgttggtacaatgttgtattggacctcactaagatggatggcttttgctgaaattcaattcttctaaaccaaatcctacaaccctgtttagatgttgattctaggtttctctggtttcaagcacatacaaattgtaaaactattaaggatcaagaatacacaatagaggtaataagagtagttattgcattgatgagagcatctaatagtatgttacctagtagacttaacttttttttaaaagcaccttactattcaatccatgcacctatgcatatgcacaacaaagggtgcaagtacttcatcaatatattggacaaattgtttcataaatagatatatacgtgcagagaattatgtcaacaacatgagaacaatagattttatcaacacatacatgagcatacaaagagatggcattgaacattataatagccacagacatctaaaaaggccagataattaagtaatacatcgaaaatagtaatattattagagtcgaatagattagatagtgctatttatcatttttcattgaattatttgtcaccgggtttcggtgaagttgattatgaaactatttttgacaaatctagctagtgcccatataaatttcatgttgtttggcttctgtcgctaaatatagtaacaagctgcaa

SEQ ID NO: 3550 - DNA, 1226 bp, Zea mays
  misc_feature (1)..(100): optimal_loci_348032_G1, chr10:137839528..137840753, Cluster 21
gacctgtggtctgaccgtctgatgtgcggccgtgcggggcaaagcaagagtcggctcaaggatgcgcgctgtcacagttggcagagtcgcctgctcaacatcaatggacatggaccaacctgccgtccgaattgcatgaccaagatgtcaagatagttagcttaattaatggtcgactgctgccactgttgatcaactagatctgcagctattgctatgctattactatggcatggcaggtttgcgacctcagggggttcttttcagacatacggaccagaccatgtccgaggagggactcgtaaaatttgggaggattctaggtacatgttggaatcactcgtctaatcagattgcaagtatacgtctgagaacaccctcaaagtcaacttactacctcctatgaattaaaaaaacacaaaaataagtaagcaatgtaatctagtgcagaaaaaaaaacgtgtgagcatagcgaactgaacccttcgtaaaaaggtagtacctcattattctttcttattattgttgaacaaaatattctatgagctacccgtcatcatataaaaacgctatgagatctgtgccaactaagtttctagaaaatgttggcgacatctgtatctctagataaatctattgttaatatatataatgatctgtactaattatgtattgaaattgttattatttttatatatctagttaaaatttaaaatgtataatttctaaaaaaaacaagaatgatagtttttatgggatggaaatagtagttgtttaacactgttggagctactcaaatgatcaagcgatgatgactgatgatgatttaatgcggtagcttcaactcccatctgttcagatgctagaatccagaattccagatagtccaggtcactatgacacaaacatttagtctggtcaacagtataattgattttctagctcatataaacttgaaagaacaaaaaccgagtaacctaacataatacgcgggcttaggaaaaatatgtaagcaatcgatgcatgaataaaaaaatgaacttagcgctttagaactaacttattattattctctcttttttatcaaacaaactattttctgagctaattgttataatgacgacggagctgtcctttccccctagaggtatggataaccccatttaatatttaatatatggtctcttaagggatttttaggatgttaattgaaaaattgtgaaggg

SEQ ID NO: 3551 - DNA, 1209 bp, Zea mays
  misc_feature (1)..(100): optimal_loci_34963_G1, chr1:212525021..212526229, Cluster 21
gtctacttacgaaattagctacattacattctttgccatcgaatgccttgcgcaacaaatttaatggtctagctcagaggtcatatgaagctttactctaggtgtttagatttggatatatttgctttattgttgtgcatacaattgagaatattcaatccatgcagtcgagaagacaacataaataatcaagcagcagctagctgctatagagcaagcacctgagcagttgactaaacagagaaatgaaagaaaagagagtttgttagtgtacaatcacaaattgatcaaatatatggtgaaatcgttggcaccatagaggtaggtgagcatgtgacgacacaacaagtcaatgagatgatttaacacttgagaggcctaaagactcttggtctcagctccaggagcttgagaaagagaaggcacttttctatcttttgcctttttgtttattatgatgctacgacgcttcatacttggccacggttttttattcatgaaaataatttggtttgcatagtaataggttgaagaagggtcttgagcatgtaatcatggtacatgatccttgtaccattttggggatggattttcttagcacactgactgaagttcatctagatgactatgttggcaacaacttttaagagcattagtaatgatacattgtcaaaacttgacaagacagtagatagacttaatgaagataagaagttgcgtttaagcaacgtagaaccatagaattataaatatctttcagtgatgaattttgcggtatataagctaaacaagtacgtctggagcagattcatgtgttgttaatgggacctatagctctggtaaggcatatgcaaccatttaaagttggacttatgtcagctctgactagtatattggatcaactgaaaatgtctgtaaaaagaaacaacacttagcaatattttttattttggtgggttggacttatgttagtgcaaagtcattcactcgttttgtgaatgtaccatttgtaattggtaacattatcctttctagagagaagtgcatattggttaagcatgcaacaaacatcattatatatatggagtatttaggcattcatatcgacctaactatgttagcaagaagtatgttattaacaaaatttgcataaatgtaggtactgaataaaaagtcagcgacggccaaggcgctgcctccctattcatg

SEQ ID NO: 3552 - DNA, 1190 bp, Zea mays
  misc_feature (1)..(100): optimal_loci_40853_G1, chr1:242566812..242568001, Cluster 21
atccgtttgttttgctggtctcatgtgaatgttataaacattttgaaatcatgagatcactggtttaatgatataagtttggtttgagcacttactttatttcaattgaagtgaagtgcttattttcagtgtttggtagaaaaatttttgattggctccattcacccactgatcgtcttagcggtccttcatcaatcatcaccagatcaatccatgcttatgcaatttgtttagttgtctggcattatggtttttaataattatgtagttataaagataaatgtttaaattatattctctatggtgatttaagtaaaaacaaaattcaagaaatgattttacctattaagcgatttttaagtggatgagaataatataatcacaaaaaatgtccctcaacgtcacctataaaagtatccgatagttactatcgtaagtctctatacttttatacttttaagtctatattttaaatcttttgtatggtatttaaactatttatattataatttatgataatttttacttagctttcaaatgtatgatttaccatattatttagtttatacatctagaattacattgtaaaattttataattgttactaaattattaaatgattttatagcattgtatatcagtttttttaggctgcgaccgtaaatcgctttctcccacaaccatacgaaatttccatgaaaaagggaaaacagaaaaaaaaatagcacgccacaagatgcttcaaccagaacgttaaaactttgcaagattttgttcaagtaacagatgtcctgttctacaaaaaataattatcgaatcgtataaaagtgggttcagatacactaatatgacatgacactgaaaacctgtggcctggtagagttttgtctgtctggttccactgcatccaaacttcagagtctggagcattgcgccaatatcaaatggccgatttggttgaaataaacgaataatcaacgattcacgggtgtgattagaagtcgaacagtatgttgaccgcgtgaagtgcggcatctgctgtttggtctcttggcaaggcttgaacttgagtttgttcccccttttctcttgacctgatttttggaggtattatgattggaagatagtttagccgcattaatattatctgcatcttcaacttgtattgctttgttttgaaattttgcctg

SEQ ID NO: 3553 - DNA, 1249 bp, Zea mays
  misc_feature (1)..(100): optimal_loci_43854_G1, chr1:257778141..257779389, Cluster 21
ttagtgtattcgctccattaatctgtctccggttggaagctagtgcagatccaagcaccgatccttacaacttaaaatattttgtgttaccttttacttgattgcgagcttatacctaattctttgatacttggtgttcgtggccgtttcaagccttgttccattatacggggatcgcagggactgaagggagtaattttttctatttaatttgactagtaaaaggtttaatattcttcaatccacttgtaaccaacaagcattcagagcatgtacaactatatttaatatagggacttttaagtggtctctaggggtctaattgaaaaaaaaaatacaaaagatgatccctcacgaagaattcgtctctatacgactttccatacgtattgtctcttaactgtatttattgtctagtatcttaatattgtatcatgcagttttttaactgtcgcttgtatttagaaaaccattgtcaggtttgtacatgactttaggcttctaacgcacggttttcaatttgcaactgattattttccttgcacagctctcccataaatgtcccgccttatgtcgatactccaacggttataattaataatcagattatataattaaatcaaaacctcccatgcatggatgcatgtcgaaaatcatgttatttggatactcctacgattataataatcagattatataattaaatcaaaatggtattaattatatgatggattattataataaaatctcataaacaatcccataaccaggttgagaccaggttataagaatttgtcgatgctaaaagaccaacttgccaccaactaattgtccaatttactaaactataaaggataatataggaatttctcactttaacaaaccatcatcaatcaccataatctcgatacccaacgctattataatccataattctgattacaataatttgatgtataatctagattgaaattgtccagttgtgatccaaactggctctagtctcactctctttggttgcatgagtgtccataaacatatctgattagttcgattttatgattagttttctaacattagcaatgagtgggcccaataagagtcatgctcgttgatgtcctagtcaactcactattaattaatcatgcttgcatatgccatgacgacacagatcacacaggagatcagagcatgcatgctcaccagtggcgtagcagtataggaaaacttgaaaaatatgtcggcctgt

SEQ ID NO: 3554 - DNA, 1077 bp, Zea mays
  misc_feature (1)..(100): optimal_loci_45914_G1, chr1:269076651..269077727, Cluster 21
ggtagaggcaagtcaagtagttagtggcaatttgcagctgcctagccagacaatacgatgaagtataaagggtgaggttcagatatcagcgtctgcaagcgaattaggtttgacgtttaatgtattgattggtcatttaacgaatattttatctttttttgtctcctttagactttggttgacatactacactagagttatggatcatatattactaactattatattaaatctgtgattaattgcgctgcataaaatttagagtatatatatttacacgtaaaatttcaactatatatattatattgtatatgtcacatccttggccccctcccggcccgcccccatatatatatacggtgtttattataatagtattcgtttataatataatagtactatcttggtaccggaagaaatcagtttctaaaattaccataagtttttttatgttcgactaaatttatataaaatagtataaatatttataataccagataaatatatatatttaatgttattaatttagtttttacgctgttctcggcaaacttggccaaatataaaatatgacttaataactttaggaaacagaatattcaggtggtagactgggacattcctggaacaatatactttgaccaatagattttgttttccaccttcacacgtataacattgtccctgctaatagatctcatgtatcgtactcataaagagtgaaagatttccattatactacaaggtttaagtagaagtactaccagatctaaaagagggtcattccagatttaaaacttgattaggcttataaaaatgtactatcaatatttatatatttaatgtgattaattataaatatatattatatattttatctaataatatttattccacctcatgtcgatatattttaatatatattcgattaagtgtaatatttgttgatttctcgaaaaaattaaatgacaaataatttttttccagaagggaggtggtacaagatagtactcctttgctagaaaatagaagggtttatctatactatacttaaagcaccagtttcaacgatcgtca

SEQ ID NO: 3555 - DNA, 1397 bp, Zea mays
  misc_feature (1)..(100): optimal_loci_46575_G1, chr1:272669961..272671357, Cluster 21
gaaatggggatgaatcaaagaaatggggatgaatcgaaggtaatctaacgtgtttgtcttatccataatatatggatctttctgaattttccgatgaagatgctaacaagaagaaatacaacagaatatgtgtcaatggctgtgaagagcggagcaagacatgcaaatataggacagtttcaccagacaggcaaacaggataaattaaatgataaagaattgaaaacttctatgcggtgttagttatcatattacatgcatgatctatgatcataatggaagttccagttccattgaattaagccaattaaataacactgccagtatggttcgcttaccgaaaaaagaatgtttgttttgtcctggtagacagcattcattgctggagttgattcaacctcttttgccactgaacagctttctcctagtcaaaacacaaatccacaacagtaaggaactatattttcagtaactgatatttttgtgcagcttataatttgtacaggttgctctataaccacatgctcatcaaggaaaaagggacagttataccttctcacaaggaacttcagagtccagaagatcaattaacgactctatagcatatggcaaacagtttgtttataatgaaactattgctgaagtggtgaataatttagtctgacacagttttttccctaactcttaccataaaaaatgtcttcatcggagcaaatggttgatactaatttctaaaaccaaacagtggaaaaacattatatgaatgctaaaataggatagccttattcacacgtattattatgctattaaactataaagcttcaggatgaatgtggatgtcacaagaaaacaggagtacctgtaagaattgcttgatcaacacgcaattggtggcttaacatttcaaccattctcatgtcagccggaactttgcaaccaacttatccacaaaggggaaaaaagcatcaaccaaacaacatcaggaaaatgctaatcttaatactaaaagaaaatcattagatgagcaattgacagtacctcctacttcaactatatctcctgggacaagttctgttgctggaagtatagaaaagcaacctacaggattaacatcgataaatgtgctagtgctaatcagctatatatctaacaaaacatacaagaaaaatattttagactggaatttaaaaagaattgtctcaaatcagttgttgtttatgcagtatgaactagttagtatagcagagagcattgttttgaccgatgattatgttatatatgtgaaagggcctctagcgtaatggttaagacttctgagtagcacctccaagtctcgggttcgatccccctcggggacggattttctggtttggttaaaaaatcccctcgcgctgccc

SEQ ID NO: 3556 - DNA, 1311 bp, Zea mays
  misc_feature (1)..(100): optimal_loci_47311_G1, chr1:277132712..277134022, Cluster 21
tggtttcctactgtgattttcacatgtaccattttctttccaagcatagtatttattttgttgttctcaaatcattttagttcacgtggtgcttctttttgttgagaagatcttggaacgaagtgcagttctgttatgttgattagtcatttgtagaaatggcgatattaccctgaagtagtcaaatatatatggctaccaactgatatgcaattgtgtgctcatctgtagtacttatgacccagacaaggtgttttctctaccaatttttttgcaagccatatttcttggtcgataacatggttcctcggattacacggtggacaacactttgataattgagcccatgctaacttgattataatatcaatattccatatatatttttatcttgtacttcaaattagatcatcctaatttttttctatccgtatttcttggttgccatacatattattgaaaatgttttaaacatgtttcaacaactatctcatttgaacaaagtctacctatataatatataggcaccgtagcaaggcacgagaaaaaaagaaacaagattgaaataaatttgtggagggtactcttgggatggtaggtgccactatgactgttattgagatttgaaacttattggctttaacaatgcaggaaaacaataaggttgaaataaaaatattgacaaggaaagatgccacgatttcatcgagatgctgaaagtttttgtggtaacgtaggtaagagttttacgtgagaagcaaataaagcccattcaatattgcattgtacatttgctaacaaaagggagaggatcatggcaccactttagattaatcatggaatcgacggtgatgtccctgatgcgtactatggcattggtttttcggctcagttcgatgatgtgtacgataaccaaatgcaattgtatactatcgtagctagatgtttagctgggtgttagcaagcatggggaactcatacaaaaaaatgttcacttatatactgatacaagctttgatttggggtaaatagcttatttaagttgagatgatacagatgggaaatggttatatattgatcttctcttttgtttgtagtacactattttgttctgagctagaggttttcccctcctcgtgtccggttaaggcatgagagcccagaaccacttagagcaaatgatgacgatgaggaaacagaaacaacaagtagaatagacaaagacaagtaaaacaaactacaacacaaaaatgaaaatttgtagcactgcttatggagataaggtgccaccaaaggagcatggaaagctac

SEQ ID NO: 3557 - DNA, 1152 bp, Zea mays
  misc_feature (1)..(100): optimal_loci_50830_G1, chr1:295366011..295367162, Cluster 21
cacggccattcaaattcaggtgcccacgtacgtcagggtgctgctgctcctactgtcaagccaataaaagggttgtttgggagcaaaatggtttttaaaccatattatctcatgcgccaggtggttggttgcatccccgaaaattatgttttttaaaaccacggtattctagatactgtgttatttttttatattaaaaacttcacttcaatccgaaggtccttcgtggcacagctagcttttatctaataccatgtttcaaattgttgtatccaaataatgtttctcaaaattatggtgtttttttttgagctggcctaaactacggtattatcataacaattgcaaagtgtagtattgcaaaaccatggttctgtgaaacattgtcgccaaatatatcttaatcgtttggcttccatgattcacgttcctaatacagtggtactcgacctaaagcttgggctaggccattttggctctcagacacatcttaaaaatataagcattaagcacggtccaatataaaaagaataagtagggctaccacggcacatagtaagacacgaattaaaatcttagtagaatatgtgttcttattcaaaagtgtgtgtatacaattttgagtcacattgctagaaatagagatatacttttaaaggctttcttcttttcacgtatgattttttaatctataataaaataatgaataacggcccaccgtgcttttgggtcgtatcgtgcctaggttttagtatttgggtatgatctagtccaatccaacattattttgtgtccttctagccttaaaaaattgagtcaaagcacgatagatatgtgtcatatcggttcagcacgatccaactttcaactctaaatggtagagctaatgctactaaaaggggtcaaacattcgagcttgcccaacatgtgttcatggcttcatgccagtttggtggtaaatattttgatgccttatataaccctatttaatataaagtctcttgagaggtttatagaggctacacaactttcaatacatattgtctcttaactgtatttttatggtctaatgttttaatattgtattatgtagtctcttaaaccatcttttatacttaaaaaacataaccatgttatacatgccgtgagatt

SEQ ID NO: 3558 - DNA, 1177 bp, Zea mays
  misc_feature (1)..(100): optimal_loci_52477_G1, chr2:3869051..3870227, Cluster 21
ccgtttagtcgcgctgtctagcctctagcgcctttgctttaatggctaaccttccatcgtggctaatgttgtctgttgaccactcgtcgacaattcgtgtaaaaaaatctatcttctactactaaaatacacgtgtgtaagcgcgttatcgggaagaagaagaaaaaaactgttgtactcagttttgtaaggttgcctaatactaacgaaaacgatttttgggataacatacatgattaatctcagccttttatatatagacacgtaattaaaaactgctagattactttcgttatttcacagtttttgggataacatacatgacttaatttttcccttccgtatactgcataagaggacagactggacattaagcatatgagaatgacattagaaggtaaggggtacgcatctgacaattacatttcttcacagatcgatcttatcaaactagatgttgatgttcttggatatatatcttaattgaaagttgtttacaattttcagattctttttatttttcaaatctaaaaaacttgtgaatacttttttatagctgatctgctatttgcatttggcatcaattcatcccaaaagatatagtttatactaagtgaaatcatttaaatgtccattgttttatacacaaaaacgatatttatcacctagggtccatcacttgattaaaaggactaatcggactagcccaccagagaagtaacatcaggaaattaaccggactagggaaccaatcggcaactgcaccatctgaccaggagttaaaacgatcccacacgtgtttaacggggctgatccgtccgttgccctgtagtgcacaacaacaattatttaaccattcaaggtttaatttactttagccatttaaagtttagttcgaccattcaaaatatacttcagtcatttaaggtttcaacatacaacataaacaactatttagatattctaggtttacttcaacctttcatcaattttaaaattttataaggaagaaacattcagaaatttaaggtttacttcaaccattcaggaataaacatttagcgactcaaagtgatgaattgaggatgagaggcggttgttgcggcggtgttgagtggaggcgcgacaatgaagatctgtggacgttgggtggtgtggggtcggcgcggcggtgggt

SEQ ID NO: 3559 - DNA, 1273 bp, Zea mays
  misc_feature (1)..(100): optimal_loci_53432_G1, chr2:8960035..8961307, Cluster 21
tggaccagagatggaagtactccccgtgtcccaaataaacagttcgaacttttcttgaatttaaatatatttatataaaatatcaataatttttatattttaatatttttaattatggaaacaagagttctggctttagcataaagatatgtacaaccaatacatgacaattattgcactagagaacagttgcttgaataattaaactaactcgaagaaaacaaaataccatgactatagataacactagccaacttcaattcttgcatttaagcgccatccatgaattgcaatttgcaaagactttcatcgctaccacttccaaagctcgacaaacattaaagatttgttgatacttttcctccttttgtagaagtctccagaatctaaaccagtaagtacctctgaaaataagctacacaactgatggtattgatttattattaaaagccctcgtttcgacggacatcaaggatttatattttaaataagtttattgtaaaaataaatttagtactaatgatataaattatatactatagatattaatatcgtttttatttttgtataaataaaactaaaatatgtcacttcatggaaaagcgacaattaacattacttgtctattctgggacggactgatgaattacttacgtagtgcgtatgtcatgtagccccactggtacctgtatgtagcgcgcgtgtcagcacccaggaaacagtcgagtacgtccacgttcttttcgttttcatcagtgtctcgctgtcactgattaccacattttacctgtcgcccccgaaagcgccaacacgttcacaacgtagcacgtcggtgctcggtagtgtgtgtcagcatagttttatacttttatatagtcttgttgtttactataaggctgttgtattgtattgtagtataaaataaaacgaaattgggatgtcataaaaaaccgtgtagacacctatttaatatttaaataaataaagattccatttttcacggagactcgctgccctgtgctaggaagaagacggatagaggctaaaatttaagtgaccccggaaaatgacgacgaatccactaaactgtaaactgaaattaagtattgactaacaataaccccacgtatcacgcgcatatatactctcgcaaaaccagcatactgaaaactggattggatttagattttcgtatgaaactatccatgaggttcttagagtttaatcgacccccacaagtgttaatagcacattattaaagaagcatacgaga

SEQ ID NO: 3560 - DNA, 1247 bp, Zea mays
  misc_feature (1)..(100): optimal_loci_55492_G1, chr2:20001876..20003122, Cluster 21
tttcagtttccgccaaaaataatttgagttttttttcagtgactgcatgttgcgcgccaccaaaagtatgtaatttgagtttatttttttgactgtcttggagccatccataacaaaaatgaacctaaatatgcatataaaattcacatattatccattcatcattttccattcaacatcacatacacatattcatatcattcaacatcatccaattttcattgtatatcatctatccatcacatttaaatgaccaagcctatcacatattatccattcaacattattatatacacatattcacatcgttccaccatattcaaatgcccaagtctcatatccataaaaacaacggcaaagcaagtccagcaatctcgaaagcgaatatgtctttgagaaagtcaatagtgccaaagggcctctagacaagttggttagttggtttcagtagcactctttaggtcctggattcgactatctgtggaagcgaatttcatgttgtggttaaaaaattttctccgtatgtcccataccctgccctcggattaaagccgcagcgaacatggtgaatgaattggatgtctttattcagaacaaacaaactaaccttctctctagatgatgctaacaccgctgaaggggtttggtagatatttgtcataatcactcttgattcttagtatatacaagttgaaatagattgaataactaaggttgagtaagttcagctagaacacagtaagtatagtttcatccaccaaatttagacaaatgaaatttgaatctactagttcatctagattgactaaatatgtctagaatctactaagtttaattgtattagctaaactaaattaaaattggataaaattcatccaacctcagctaaaaaaatatcgatttcatatatgtttatcactgtgtgtgcatatatcatcattagtaggcatgcacacatcggcactggctggcagttggcacgcacctcttacccggccgtacgggatagtttatccacgcgatctgggactcccggtgcgctgaaaaagagtagtatttaacggcaactactcgtagcagctggcgacctcgtattgcatgcatgtacggcatcagataattaagctagataggtgtgcatggagatgctgaggcgtgtgctggactgcgacgccgtggccgtatgtgtctggagccttggtagcggcgccagatatattctacgtgtgccgccggacgagcacatt

SEQ ID NO: 3561 - DNA, 1201 bp, Zea mays
  misc_feature (1)..(100): optimal_loci_5823_G1, chr1:29670951..29672151, Cluster 21
acattgtttatatgaacttttagcgctaaaataagagatgttatatgaaagttcatataatcaaagttcataaacctatatcatgtgagagaaaggttacgatcatatacatgaaataataagcttatttgtaataaatatgaagtaaggaattcaaaacaagcatatgtgacatgttataagatatgaattagaaatagtacatgtcacaacatgacaaccatatacgataacataaagcttataatacaaaccaagagcaaaattaagtgcatatgaaagtatcacacacaaaaatcatatgaaagaaccaaatatgaatcactcatagctcccctctttcactcaactcacacatactctccactaccccccttttgcatcaagcgccaaaatggctccaaacctaagggtcctaaggatgagaaattgcaatcgtgcaaagaaatggagggtgggtgtgaaatcaaactgaattagtagggtatgctcatctaatgaagcaattgtttgtctagaaggatgtgtttgtgccttaggtgctgataaactagccggaggaacataagggatttgtgggggtctaatgaggccattgaggaaggtaaggtctcggtactccaagtaacaggtgcttttgaagatggaggctttgcactaaagttatgtaaaccatatgtggagccctagtaacctgattggtggacgttgttgaaataggtgacacaataacaattatcactaagatgaacgatgtttgaagtgtaatgattggaattacctcagacaccccatcaaaacatatagtctgatctagaacgggtgagatatgctagtagggactctagcccaagagttctcgagactatattactagggccattggagtctaaagtgtaggctaaggagccatattaactagcaatggtgggactactactctagactattggaacaggttgtgacaatagaccatgttttgagtgtgatctgccaacaactatcgctagaaattgatcatgtctgacctgatagtctcaaatagtgttagcatcatatctatctgcctatgttaggcctcattctatcggtgttgctcctcatgctgcttagcatcacatcttagttcatcatctattatcctctgctactgagtggctatctgctactgctctatggcaagctactgctattgtatcat

SEQ ID NO: 3562 - DNA, 1366 bp, Zea mays
  misc_feature (1)..(100): optimal_loci_58251_G1, chr2:35870330..35871695, Cluster 21
acgccgacggctctcgtctcctacactagaattttcgcgcggcgttgccgctcacacttttttatttttattgtgtttttttagtttttatttatcgttagcattgttttgtaaaatttaaatggttccaaaattgtagacttacatgtttatgaaagtgagaatgcaatataatatcatcacacatagaaggtataataatgttaacataacatctaactgtggtcgatggttaataaatatagtcttatgaaaaaaatataatgattaagcaaaagtaaatacatttgatgatattgcaatgtaaaataatgatgtagttttctaaagttttgtaaaaaaataatgttgtagttttctattaaatacggttttgtgaaatcatatgagttacatgattaaatgtaataaaaatagagaaaataaacacatgattattaaaaaaatataggtagacaaaatatatttaccttgatataactattgatgaaaccgattgagctaatgatctgatcttgattacctagaagaatttattttatattagtgcctgactgatgagaaagtaaagggatacaaaattttttgtattttctctatttgtgctggtgatataattttttgttttcttgagttgactgatcgaaaacgttgttcaaatgagtaaggtgcatgaggcactttattttgtggataaaaatggcatctaatcgcgtacatattatgagtccataggctttgttttccttcggccatgatttgtaaaatgaattaacatcgagtggagagagatgaaaggtgaaaaacacaacctgtagaggcgcgatgcagatttgtaaaataaatttataccgagtggagagatggaaggtgaaaaaacagcctatagagtatagaggcgcaatggagatttgaagttcccggggagcatcgagaagcaggtggaaatttcatggcatttttttgagccgcggagctaaagaatcttggattttgacgctgctcggcttgctatcatagacctaggagacacttgggaaccagtctgcgatcatctagactggacgattggtctagtgctagctgcttatgggttgttcggcgggcaggattggcagtcccgcttcaccgtgttactcgactagtaggctggtcgacagccacgtttcaccgggtcgctcgacagccccgtctcgttcggttgttcgacaggtaggccggtcaacagccctgcctcgtcgggttgctcgccaggcgggctagtcagcagtccggtcggtcagttagtgggtcgttatcgagaggccttttggccttctttgggtacccggttctcagatatctaacgtatatactttttagatcc

SEQ ID NO: 3563 - DNA, 1269 bp, Zea mays
  misc_feature (1)..(100): optimal_loci_58581_G1, chr2:37869937..37871205, Cluster 21
catggagccatccctaatttgcagttgcaagctgctcctggaataagggtcgctatgaagggtgtccattgcatcagcacatggttatctgatcctaggtcaacataatctgaaaaatcaagaagtctgtaagaaaacttcagtaaagaaacctatatttccttaagtgtttcaatctaaactaaacattgcatggataacagataacacaaaaaacaggaaaagggcatttaacttataacagcaaatagcaccacaaactaaaatcatacatagacattttaatgggattatgtgaaagcatagcgttccaattttccccaggatcaaatccattctgaatgtctcgaatcacaaagaacaataatctaacatattgatgaattgtgtgcgaaatatcattcctgatgatttagacgtcaaaggacatttgctttcctcttctgttggcaaaaaagagagatggaaagtgggaaactatgggagtaaacccaattcattgtcaatacctcccaaaactggggcgcaaactcaatttcatccaattaccaatccttcctgaacaaaacatgatgcagttgtgagtaactaccaaatcaaacactaagaatcaaaaatcaatcacaactaagaaaataaaggcatttaagtgcttttggattcaatggatttggaaaaaggttgcttttggattcatgattgcgctgggcctggattaggttcaaatattcataagaaatttccaattagtgaatgtcacactttcacgcagaggcagttttaactttccaaatgagaaatttacttttatatgaacataaagcctgagagagtgcagtatggtatgtactagtgtactatgatactatccgactgctctaaagggtcgtacatgcatagctgtcttgcaaacataagttggataattatgagtgaaatttcatttgtagtgacacagacacttgatagataagttatcacaagtagagggcagggcttgataaaaaaaaataaaaatgcatgaatagtagagaaattccatgatcatgctattttttgtaccaaaaaccttacatatatatgggataacaccacaatgccagattgttttcgtagatcaagacaatacaagcctttgaactttcaactagtatggtcaggaaaggaagagcattataaatagaagaaagtgatgggaatgacactattcttgttatggtttatacatagactctaagttcctatggaacataaacactagagtggaac

SEQ ID NO: 3564 - DNA, 1297 bp, Zea mays
  misc_feature (1)..(100): optimal_loci_59233_G1, chr2:41726391..41727687, Cluster 21
acagcaatgtgtcagtatgcaaatatgttctgtatttgtttatgtgcgcatcttgcattttacctgtttttacaacaatctgaacggtctgtggtggtacatgccgctgaaatttaacggttccatctctatgcggtgcatgcatgattcaacaccgaataagtgctattgaaagctataccttactggacgggttactcagtgtcaatcagaatattgagatgtcctcattgccccataattgaaaaagatcagatccaatgctagaggctcccacatgagttggaggtatagggaagggacaaacttatttactcggtaaactcatttactgctccgatgttgcccacttgttcttataccacatttctaaattgcacgggtgggctaccaattcatattttgatggatgactactgagatgcccgtgcatcgctacagttctatatatcatatgagtagactttgttttaataaaacataaaaatatgtgttctgttggttaggtggttctaaatgtggacttgtggagccaacaacaaggttcgaaccccaattttaccttatttttgcataaagagagaaggggagacaactgtagaatcgtagaaccatgggaactggtgctttatattttgatggatgaagtgtttcatatgttgtcgtaagtggaactgttttttggctattgaaggctcaagtaaatattgtcatattacttcatccgttccaaattgtaagtcgttcttgcttttgtagatacatagcttttactatgtatctagaaaagccataacaacttacaatttggagtggagggagtatataaaaattgatcgtatttgttctacaaaagaacttagtcctttctttgccatctactaacacatgtcactaaaaatagtaggcagtacaccagtagcagagagagttatatcttatcacacatttcattttgtaattggcaatgatgccacgtaaaaacaccaaatttcgacccacccacccatccaatgtaaaggtctgtttctgcagtgagtttggactaacctgaattgctgatgaccacctgtgcacagctggatcctttttcctttttaggtaaagatctgcctacgctgtcagtttggccttccctggattgccgatggcactcagcaaacagctggatcctcttttctgatggccatcaacaaagatctggatccttttttctcccttccttgcagtagatataaattgatccttacgtaacattcctgtgatgtagtgataaatgacatgaccaagtatatgt

SEQ ID NO: 3565 - DNA, 1310 bp, Zea mays
  misc_feature (1)..(100): optimal_loci_59463_G1, chr2:42943320..42944629, Cluster 21
acacctgaacatcaaattatgtaaaagttccatgtatcaaatggtttacggattattaagattaatggtcacccttccggtctttactggatccactgagacagtcttttagctacaaaacttatcaaaacacatctacgaaataaaatgtgaggtgattttatgtgaagttacttgaccatctataatgatatagaattgatagctatgatcaactctcatgatataatcgaagcttttgatttggttgatcattgtagaagcaaattatttttctgttaaagttaattaatatacaattatatggtgcaagtttttttattaatttattatatatgctacattagtatacgcatgtgtatatatcctatgatattttcccacctataatatttgataaattgttcggcccctcgcttctatgttgtaatacttgctccgccccaggtagaactctttatattccagtttttgtgcaaataattctttaactgatatatatatatatatatatatatatatatatttaagataatctctatgtgtggagtaaaatgagaatttttttatttctggcccttaattcattcgagaaaatcacttcgtgaaaccagtgtagcataaaactgtttggcattctcagatttagcctagcctctacacaaatggagggggtatactctgaacctggaactctgcaaggtgtggtgaaaataagacacatatatttaccgatattagttccttctttatgggacaaaagaactacatggaatcttggataacccatatctgaacatttaacatttatatcagaatacttaaaatcggatttctgatatgtatataattaagacacatatcaatatttgacatatctaatatgacccctatctagtctcgagatatgattaaaaaaacagatatgagaaaaaaaaatgatacggtatcactgatacttgtgtgtgcgatatcccgtttctcactgccaggggtactcctgctagttgcatgtatgattgatgtatccgaaagttgggtacgaagcgttgtcctaaacgtccagcagggagattatttatattgtttatttgatcgcgaaaatatgtcagagtttaccgaactggcgcttcttctggtacctgacaagatcccaggtttattctgacactttggaacgagcaaacttttaaatactaaagtgtagatggtagactgtttgaaccgactacaatttgattataaaatacatgccagcgatacccatgttgcatgcgacatcactccatttccttttgccttcacaacca

SEQ ID NO: 3566 - DNA, 1135 bp, Zea mays
  misc_feature (1)..(100): optimal_loci_59586_G1, chr2:43726104..43727238, Cluster 21
aggttagggtttcctcaacttcactaaaaatctcacaaattcatgttcacaggaatctgaccaaactacttggtagatattttcctctaaggtctttgcatttttcttcccaacccaatcagtctcaaatccatagaatcccaaaaaccattaaaacaaaagagaagggggttaataagaggaaaaatcaaaatgaatcaagagattagatcttttgatgaatgattactttatttcattcttgaactagtcagatccttttccaagttctacaaatgaaggattatatatacaaagggacaaagaatctcatctatggatctctcttaaggctctaatgggaaactaaaaactagagaatggaaaacctaagcaacagcaaatctagcaaattatctttgggtataccgaggcattgtacaaccccacaacttttggaagaatagatgtccattcatttcatgagatttcaaagttttttttatcgaggagagaatcataaagtaaaccttgccgctattttttcttatcaggcaaatccattcatgtgtgccatcaaacactttttgatgaaaacaaattgactttgcaatactaagtgcattggcattacttatactagtccatagatttggtatgttggttgaagagtttctacacaaagttacattgtagcattctcggttctcaacttactaaatcactagagccgactgaatttacaaaggttgtgctctagcaacttccatcaaaaaatagttttcatcaataagcgacttccaacacacatcctaaaatgacacctggtcaccagagaactatcaaccgtaacacaacaccagcttggaaaatatttgcacatgtatctttcaacagagattctaacattctggtgttcctccccctcctttcttggcagattattcctaatttcttgctaatctgatcttggactagagaaacatggaatcaaggaaaaaatccatcctttgaacaagttcagctagaagtcaaaaccttgcatttgtagagatgcatagagaagagcctgaagaggtacccataggaatgcataccattgcctagtcaggtagaccatgaacgcatgtgatgtcacgaagccgacaaacttgga

SEQ ID NO: 3567 - DNA, 1098 bp, Zea mays
  misc_feature (1)..(100): optimal_loci_63195_G1, chr2:63471681..63472778, Cluster 21
atatatatataatattttcatttgttgcaatgaaaagtacccagcaccagaccggtcgtcggcttccacacaacataacttataacattattaaaaccaaacagatttgtgtgtaaagaaacggggcaaccagaagggtcgtctcctgtttcttggtcaatcaaaatatttagcgatgcatctaatttctacctgcctttgttgccttcctgcaacggttctgcagataccaatcggtcaatgccaccacaactttactccagagacaataatcaccatgtgctctaaacgtcctgattgattggtccttttggctggttttaggtagggaggatactgcaacaaatatatcgatctcttgctgacaacgaccaaatatattgttgtttaatgtgcaaaaactgatgttttgcagtatgaacaagactgattgacaggagcattgagtgattcacgggaacctttttttttggaaggtctaattcatgggaatctttgaacggctaaaaactatatagctgccgactgcaacatatatataggtcaatacatgcatgcatgcatcgatgtttcccggtgtttatatatcgtgccgtaggtgcaggggaactgtgcaaaccacaggtgacaagtcacctatttgcctgacatctcacctgagatttgcctggctgactttctgaagttatctccacccaacagccttgtttggaaagccttgtttggaagcattcagttttttaaaaaatagtttataaaaattgaggtggtttcaaacatactagtttatgacttaatttataaaaattagattatcaatttcttgaaaaccaagaagccggcctctcttatctaaaagataaaaactggtttcttaaaaaccgagttgcttctaaatagggcctaaatcatctattcttagagttgacttcaagaaacataattttttaaacttacggaataacttgtgaaagtgcaagcacatagaatagctccaattctaaacaaccggatccactttcaagcagctctaattaggatttagaatctcaatagtgctaaaaaatctatttcgaatatctacatcatgaatctatc

SEQ ID NO: 3568 - DNA, 1052 bp, Zea mays
  misc_feature (1)..(100): optimal_loci_7375_G1, chr1:38213275..38214326, Cluster 21
ggattgaaatgaactgataataagtttcaacttagtttaacaacatgttgttctcagccacattaaaaaacattagccttaataacagtgtcaaaacaaatgtatcagtgacaagttctccaaaagtctctccttcgcagttttttttgccctgtcttctatatgactgattgactggaatgccagttggtagggatttacacttccgtgcaagtttatgattttgaaaatattaagagcatgttttgattaggataggatttaaggggattagagagaattaaatcctttgctagtcaaaattgaatagaaataaatttaatcctctttaaatccttttcgatccccacacaaacgaacatgacctaattagtaaaatgaagccccggtttgctttatgttgtacatttagccaaggaaaaaaattgttcccttccaaattctgttttttaggacatgttatttaggagtcaacatgccaaacatccggtgcaatgaagtacataaacgtcaccttgcctactaaaatgtacaatcatccctgttattctagacttttctgcaccagcttcacaaaccatacaagaaatcatatttaaacttgcaaaagcagagaaaaaaattcatagttgtggatgaaaaaagaagcgcaaataaaagagtgagcatgtgttgtacaagaagaggcctcgttctcatccaacgatgacagatgacactgcgctatggagcaactacacgaaaggtgctggaaccagaaagatcgttggcaacagtaccaaagaaagctgggaggcgcgaatgacgcaataggaaagtgattagggtttatcaaaaacaaagcgtgcgcttgttatgcgtttagacttgcaaaatttctcctccaggtctcgtttagacgtttagtggtggtggcatggctaaactgtgcaataaagagattctttccaggtttacacaatcgagtctttgtgctggcagcctggcgtggtgaccattgtcttcttggtgaatgatggcgatgccaggatgagcctgaccacctatacact

SEQ ID NO: 3569 - DNA, 1345 bp, Zea mays
  misc_feature (1)..(100): optimal_loci_76733_G1, chr2:151692006..151693350, Cluster 21
aatattaagctactcaaaaatctggaaggaactaactttgtttgtactaaatctcaacccatgcttggcaaagacgaataccacagtattgacatgcatctacatagcctcttatgtcatgctgagtgtgtatctctttctcttctctcctgtcttagcaaacattcagtggcaaaattatgtcaaaagctagcctggcattgatgttggtctttgatctcatttgtgaaaaataacgtccagaactagactctggtcattagaagtaggcattaattggtgttgttaagatacaagtggatcaccacaatctctctctctctcaacttaatattttggattgaactaattagtatatacaacttagaggtctcgatttcaaattctagttagtgtaattaaatagaaataattattggtttcttctccattccatgtgtctgagacttgggatagcacgtcttgacgtgaggaagaatataatgttagaatataatataagtgaattatctagctctctccaccagcttaatattttaggttgaattggttgttgcatgcaacttaatatatgtatttatcacaaaggaaacaaatgtgctagtagcactaaatatgattattggaaataataaatccgtaatccacgtccacattattatattggttgctcggctttttctgatgcccatcgtacgttcccacgctccaataaagaactaaatgccctcggaataaacagctctaatatgaattgttgttgctacgtccgtcgccaacaacgctgaccggcagagcgccccatttttgtacgaacagcacgacgggtaaatttgagcttattacgtgagagacacgataatgcatgctgaggagcgtgacgaactttgtgctgagcggagcgtgcttccgtcagcacgatggaaactttcagaatttcttgtgttttattagggcagaacgctgtaaaagctgaaaaggtcatgtcgtcagaataaccaacaagatagcgactgctcactgacccagacaaggttgattttccactacaagcgacaattcactacgtacgatgaagttaaccaatccttgggcgttgggccaggttaatttcatgagtgtaccattgccgaatctaaccatgcatgatcttcaaaatcacaagtacatgcagctgcctggcaaagaaccagcagttgtgctccgtagctttagttccttcccacggcaccagttctttagtggatgacaagaagctagctagctagagctagagagtaaagaagatttcctcagtcgaccgcaagaacgatcgaggagctgagggtcttaatcactattacta

SEQ ID NO: 3570 - DNA, 1370 bp, Zea mays
  misc_feature (1)..(100): optimal_loci_81625_G1, chr2:179975637..179977006, Cluster 21
atgttgcactatccacctgcaatgataggtttaaataaacattaaagtccattagtaagtaaacgcacgggcctttaagatttatcaagttttttttttgcatatgggcttcatggattgataagaaattaggctgagaactttattatttttgaattatttttttagattaaaataattttagaaaatcccaaatatatcatttgacatctagaaatatttagaaaggttcaaacaatttgagaaaaatcctagagacattttagaacatgaggcactcaaacaaaataattagagttcatgaaatgcatatgcgtgtatctaaaaattataatacgctcataggtaaaagaaaaaatatgccagatagattggataaattcttggtaagattatagccatagttggatgaataatgaacacaacaaataatttagaatacaagaaaaatatttttagaaggtccaagcaaaagaattaaaataaaaaagatagatttgactatgtaaagcagtatgtcgcagagagaagatcgttgttacacaacacatataacaaccaaaaacaaacatcacacctccaagaagcttgtcggattaatttagaaaagttttaaaattatagtttttaataaccaaaaagcttgaaaagttttatataaatattaaaatcatttattttagtgttttctgtttacaacataaaattacaaattttggaatatgacatcgaaagccgaaagttaacatatgcccgtattttttgtggcttagttcgatttagcaaaaaaaaaataagcttactttcggcggctaaatatatcgtagtaaaaaacaacggtaaattttgataatatattgttgacagttatgatccaccaaaattagcgtaaagctgtagaaaatatctttttttactggaatagatcatattttttgtcggcaaaaattatttgaattcctgtagctagcagaaggccgttcccggccatggaataatgggcgtatatgtggcacatgcattcctgcacgatcaaacgacgacacacgacagtgaaataaagcaacaaggatatgataaggtcgtccatagaccatatagtagcttcatttggatgcttctcgccattgccctttccatttctgcatgccgccattgttggctctctccgatcgatccccggacggccactgccaaccaagaacgcaagaaccaagagcagacgtgcatgcgcaaataaagcctacccctatatatatcatcagcaagcactcaattcaacagtacagtgtacccacgtggattggatcagcagatagaaagaatcaaagaaagggctataccacctagttgggagcataggcagtaca

SEQ ID NO: 3571 - DNA, 1203 bp, Zea mays
  misc_feature (1)..(100): optimal_loci_81673_G1, chr2:180180776..180181978, Cluster 21
cacactaaaaccaggaaaagttatggactattgttgccaaataacttatgagatgtgcaagcttcctacataaataaaagtttggcctaagctttaaaatttcttttaggtcgggctacttattgcgtagtcgcgtccatgctatgcataacaaaaatgatgggtccttggagcttgatcgaatcgtttagaggtgtaaggatttaagattgaatggtaggaattacttgttaagaaggtccatgactttgtaactctatggttagctccctcatcaagttaaaagttgttccattgagatcaccagagtatcaattagaagttgtagaaatgttataaatatggagagcaaattaaactatgtattcaattacgaaaaggtacaatgtatgaggtagtggacattaacttaaaattgcaaggtagagtatgtattgcataaaatgttgtttctacaaaaacttgagcaatattttggggacgtcagcgcgaaagtccatttggttaaccaccaccagatcattgaagctcacattgtaaatcccctccttacggcatgtctagatctccatcctacacgatacgaagtagttgtaagggcacacaaggaggcattgaatatatatattatcaacttgtatacaagagagatggcaaatacttatagaagccatcttaaatgtatccttgaagtccagcagcaccacattaaggctattatagaagttagaatattttatgagcacaccaaaatacgtattgttagaggctaaatccttcgtgtaccactcatggagtccatgtatttgtgttggtaagtatttcgctaactctagcttcgctagaggcttggcatgccataggtggggaggagaaaacaagcgaaaggggtaatctctcgctactggcaaaaaactatgatccagaccaaagctttttagagcctaaaaatattatgggattggtgaaaccatggtctaagatagagtttttaggtaggtgtgctcgtgaacaccttttggcctaaaataccatggtatgctctcgggtcaatttttgcaaaaatagatattagctatataattttgtaaaagttgagtagcatgtatacaatttatccatgctcaaaatgctattgtcctaggactagaaaatagttttccaaacagacccttaggagttatgcaacacttatgaggtgtt

SEQ ID NO: 3572 - DNA, 1259 bp, Zea mays
  misc_feature (1)..(100): optimal_loci_82339_G1, chr2:183627951..183629209, Cluster 21
agcttcttctatctaaacaggtttagctccacaagctctaatttcaaaaaaataattaaaactaaaaatcagtttcatgaaatttttaaagccccagaagggtgcatcgaaaacaacgttttcataacccctcatgaaattagggctaaattgcccaccacgccattgttttacacgaacgcgaggtctcacaatctctttccatgcttcccatcttccttatttttaccatgagtcgtattttttctcagttttgcccttctgctctatagcactggaagggcaaaactgagcaaaaaaacacgactaagggtaaaatgagaacaccagcaaaactaaggacatcaccttaaaaccctgttattccaaagctaattcaaaaaaaggcttcgttaggcgtgtgacaaactaacaactatttgcagctagaagatgtctcctgtgtgcaaaaggagtagacgtcgcatgcaatccttaacaattttctgtactccataatgtgttgcacaataaaaaaaattagcaatatatccatgtccactatttgcatctcctcgatccaataggagaatcacgtccactccttttgcatcgcgtccaccacaacccactaatcattgtgggtaattaaggaaaatcacataaattaattgaattatagatgtcagagttcatttacaagccaaatactcatgaaacccaccttaacaatttacttacaagccaaacaatcatgaaacccaccttaacaatttactgaagttattttatggcgaagctagaaaactgaagttgcaattgttgaagtggagttgtcccaaacatgctctaaatacggagacagaggagagagaagatgagagaaagaagaagcgggttgtaaacttatggcctgtttggaagcacaacagtttttaaaaaaattgatttctattcccagtttctaggaactggtttataaaaaaatttagttgagggtgttttgaactcaaattctaagaaaccagtttctagtgttttgatacacaattactagcataatcttcctctagtttaaaaattcgtggcgttatatgtaaattcattgaaacaaacaagggcattgtgtaattaaacaaataaaagctcgttttagctaggagaaggtaacttttggtttttaaaatctaggaatctggtttctataaactgaaacataaactgatatgtttggaaccactacaaaagtttcttacaagctgggtgtttccaaacatgcc

SEQ ID NO: 3573 - DNA, 1150 bp, Zea mays
  misc_feature (1)..(100): optimal_loci_83584_G1, chr2:190398497..190399646, Cluster 21
aatatttgtaatgtatgttgtgttttgtcggctgtactagcctatactgatactagaggacagctacgtacgacaaaaggagtatatgtcgtcgatgtaactaggactagaaacagcagcgacgaagaacgaaagcttcactgacgctgacgctcgtgtaccgacttgcaacgacctcttttatggcggtgtggatgtggacacataatagaacttttctatggaggacgtggcctcattggtgtagaatcaattttcagtcgcagtccaaatccaaatcgatttttagagaagtttttttaactggctctattcatgtatatctgatatctctagaagcaacctaagagcgacacgccgagaaagcatcagaatatgtgcaacctcagcacctgccttaccattctaccgcactgctaaatcctgtaaaatagaaaatgtgatattatagattataatatttaacattatttgtaggataaaatttaaaatagaggatacaatggagaatgaattaagaaatctacaggagatggcctaactaaggaaatggtgcctattttttattaacttcagtgaatcttgttacaaatatctgagcttctaaatgatttggaatgaaaaagaaaaactacaactacagcttcggtttacgacatatattctcctaagatagcttggaaaattcagattttttaaattttaaagtttgaacgcaacgaagattggcacaaccatacatgttttttaatagtgtaatatattttcatgatatacgcaaaaaatattattctttatgattaatagtataaagtctggctagattaataatacaatatgttttcgggccactgttatgtataggtcgtactaagccaataaccaataacaaagtattctcccatcgtagctctaataacccaaggagtagcaagaaggaccctagaggttagagtcatcatccacgaactttcttagggcctgtttggtaatgcagttttaaaaaattgtagttttaagatactatagtttacaatcgtacatgacataaatactacggtattgctttaccacaataaaactacagtattgttcaaaaccgagatctgtttggttctattgtaaaaacaaagtatatgtagagagaaga

SEQ ID NO: 3574 - DNA, 1266 bp, Zea mays
  misc_feature (1)..(100): optimal_loci_83739_G1, chr2:191427764..191429029, Cluster 21
gctctcaagtgtggtggtggtatccaagctccacatctcaatccttctagccatggtgtaactagtactcagctcgagtggacaaacagacggtggagttgctctaactcctgttgatctagttgtgactgcttcttagtgaccttagtgatccatatggagctaactctgtcacctcgatgtgcaggctccgctgcctgagcaatttatagggccctttgagtctgtcgattctattaaggggcctatcatgtcaattaaaagaagatgaatctagaaaatgatctttgactttgtaagacatgaaaaaatgtgaatctccttattgttaatgtgttttcccctaaatatttatttaaatattttgctaaaatattttttcccaaacatcattttcatttatcaatttaaagaaccacaactcaaaaagtaagtattttaagtcgcaaggtctatattctctaagtcaactcttgtttcttttttgaagtcaaatcaccccttttcatcggcctatatagttttcacagcttatatatgtgcactggttgtctatctaaaaataaaaaagagataattgtgattatatcctttgttgcctttgtaattgtgattttaccttacatttttcaactttgtgattttaccccttcattttagaaacgaagctactatttgcttcttcctctcaacgccactagtgaaaatcataattaatgattaaaataaaaaataaaaagattgaaaggtctgaactatcctcctattatgtgcgggtgcaaccccaataaggtaaaatacaattacataatataacgaggcatagaattattgcatggatatttttgtattttcgtgtcagatttaacattgttaactgcacgtaacagtgcaagtatatgactacacaatagagaggtaaactcgtacaaacgaaaaacaaggagtaaaataattgcaaggcctgaaagggatataaagacaaatgctcgaaatagaaattcagagggtaatagtgatgggtctatttatttctgcttgtagattatataatccatattataatatgttgatattataatatatatgtagtcgtttggttgcctagattatattattgatctctgagacacaaaagcaacagtatctttgttcatagtcgtctcctttttttatagctatggcattctatcgcctcgtacaactattttcaaaatagaaaatttacattatgccaatttacacatcttacttgtctagagaaat

SEQ ID NO: 3575 - DNA, 1062 bp, Zea mays
  misc_feature (1)..(100): optimal_loci_86465_G1, chr2:208340525..208341586, Cluster 21
atctccatatattttactgatttctattggttgtttagttgcagcatttaattgatatcttagtctataaaatagtgaaactaaattttatattgagagtttcatgacactcttgatgatgtggcagtgctggaaagagtgttataaaatagccattatgattagcctaacgacaacaagttccgcgatcagcgggcacctaggtcaggcaaggtgaataggtcggtggtgactgctacatgcggacgactgttggaacgggtggaggcgtggagcgctgtgtggcgtgtggtatactgcattttaaattacaagtcaattcaattttatagagaatcacaacgttttaagcgtaaccaaatttatatttatattaattacgatataaaaatactattagattttaattaattataattttatagtatatctatttaacgttataattttgatcaaatttaagatgttttattttaaaataaataaaatgtcttataatttaaaaagaagggggttcatgtttgtgtaagccactaaggctgtgttaggattaggacccatccgaacttctataaactgtggtacaaggtaggtttattcgatttccgagactgtggaagctggcttgtaaagctaatgaatgtttgatactagcttggttttcataagttagattggggagtctattaagatctaaacgggttctaagttagtcggcgaaaggtgtgaggctccggcttaaaaagtagatgtggagctgaactagagggggcccaatgctggccatgatgttttttttttggggggggggggggggggggtaaagaaacagcacatacagagctgaatgcagaactggaactccgtggggtgcatgttgattagtggtgatggtttgcaagtcatttcagcacgttttacactcgcaatcagggaacttgttctctcgcgccttgttaaacaagtgctttcaactgcggtcaagctgataccaagctttttcactctttggctcttctttgataaaaggcaaaagagaaaaatcggaggaaccttattgtt

SEQ ID NO: 3576 - DNA, 1128 bp, Zea mays
  misc_feature (1)..(100): optimal_loci_88369_G1, chr2:218950044..218951171, Cluster 21
gaagtttcagcttgctagcacaagagcactcaactcaatcaccaagcaaaatcatagagagatactaccaccaattctcaggtctaaattatcatgactcagttatcaactagtaatggacatcaatgcacaaaatctcatatactcatgtgttatacatatatgtttgtatatattaatcactaacttcattgcttcgaccatatcaccacatttataacttaaggttgattgaagttaactaaccattagacttttacaattttactctaccaattgtgagaagtgtaccaatttaggaatacttaaccaggcaccattcattatacaatttgtttactaattaacattccaactatttggagcactatagtcacaatcatacaatttacaagcacacatatctcatattttcctatttgacgagatgtagccctcatattaagacaacactaacacattacaagtttatatttttctcggttaggggatgtcaccaaaagactgatgaattttatgctcaccatttcacgacacataaacttagactatggatagaagcaatttactaattctataattcactttattaggttaacttgctttacgcatcaactaaataaaactcacatctttctttggtctaacacatagagtattaacacatggcataaaactccataaggctacattttaatacttaaggacctaaagcacttatgtgcatatctcatcggattattctttgatttcaaagggaccgacttataaatgctactcgcttccaataaatttttgggcagcaataacactcatagtatggaatgtaatggttaataaaacgaagcatcgatctgtcatacatcaaaaatcgacatgataacactaatagatactatcaactaattgtttggaacactaaacttatttctcgctttgccactacactacccttcaatcacatgaccatcatgagcatccttcacacgaaacttacattaacaacctaaacatcgtgttacataatacatacatcttccctcatcgcgagtataaccgtatcacgacatatactcgcacacctcaatcaaacatcttacgcaaccactaatacgatggaccacaaca

SEQ ID NO: 3577 - DNA, 1083 bp, Zea mays
  misc_feature (1)..(100): optimal_loci_88592_G1, chr2:220060597..220061679, Cluster 21
taaactactctctgattttttttgagctgaccttcttaaattttacattgaggtacgaaatgttagtatgttataacttacatccacctgtcaattataactgaataaaaaagaagtctagaagccatttactgttctaatcgggttgtggaggatgtggttggaggggtcgagagcgcaccggcggctttaatcgggttgttgtcggggaaaaatgtaggcaagcagctggttgccattgcgaggccgtgaagcaggaactatcaatgcaaagcgaaatataatgcatggaaagcagcactaatagtaacggattactgctgacgagcggcgatatcaactttcaacgcgctggcatccgattagtgtcagatctcagtctttctttttatctattgttgttaaaacatagtgcaattattggtactatgatcaaacaagttatactgctatatttggtcttataactcttgtcgtgatggcatgattgcttgacaaaatgcctaacaaaattattcttcaatacagtataaaaaatatggtgactcaaaatcagaacaaaaggtctatttaatcttcttcatcgaactcttttgtgcggacagttttagtgctaagtaaatgaataatgtacatttattaacaagccattccaatataaaagtattgaattcctctatgactttgtgcacagtgacaaaattaaataaagccatgacaatgatgaacagagacaacacagtctgatggaatcttagattgtggatgaaatttactttatagaattactatatctaaaccccttctcataagttgattcgatgcctaaacttgataaaaaaatggattaatattttggatcatacctagggcaacctaataagcatggtgtcgctaacatgaagcaaaggtctaccagagaatagggtttccatcccttaatattacttatttcctaagaaccatactgaaattaagggtaagaaatccagtcaacattttaaataccggttttaattgcccagagctttggtaccgaccggtggttgcaacctagatgagctctctattcatagcgctata

SEQ ID NO: 3578 - DNA, 1033 bp, Zea mays
  misc_feature (1)..(100): optimal_loci_8952_G1, chr1:47468790..47469822, Cluster 21
ctagcgccctcgaccgcgttgcgtcggttaggatgtcatcgtcagcgagccgagcacggccgtcgctacggaaagctgaccggccggcaaggcgacccgtgcccgtgcatgcgcctgcttaatcttttcacgcgcagcgcaggtacctgcaactgcaagggggcgggcggtggatccgtttcaaatgcgatctgctcctgcatttagatattagtgataggaggccaagagagagtagtattacgatgttgtctataaattatttgtaggataaaacattcttaaggtcatgtaatgatatgctttgcttattggttgggctagctacaatgggatacttcttctataatgaatgctatggagtattaagctatctgctcatgctttgccatgtgtccttggtcaaacaaacttcagtgattcctattagccgcagaatggctttagatagagaacagatatagaataaaactatatatatatagttcacaacagattgagttatgctcttctatgttgtatattctgtgtcaaagtaaaattcagagcagattttgggaatatttagagacagaccggcaaactaaaatattataaccagttgtttatggcacgtatgtacggcaattgttcatggtaattttttttcttccaaatgagcacgttcctttgacgcggagacgagacaagggaggggctgtgtgctgcagcctgcaagtctacaacgagaaacgagacggatatgacatggtcacatggatatggatagaaggtactagaaccgttgtgattcgtgaggatctttttaaccatacagtatataagtgtataacatagaattaatgtttccacacactaccttttctaaactatgataaataaaaaagaatgggtaaagtactaaacactgctcatacttataagtatttttaaaggcaagactgccaaaatcttgaaattaacgaagttctcgcacatggaaaacgtcggctaccaccatgttcgctgtgacttgctgatacgattatagttg

SEQ ID NO: 3579 - DNA, 1150 bp, Zea mays
  misc_feature (1)..(100): optimal_loci_89606_G1, chr2:224481797..224482946, Cluster 21
  modified_base (249)..(249): a, c, g, or t
  misc_feature (249)..(348): n is a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
tatacatgggtatcgaatatatattgcatatctattctaatagtcccgtgtcctcttcagccatgcatgaataaactcggagcaaagcgtgcgctcagcactgctccttggtggactaccaaatgtgtgtccttcgcctctctgatcaggcccaatatgaattggatgctgctaggacactgctctctcgtttcagtatgtcagatgattgcctgagccactgaaaaatctctcccctccctccaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccccccacccatgtgtaatgttcagttctttgcctggcttgcctcccattgaacgtctccaatgtcgtgtcaatcttctttgaaaaaatgtaatgttcagatgacgtttttgaagtctacctctcccaaccggagacaactcccacacatactcttccaccgtgactttgcgagaagcctttggtccgcggttggcgtcccagtggcagacgatgccaattgcagcagcactgcctcggcttagccatccatagactacttcttccccttcctatagttgttgtatacagaccgtgtttgggccattaaaagcaatgaaaaaacatgcaaaacatacaagcacacatatatatagatcagagagagagagagagagatagtctttgcatccaaaacatatttttggcccatcgtttttattacaatagctgcatttgtagtaataatgacaagtagttctttttgtaacagcaataacaagtagtcgttcttttggaacaagagtgctaaataaatggatataaagcaaagtcacatcatagagtaccatgcatttagatctatcagtttagttggcatgcgtcttcaagctctttttttcccatatgaggctaatggtggccatggtagagctagcagaaggctgctaggctgttggccatgacgaatgcctcgaaggagtgcttgctggcgagtttagaagcggtagaagccggtacgaattaaagtcaagcaaacaggctaaaaatgactaagtttgttcacttctttattgcaacgcctattttttatag

SEQ ID NO: 3580 - DNA, 1018 bp, Zea mays
  misc_feature (1)..(100): optimal_loci_89995_G1, chr2:226591073..226592090, Cluster 21
ttgtcttggccactttagtgtaatttggcatgtagaattagtatagtttcatctgggtgtgaagatggtgatttatattgccgtggttgttatcggtaacttcgtgtaatgtgttagttgtatggtaaaagctaaagtggcacaatatagtctggtcttttgtccttttggaaactgaattggaaccgttgttcaacacttcttggggccaccagccaaaggcgtgcaaggtttttttttagcatgttatttgcactaagtttgcactgctactgtgttttacgactaatttgttttttatctgggatttttcaaacacaagagaaaattacaacgtgctgagaacgatgctgcctctgttcaagttacagttgttagttcttgcaattggctcaaaacaatgctatgcattccaaaaaggctcccatgaacccgtgctccaaacaggaggaaaattcaacgaggactcctcaccattggcttcgtttcagaaatcaatagtgaatttaaaaccgagacagacaactagggatggcagtgagtgtggatctgggtgtcaaatttcaccctagatctatactcgatccgtaaaataattggttagagctaggtgtgacttttcacccacaggtactcgatagatctcaaaatactagcttttaactcatttttcaaacatgattttgctgataactgaatgactgattttcattgctctttaattctaatgctcattagctatttgaatgtgtaataaacattattttgtcaagtatggttttacacttttactgttgtcactgagccaatctaaaatgtaagaacttagattattactattatttggcttactggactagttatgttatgtgtcactgaaactaaatggagtttttgaaaagttatgatcatgtgaaatgtgaattgataatacattctgtgcttttaaataattatgtgttaccttgccatttatgctgctatttatttaattatttgtaattgtggatcacccaac

SEQ ID NO: 3581 - DNA, 1238 bp, Zea mays
  misc_feature (1)..(100): optimal_loci_93582_G1, chr3:7215583..7216820, Cluster 21
cacacacttgtatcctgtggatggagatagcacaacttgtttttttcaagagctgacacttttgagttttatggtgtagcggtggagagaaaacgaggatatgtttgtttgtatataccaaagtggtcgtaacttgtggattagaccaccactagttgagataggtgtaaatagtgacacacacgactcagtatattgtttgtggtcgaagatgatgtggcatgctttgttttatcgagagcggacacttttaagttttgtggtcgtgcggtctagtgaccaaaagagaatgaggacgtgtttgttaaagtagtttgtaacttagatttggcaagcactagaaatggtaggtgtaaataatgtaactaatgtttgaactgcatgcaccagatataagcctatgtgagcgtataatatgtttgtttgcatgcataatcatgatcctaatcccactatatttaggctatgaacgtataaaatgttattttaggttgtatactgtactgtttatatagtgttgtttgaaatgagagacgatgataagtaggctctactggagttagccttacaaggaacaccttcaattggtccaagacagcaacattatgcaagctagggtgaagagaaacggcgtccaaaccagtttatgtagagctagacactctaaaaacgtgcggcctggctcattgcttcatccagataacatgtggacgtggtggatacccaaacaggagaaagtgcatcatacaggccacttctccaagcaggcgaacagacacgcatcaagacggtcccaccgcatcttctttctcgcgtgcacgaacgagctcattcatgatcaggtcctttcacgtggaaaaccatttgtccatttcccatccgtttggttgttgtacaacctgggtctgtatgtgaggagccaagtctactgtacacagctaggtacttgtatatgtttgtgtttggttgttaatttgcattaatgtatttaggacagaaaccgatagtgtttggttaaagtgtactagaaaagagtatataaataaattttcaaataaaatacaatatgtatgatctagttttatttataataagctcagaaacacgaatataaaattagtttggtgattaaattttttatttggaagatataatgaaaaaataatctaaaaaacactttcggtttatgtgccgctacatgcagctgctgtatatgcagagcatctcgcgcgggcccc

SEQ ID NO: 3582 - DNA, 1306 bp, Zea mays
  misc_feature (1)..(100): optimal_loci_93764_G1, chr3:8327194..8328499, Cluster 21
gtcagaattcaaccaaagaacagttcataaagttttctaagtgtttgataagagaattacataagctgagatatagtaaatccttaagtgcgtaaacatttaaaatatgatctcaccagaatattgtagtgatcggtcatcattgctattaaccccgcagcagtagctgttccctctggaagagataaatatgcctgtataggtctcacagcttaattcagtacaacaaaacacatgtagaatacaagctaataagtggtttatcagactatgacatagaaatttaggttattatatggaaaaggaagttggttacaggatttaccttattaatgttgtaaagagcctccaccatttcagatgtcctatcacgtattgcaccagcaacctaaaaagtaaatgaaaaatcagtataatgaaaagtcgcaagctatatacaaatttgttagggtatcatactaaatgtatttttatgtctcggttctgtctagaagggcataaaaaaaactttctccaatcttttccatattttctgtaggctccatagaagcgctcgagctcatctttgctccattgagacccaagcatgtcagataactttttcttctgcaaatgagtttcacttggatcaatattcaatgatgaagttaaggaacttaggtactactcaactgcattagcagtatcaaaattcattcgtaaaacagtttttccgttgaagtcataaggcatcccaaaaaatggcaattttgtgacacctgacagttccacttataaatacataatacagcattatcattttaacaagaagtcaattacgccatttacataacgatgatgacaaagcaaagagattgaatgaaggctaaatttacagacttactcgcactttacttttatgtacatttgtctcatctttatcctgccaatcttcgttgattttggtgtagcgtttatttgcattcctcacttttcgcgacgaagccattgagaattgaacagcctacctgagaacacaattaactcgagatcattgctaaatttcatcacaggatctttagtgagcaatgaaacaaggagaatttcaatttcaataatataagtggactgtgagccttattaaataaatgaagattcaatttttcacgtgtacatgttgctacatgtacatttacaaacatagctcaacattgatccaaactttcgatgatcagagcatcataccatcttgtaatcgttgatcaagcagaaaagaaacatgctgtttggaatttttacaataatctccttggggttgctgtttcta

SEQ ID NO: 3583 - DNA, 1113 bp, Zea mays
  misc_feature (1)..(100): optimal_loci_94161_G1, chr3:10432692..10433804, Cluster 21
  modified_base (289)..(289): a, c, g, or t
  misc_feature (289)..(388): n is a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
gtaatagagaagggattataggagtgcgggttgattctaaataaatgtagtgttttttaaaaatattaacgtaggatgccagttaaacctgatgctttaatatagtaaagatatatattagcctctcaacctaggtggctgtgcgcagtataaattacttaaggtaacttataatctggccgtgcgcaacctaagaaaattttgttagggctagttcgggaacgctaatttcccatggttaccccccactcaatgggaggttattccctctttttaggtttacctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaattagtgttcccaaactagcccttaggtggccgtgcgcaatataaaatactttagttcaaaaaattaaataatactctctctatcctaacttataatttatttaacttttttttttgctaagtttgataggtttgtcttatttatgttttttggaaaaatggaaaatttaaagtaatacataaattatattatatattagacgatatcataataaaatttaacaataattataaatttttttaataaaataagccggtgaaacttaagataaaaaaatcaaatgaattataaatatcaaagcgcctgttccattctctgattcttatcactgaatataactaatccatgtcaagaaaaggagtaaaacgaattatgcccttaagattgctgagaattcgtcggtggcagcacgaacggttattctctggttagttaggatataattgcagcatcaggagcaagctagcttttctatccctaataagtagtctgatgagatgtcactaatatattcatatgccggctgcagctgcaaggctacgtgcttaaacgacgaacgcagaacaaaagccattagccgcgctaatgtgaggacgacgtgtagtgtagtgagacaaagcgcaaatcttttcttgtcgccgtgtgcgttcgtacgcgacaaatgctaatgcgtgttcccatgcatgccaaagtagtgccaccgttttttttttcctctcta

SEQ ID NO: 3584 - DNA, 1291 bp, Zea mays
  misc_feature (1)..(100): optimal_loci_94273_G1, chr3:10951705..10952995, Cluster 21
cggtcatcttcctcctctagccatcccccatttgtgactggtttttttgtcctcactgaccgcaatggctgcaacctgagcacttgattaatgagtaggtcccttgagcaaacaataatgtctttaaccgaggtgcttctccctctattgccataacttctgccacattcttgttcacgtatggccttatataatagaaatttgtcgtctatgagcttctttgctaccaccaaagcatcaatatgactatcgatgaagatgatgaacttgtcgaaatgccaataatttctcgagagagctaaatgtgattagaaaagacgactctgattacatgtgtaaatatgttagcatattatctccatcaggcttatgtttgtattagaagatcgtaatacaagttcatatcaactatgatctttatatcagatttattttgctcattttatctacaaatagagaagtctaattgaactactacatatacaatctatacaagagttcttttctagatgcttcgatgttcgaacgtaacccgtatgcgtgcggacacgatgagaagagagcgagagctgtaggccgcagcccgcagcccaccaccaaggaaggtgaacccaacaaatgagttctggacacgtcgccataacaatgccatacgcctcttgccgttcttggaaggagtagtagagttgcagtgtcgagccgttgcccttgcctgtcggagtgtcagccaggtccgccttgccgtgttttgtttcacaagacagcaagaccacctccgtttttggcatgttgtgtcacattttatgtctatcgagagccattgcatcgtaggaacgaagcccacggaaggtgaccgcagtgatcattggatataaattaggaagtactaccaaacatacccttgagttacaacagagtctaatacgtataagaatcaaatctataaaattactatacgcaagttgttctaacttgtatgagcacgtgtcgtaaatatcgagatatgtaaagaatgacacaatgcgtattcgaaccagatgtcgaatctttcatatctatcattgtgaacaaacactagggtacataaagctatgaaaagaagagatttggagaaagtggagcataggcaaccagcttgttaaagctaggcacaacaatgatctagcacatgggcaaattagagagattcattttcgtaatacgtgtaataccctacatcctcttactacttgtcgattgatgaacacaaagggtgaataagcttacaagatcataacaaaactgagcatta

SEQ ID NO: 3585 - DNA, 1374 bp, Zea mays
  misc_feature (1)..(100): optimal_loci_96494_G1, chr3:23184584..23185957, Cluster 21
atagggtggatgttgtgcatccatatatgtgtatctatatctatactatgattgacaaaaaatcatttgtttctcttttgcataagttcagaataaaattaaatgttataatacatgggtgctcaggaggaagtagtaatgaccatacaaattaatgtagagtgctcattgtctaaattataatgtagtctccctccattttaaatttcaagaggtttttatcttttcttaatatatatagagagagcaagagagcctctttggttgctcctgtttcccgcttaccggtttcgaccatattgttttcttggcttcaatcaatccatatcgttttttttttcgcttgttgcctgttcgatcgattcattctgtccgcgcgcgagtgcgagtgcgctctgtgtggacttgtatccatgcgcttggacttttgtcattgttaatatgcgtgcccaaatgggggcgcacagcagctaaagatcaaaagggagtcgaatacagcaggccgggaagctaagcttagggctggacagggctacaagctgcttacactggtagctggcctgtcgccggccatgcatgctttggcagcgcgcgtaaataaaacacctaaaaacaactttgcatctgcgcaaaggtctctatgctttctttttggcgaaacatgaaagggagagagagagacatgtcgagttgatgcggctagttgcttctcatgcatggatgcaggccttgctgattaaagtggctgtgcgtgggcggtaggacgcaggaactcagagctacctagagatcatatcgaccagaagcgatagatccagcattaggagacatgcgttctttgacaacttcatggaatatgatatgtgtaagtgtatctcgagaagctcacacaccagtcatttggttggcctctgtaaacctactacatgtacatacatgcatgcaagcacaagttgtgtgggctagccagatagccgcagaagcctgcatcagcaccttcagattagctagggagtctatgtatatgtataggcaacgtatatataatgtagaacgagagagagagaagtatccaaccgtagatgaaagctggcaacaaataaatataagctcacatataattagttgggggcattgtttcgactcaagctaatatcgcgacatgaatagtcaagacggcgaaatatttcgtacgctatagtaggctatagaggaagtgcataaatttggtgacatgaaatttcttgtgttgagcctaacctctctcaactctcgttaatgaggtgtttgatttgaagaatcaatttattttagatgaggtggtgtatcatgagtctatttcacaaatttattggaataaactcatttatcata

SEQ ID NO: 3586 - DNA, 1059 bp, Zea mays
  misc_feature (1)..(100): optimal_loci_326869_G1, chr10:12348441..12349499, Cluster 22
aactaaaattgtttggtcgaaacaactgtcaactatagatcctctaagagcatgatagcttggtaacatggatgacaataatttgaaaattttggggtagaagatgattgtgaattaaactagaagaatatccagattttcaaaaaaatctaccctaccgttatacctgtttggttggaattccggattattttagaaagataaaaccaaacatatccttaagcatgtcaagagcttgttcatggcttctcataggcagcggaatggcgaggatgcgatgcgagtaaaaatatgtggcaagcgttggactgctgaactgggtaaggattcctgagccctgatcatcggcggtttgtccaggagagaggagcaactgagcaaagcatcgtcgcaggtttgcagtttctcgttgagttcgtgaacctcttgtgggcttggctgtccagcccatgaagtaattgtagccgctccacatgagccagccatagagtctatttgttttagctcttttctgataagcttttatgagaatctagttatggagaaaatctgattgtaaagagaatctaaatatcgtgatgattgcgtgcggacgaagatcaatgagtccataaagagtatcatatgaaaactagcacgagattcctaaacttgctggaaactttgttgtgtctatggtatgttatcgtgagtttttaataaaggttgtttaaaactgcttcacagacttttgtaccttacgtcatccaccgagaaacttcagagaattatcaagcactgtcatccaccggttgcccaaacttcagaaaagtttggtatgtttgttggtcctcttttgcaaggtcagccttgcctgagccagagagcgttgttttctagctcacgtcagcaaaacaaatcaaacatttgtgcgacggcaagagttgagttccaaacgcccccagcctaccgtttcgtcttacgtaacattttatggttgaacagggcagtttaatacagcagacaaatactctacagatcacttgaatgctgccaaactcctccagacaacaaaaatat

SEQ ID NO: 3587 - DNA, 1203 bp, Zea mays
  misc_feature (1)..(100): optimal_loci_100036_G1, chr3:44091468..44092670, Cluster 22
cttgagagcaatagtctgggaaagtatatggtatagaaaagtacaattttcttgcttattatgctgtttgccaagtactcttgttcttggcctgaaacagaaaaatttgcaagtagagttgagccatcaatcaatcatccatccaccctatgaaaaagtaatctattcaatactatatactttttgtatatacaccgaagatttcaattacgaatcagcttcaactaaatctctagtgataatagacatatgaaaagcatagcctgtagttgtaatctaatctgtgcaacaaaggaatacaagcgaactatactattattacaggctcgtagcacaaagacgtgagggtaaagggccaacagaagcgtattaaactagctagcaatctcagacacttcacaatcacctcagcccttcagaaatatacttcaagttgatgcgcaaggatcagcataatcaacaatatactagtatcaactctggaacaacaataccttaccatctagtagtccaaatataaaataataaatatactatatggcattgaattcaaattgagaaaatgatgaagtaacaacaaggaaaatgctgaaataagaacacgtaaggtaagagctaacaacgtttttggttagtggaatgccgccatgcaaaattatccgatccagaaaccgaacctcctcaagctgtttgatctgcgtcatggattcacttcgtttgttaccgtgtagtacccctgttaggccgttacaatgattccgcagcacgatgagttcattccacacaaaaaatgccggaccgacccattctgattaaactcatgcggcacgaaccaaatccacaaaccaaacacactgtaaacagctttagtaatctttggtacttttaatatcggctgcaccaaccttccagcgctctgttcagtaacctcatttcttgctccacaaaacacccacatcaatagctttggattactcaaaatttcttttcccattaattttctagaacatccttaccaacccacacttcagcagcttaagtctaacattttctatagatcaattctcgacttaataaaagagagaataccacattcaaccaatcttcaattcaatggaaatacttggaatcagatacagccaccatgcaactaagctgtcagaacacatgactgacttgtagctataacccaattgtcttgaa

SEQ ID NO: 3588 - DNA, 1181 bp, Zea mays
  misc_feature (1)..(100): optimal_loci_107462_G1, chr3:93084485..93085665, Cluster 22
gttctcatctcaattcacgacttaaagttgtatttctggatggtcagaaaacaaacttgacatatctattcaagtgtattatacatttttttttcttgatccattgctgttcaaatcaaattaattaaaaaaggtggactgacttggtcatgtggtgtgggctggcaatgacgacggcgggctaacgaattgcagttacaaagtcttaattgtgacgccgatcttgaagggcggccggccgatccagtaatcaatctagtggcagagaaaaatcgtcgcagagcaggccttcttctctgaccggccgggcttccggcttgaatcaatctgccttctggttttcattttcaaataaaattctggtctctgtctctacggcagcgttctgaattggagtcgaaattcaaattgacacgactattagccgtgacgaataacgaagggtttacttagggcacgtagaacccataaaggacatatacaatgcatattaattcactgtgtcttaggatttgtttagattcaagtctatgagattgtctccctcattttaatccaatcacgaagagaatttaagttttcaaattagcctttcatggcttagagttgctaatatatacttgttgattcatctattagcaggtggatctaaatagcctcctaactaaagattagctgatattcttcattaacacaagatatagatggttgtgtcatatatgctctacgggacatcatttatgctccaatcaagtccatgcatgtgaatgatgtggaaagattaaaaaaaaaagtcccattattctgtgtgcgcgcttgcttttcactaacctagctagaagcacactttccctgctgctccttgtgtcgacctcgttcgcaaaccaaccgaaaaatattccaagcaagcaaagctaagcaaactctccactggatgccaacaagcaacgggtctttttcttttcccgctcaggtgccgttcctttcctttcccttttcctcgtgaaaaaagtggagtaaactcaaggttggtagagcagcaccatcctgttcattgtcatgcttgtagtagcagtagctgttgggtctcctctatcaatcgataatatatatttgcctagcacaagttcggccctgtcatcttgggaaaacaaaaaagaaatgagaaactaagacctccc

SEQ ID NO: 3589 - DNA, 1300 bp, Zea mays
  misc_feature (1)..(100): optimal_loci_113238_G1, chr3:131621276..131622575, Cluster 22
acaacagaaaaaaaaattagaacctgccttttactttccaacagaaacattttatttttgtgctagttgagtaccagcatccaatgtgacctgcaaaaggaaaactcaatttcagtccttttgtgtaaactaatgactaagagaacatgtttacacaccaatagtaattaaaacaagattacaacactactttttatcttataggttacggagttcataaaaaaatctccatcatatcaagaagcaacataagtaattctatattttttcccactcagatcataaaaatttatattatatgaaactattagccattagaacaatcaaacaagctaacaagacaacagtagaagtacctgctaattaagtgtttatgacattaatccaagtatcggtggtatgtgcactcaaagccacaaaattgatctgatctagacctgtgacaggttgtattaatctaaaaagacaaaactacagtagcaactgtggatatacaaaccctagaataaacagtcatgaatatagaaaataacttcaaggggaaatgaaataagagaaataaaaatgaaattagaaaaaaagtatagatcacaatggttgaaaggttgaggtagcgattgcctctggagaagtcgttggggcttagtaaaggtggttacgagtcatcaggaccatgtaaatggatttgcaatccaccaaataactattgcatgatatgattttcttgctgtgataatcatcagtttgtaaatgtttaatatattaaatcaggataaataattgtgttaaatagaaaaatcataatgtgtattttaacacaggtacataatttccagtacatttcctagggttgagaagctttccatggattgtcagaaatctcacaaaactagatcctaattcgtagctgcaccgtgagcgttcctacctccataccacgcgcagctccacagccccgcccgacggcgcgagactaagcgtaattagaaaaattgaggttcgagtcaaaatgaaatagaagaaattgggaccgaagaatttacaaataactgcacataattagaactaagaagtcaagaaggatgaaaagtagcctaaccccttgtttggctgcagccgtatccatttgaaatccatatgtgtagaactaatgttcacctcaatcaaacataaaaagaatcacctcaatcgaccccaaaacatgtggaatgatgtggatctcctcaaacacattccaacagtccgctgaactttgctcaaaatatttttttttcttaatggaagtgcgactgatgctaaa

SEQ ID NO: 3590 - DNA, 1236 bp, Zea mays
  misc_feature (1)..(100): optimal_loci_116472_G1, chr3:151615341..151616576, Cluster 22
ctatctcttcaaacaatcttatggattctaaaactgtggtattgaatacttggttatgacattgcactcaaaatagtgtgtggtattgaatacttggttatgacattgcactctaaatagtgtggtataaaaaaccatgcttccaattacaccttattgtagtgcactagttgtatgtacatagaatgaatgaaaagagtaaaagagaacaagaaaattgatcggagtcagaatagttaatagagaacacaagaagcattaggatatgtacaaccttgagaccttggatcggtttttaaaatataagggtctgtttgggagggctttactttaaaaactttggatcattctagcttctgtcactaaacaggtctagcttcacgagctctagctctgagaaaaaatgaaactagaggccaccttcatggaattcatgaagttcctcagatagtgcttcacaaacactgttttcatacctctttataaagttgaaattacccaccacatcactggttaaacaacacaacgcttcgcttcgatctctcgtgacatccactaatcatcaagggtaataaagaaaactcacacatatcgattgtattacagaagttggagtctatgtgcaaaccaaacactcattgaacccactttaacaaatttattagagttgttttatggtgaagccgaaaaaccaaagcaaaattttttaaagtgaaactctcctaaacaggccctaagagacaattaaccgtttggttcacatattggtaatataatgggtaacccataaagttaaatcatgtttgtttaagtccaaccgtaatcgatatcatactacaaatggatatcgccttattcaaatttattaccaccggtattcgagcgtgaatcgttaacattaacatttacattacatttggtgaactaaacagcacctaagagaccgtaagatacaatgttaagccattggatcataaatataattgaaagataatatgcatagagaatcgtgtagagacaagtttttattgtattttttatttaaaactataaagaaattataagatacccgataattattaataggttgtacatgccctaaatgtaaaaattccaacaagtatatttggccaactgttcacggttcttcaccagttgcgttcgtcgttcccgttctcctcctcgtatcccctggtccgtacgtcgtggccaccggcgccgcctagctcgcaccgc

SEQ ID NO: 3591 - DNA, 1233 bp, Zea mays
  misc_feature (1)..(100): optimal_loci_116939_G1, chr3:154560214..154561446, Cluster 22
taccaccaacaggagcaaccttatttagctaaaaccctaagacattacgctaatgggccttattatcaggctggtagtaccagtcgtgcaacccacaactaaaacaccccacatcttaaacagtcgtgcagcccagggaaactaaacgtctccactcaaactggacgactaatcagaggatcggacaattagtcgaactgatcggatcggactctggttgcgcagaaccgactagccagactagtcgaacgacttaacgttattgtgggggcacacacagatagatatttatatataggaactagcagtatatagagaatataaattatcatagaggaaggtacaaacaaaagcattgacgtacaaaatgtagaggataaagagatggtctagagggggaaaagattacgtcatttcaaagaaagacgacagagagagctagctagctagtattcggctatggtcatgtggtaaatgattggtgcctgcctgcctgcctcctccattcataaatgagcgcgtcctgaatcttcgccgcttgatcgacggcacgtcaacactgcacctaatctcggcgctcattattggctagcagtagcaagaaatgttctaacgagggaggcagcagcttgatctatatgatctaacgagagtattgtagtgatagagcaggtgaccgaccaggtggcggaaacagaaccgagcgtgaaaatccaaatatgtcgaggcgcaagagtacatgggagaaagctgaagcaagcccaacaagtcaaaagcccatgggatatgatgattaagaccttgacgggaatcagatatgatgattaaggatttgcttagttgtaagtagatttaaaaagaataaatcatattctatttaattttaactagaaaagaatttaatctcctctagtttacttccttttgtctagaaatacacctggaattattccaactgaccaaaacttataaatgagacaagcaatctgttccaaacagcgattccataagaacagaacgagccctaaaactttactcggttgcataaagatctaaatttttttaagataattaattttttttctatttaattttaactagcacaagctttaatctcggagatgcagccgcggtagaaagcgtgcacgctgccggcagcaccacgcgcggccgcgggatcaaacagacgctgcactcggtctcgtcgtcaccacccgtcgcaccaccgtcgtc

SEQ ID NO: 3592 - DNA, 1344 bp, Zea mays
  misc_feature (1)..(100): optimal_loci_117803_G1, chr3:159526451..159527794, Cluster 22
ggcaccgtggaatctgccgttttgcattgcatgcagttgagataatttgtaaaccaaataaatataaggtcgcatcagctagcatcgtatgtacagcgaacaggcagcatcaagcattactgtgggtttgcgtatgcagcatcgaccaatcagcactcagaacatagatttctatcgcggtttgatgacggctgctgtctgtgtctgtcgcactgcttgctgatttcgccttcgatgaatatcacggtttttggaggtagcacatttggctccaacctgttgattatggttactctcttgcatcggaatttgaacatgtactgacagagagatgcatcaggaactgaatgaaagcagcaaacgaagcccccgacgattacgcaattatacatcaagaatacatatatggtatgtagcagtaatacatacgcactgcgaaattgggaagtctgcgtgcgaaattggtaaggagttgagcttccctatcttattctatatctcaaattttactttacaaacaatgtcatctatagcgtcgtgtcccttattttatccgatccagtgtaaataggcttattagctggatttaggtacgtacggtgtatggatccatctctagttaattctaaaccattctatgtaaaagttttatagcattgtttctaaggccaccatatcatatagaataaaatgaaatatagacgaaactgactggataaaaaaaataatttatagttctatagacatttggttttatgatttctatagagttagtagagattcgtccctttaaattcactctcttctttgtccgtgaaaacgaagtgcttaggccatttttagtggaaattttatgcacacgattaactagattgatacgtcatctaaaagggtttgaaactatgataaatagtctcacataatggatagtttcatcattattgtttcctagtacacatacaatacacaaacactttaaaatagtacacatggtttcatctccataaaactcatttcatatctctcatcattaatacaccgccaaatcaccaaaaacactgatacggcagcctctttaatgctcatgaaattaaaatggccttataatttattaaataagaataaaggtttgattaaacttccacctatatctgtacatatggaccagtctgtcccgacacggcacatacccacgaaggcacgggccgcaaaagcatatccctaattatgggtcgtgttatgccagcacgtggccctggccatcagtccatggcacaactcacaattagttatttgtgtcaggctgaccaaaatagcttagaatgctttagtgtgccagattgg

SEQ ID NO: 3593 - DNA, 1052 bp, Zea mays
  misc_feature (1)..(100): optimal_loci_120993_G1, chr3:179419306..179420357, Cluster 22
gctccggcctccatgcgtgaccccgcatttaaaggcccgggctggggacttcggtatgcggtttcgttgatctagaaggacttgtatggaaaaacgtagatgtgcttgcccattactgtgtgcccataggaaaacctttatttaatgcataggcagccagccatatgtgtgtctcctgcatgtatgaaggtatatatcctatcttccaacaactattggagtagttggggcagtaaacctagtgatgctgcctcaagtttcatagtacgtggcagggaagcaagaattaacttttaagtgttcgaatatatgcaagattgcatggagaggcttaaacaaataaaggcaaaattactttaggggcaatcatatggtggcaattagttgatgcacgtatgtaataaagtactctgatttaaattataagagattttgtctttcatggacacattgtatttattacgtatttatacatagtatatatctaaaaacacgacaaagactgaatctagaaacaacaaaacatcttataatttgaaatagagggatgattctttttaacattgtatgtcttgttcttgaagtaagaatagtgtgtgatgcaaggtggcgtaaaggcagggacataaagaggcagtgtcgcagagatatggcatcaatcaagatatgcatgaatgcagtaaagtattatcaatattatatcttgttagtaagacgatgcatagtcacaagggtcgaagtggacagttacacttcagtgatgagcaggtacgacaaatgtggacaaacaaccatacatggtggcacgccgattaggcaggtggtgtagcaacaaaagtaaactatagagataatgtggtggcacgttgaccaagcatagaaacaaaaatggttggtcgatggtagatatagacatgaaggggaaggttagtgccacgacaaccatttggtggtagaggaaaacaaggacaaaggatagatgtgtcacgtcaaccacgatcaaagagcttgactatgtacgatggttggatggcagggtggcaaggtgtcat

SEQ ID NO: 3594 - DNA, 1034 bp, Zea mays
  misc_feature (1)..(100): optimal_loci_121339_G1, chr3:181278676..181279709, Cluster 22
gtgaagtggataagaacgcgcagtacaccatcataagcaaatggacactgtcagctgtgcgcctgtgtgggagaggagcgccttgtgaaaggtattgtggagggcacggtgctccaatccaatatgaaagcattggggttattaagagatctcttaggttgtctttcactacatcgtgaaaataagagatttctacggtagatggcatattttggagagttaagctcaaaatagaggataagatagagaagctgttaaggatatatccttagctaaacaattaaagctacaaatggagtggccttccttctcgacgctctcaacttgcgttttgaaatacagacagacgcgtgagcatttcatgcgataagtgtgaggacacacggcatccgagcttcatacaaaatagcataaaaaatgttcagtaaaagttttcaaattgagcttgaagttcaatgtaatcgagggaagtatatttgtacacctattagattaggggcattcgtactttagttattggattatctagtgtatactttttgcttatatgtaccatgtctcaaaaggaacgaaacactgaaacagaatacaaccaccaagccacggcccattgatgttgtgctgcgtgcctgtctcaaatggactcattttgggacggctaaacagactgaaggcaactgattttcagctttgcactaactgacgagaagcccatgtcttgctttataagctgcgagttattcgaatgactcaccctcgtcgccactggactttagaatcctctctatcttactaggttgcaatttataatttatttgattttttaccttaaatttaatcaactcgtcttattaaaaaatcataattattattaatgtttaccgtggtataatttagcatataatatactttaagtatgaccttaaattttttttaaccaattttcacaaaaaaagaataagacaagtcggtcaaacttggtcaaaaaaaaatcaaacagattgtaaattagtagtaccacattgtttgcatca

SEQ ID NO: 3595 - DNA, 1076 bp, Zea mays
  misc_feature (1)..(100): optimal_loci_124189_G1, chr3:195945889..195946964, Cluster 22
aaaaaggccttaccggtactgcgctgcacccttctcccatctcctctgtcctcgcctgcccgctatccgaccatcccgtcccgcacacaccatgacaaggctcaagaagcacctagtctccaacttcaagacaattgcctccatggtcaagaaagaggcacttccaagcctccaactccaagacaactaattgttggcgacactctttgcgattacaatcagcccagctccaggcatgcgttgacgacgacataaactttgaaatacacgaaccaatactctttacgtgataagaacagcgaggtttactagtaaaccatcaaacatcacgaagaacagccagtagtttttaactaaactaggaaagacaaaccattcgcctgggcaaggacatcccagagttactctcgatcggaccacgggcttttaggacatcatttgtggacatcggatcgggagataaacaccgttcggttaggtaaaaatgattaagaagaaaggagtactaaatgtaaaaaagattattatgttagatgactcaatcagtgatataccgcatattttatagggagtagaggcagtcttatattgtccagacgtgtaaaatatggatttttgcatggtaacttggttcactcgacctaacaaattgcattcgacttaacacaccaccaaaacggtttagactactagataattctctattttactcgctcaaatccaataaataatattatttggatcatccctcatccttcgactccgctacccctctcctccccctcactcgtgtcgtcgttgtcgttgatacctccactcctcgaaatcatagcgttagtacaaactatacttcgcacatagctcaagaaaaaacagtgaacctctacttcactcatacaaagctacaccctagcccacgtaaacacaaaggtttaattatatacatgctagtcaactttttttgcaaaattaaatgattacttcattttcatgttatagagtggcataaaaataaactagtttctagcttttttttcaaaattgaagtggagactcctctgagctttgtacctaat

SEQ ID NO: 3596 - DNA, 1386 bp, Zea mays
  misc_feature (1)..(100): optimal_loci_127044_G1, chr3:210668234..210669619, Cluster 22
atatatatatggatacggacggtgagatagtttgagtgttgccacctctctgttcgtgtgggctcgtcagctcgatgttggccggggacagacggacagtgaggcaaaacgtaggatctgacgacgggacttcacataaagcaggtctagctagtgcctacaatacgctgttacgccctacgtactcgtacccggcacagcacaggggactatagtataggagagtgtgcgtgtgtggctgtgtgctcactccactttcgcatccttttcctgtctcagttgattgatgtgtcccgagaccattggtgccatgtcgggtcagcttgcttctcgttcttcgatctccttccttgccttcctgccatttttggggtcaggaggagtcaggacacacgaccggtgttgattgttgactgaccggtgctcgcttggccatctgctgaaatttcagcgcatcaaatgagtgtgtttcttaccttttaatgctactctctgtccaatagcactatatagcagtggagtaccattttagctaagagtaaagccttataatataatatctatgggctatgcataattttgcacagtccactcgtatagcggcgtttggtttatacagattctagtaaatctgatattgcatcaaatccaatgtaaaagggattatcagtttacaggaagattgtgagattctgggctctgggaacaaaatccaatgtacagtataaactgtttggttaataatcagattctaaaatgagattttgaaaataagccctaaaaccaaacacaggcccttattttactcgtcaagtttttaagctcttgtgaataaactaacttcgcttctcttcaaacccctctcctctaacaccccacctcagtatacaacgcacacatgctgacatgccatgccatgccatgcatccctttattatacttgttgtaacgagaaataaaaaaaagaagatttagcgtgtaaggactaaggaatgcgaaaaaaaagtataaggaatgagaaagaaacagatggtcataaaagatactccatcggtgcttaaaaaatgtaaccttcagtttattaattaagatatctaatatgacactgtaattaaagaagataggaaaatggtttcttaataaaaaaaaatcatgtctatgcagaaaacaaataatgcagaaacgtgattgatagatagatgagtgagagaagacatatgattggataaaatgatcattctatataaattgtctattaaaaacatcaagcatagtatctatccaaattaaataggcatagaaactgcttagaacaaggttggtaatatagcccatagtgggctttaaacccttgccatgtcatctataaccaacaataaaaatatt

SEQ ID NO: 3597 - DNA, 1347 bp, Zea mays
  misc_feature (1)..(100): optimal_loci_127236_G1, chr3:211677044..211678390, Cluster 22
tgtattgttgtctgagtggagggaaagggaactgtagcgggatgatagtggtatgaatttcttctcctgttttagagctctgctctgtattgttctttaggtaattcagttgtcgcttcttttagctaacatgtttcattcgagtcaccaacatctcactataaggcctcatctcatacttcaagcggtttttacctgaaattataagacaaaaatatggttagcaatctctagttaggttagtaggatgctcaacatcttattgggtgtatgcaatataactacattgttgcaccttgatgtctatttttcagagacactccactacctgatgaacttggacgtttcatatttcagtaaacatgttacgtgtaagatcatgtgtcttcttattaaatatcttgaaggaaaggaatgggggtatgtcccattatatacccgactagcttttatatagatgtttgtaacaaaaaagaacatatatataaatgtctgcttttgatccatatgcataaatgcccacatgggattagaaactagtgatggtatctatgtcctcagctaccctaattcgtatttgtacggtgacaatatctagttctcgcatgaaattgcgatttacttggaatcactgcaaatatacatataatcatgttgtgtttattaatgtgaaatttgtgttgcttcaagggaattatatgacgtctgatagggcactattgattctagtatctactacatttaagtgggattttctcctttcgtgcgttgtctcacgcagcgaatgaaataaaagtccaaaaatgagtgggttcatatcatcacccttccccctctcgtggctaggttctaacaactggagctcacaaccatttatgttcaacaaagaataaatatggcaaatattctgaatatagaaatcgtagtaacacgcatacaaccaactagttaggcatagaagtgtcaactttgatcttcgtgcatcttacagaggcgatatccaatgagggtctggcttcctagttctcctttggtgccgaacttgttaccccagttcctctacaatctaaatgtcttcctccacctcctccgccttctgcctcgtggttgtgacgcccatcttaaagaatgggtttaactgaacgcgaccacaatcaagtgtacaactgtacaagtacaacttttgcttgaggaaatcatatacaccgacttgctattgcaagagctcaattcagacagacttgacaactttagcaattttctctaaaaactccaactccaaccttcataactaaggtactgtttggctaggtgtacgtgaatagatgcttccgtgatctaaaacgt

SEQ ID NO: 3598 - DNA, 1124 bp, Zea mays
  misc_feature (1)..(100): optimal_loci_128957_G1, chr3:220032152..220033275, Cluster 22
ggatgagacgatccctcaaattaggttatttggttctggattaagggttgggacagtactattacaatgttgtcccctgttgtcctttaaaattggagggacgagagaagacgccagagaacgtccctgtcctagctgtcccgtaaccgaacacacccttaaagcacggacaggatcacgtggcgaggtttcgtttcacagccatgttcgtacgtactatgattaactattaactactggtgcatggttcattagtactaaaatgcacagcattgctttgctagacctcttgtcggtgtgagaggtaactttatataccgttaagcagagcgttatggttcattgtctgatctgatctccgtgtaagactggaaacacaatatcacacagactaatgacagcgacctaataattttgtttgtgaacagattggtcaggctaggcgccattagcacgtgaagtggaccggattttgaagcctccgacgaccttttgctctgaagacttcaatttcttgtgcttcgcatggagcggacctgctggaccgtaccttttctcgaaaccagccaccaagagtcaaccaatatgccgaacttcttgcataattttctcaaaaagagttattatatgcaagattaaagcataagcaggtccgtatgtattagctagtagtccatcgacccatattgcagaataaccaatcttgcaagagtaacctatgactattattagctagtagtctatcgacccgtgtgggaagaattttagaagacataagcattagatactgatgtttaatacctacaaccagtagaaaatacttatattagtttatttctatatttattttttattttcaaacatgatggccatatactatgagatctatttatcaagttaagatgaatttatcgtttactgatttatgtgtttttatccatacgtatgtatttcattatgcgtttaattgagacgttagcttaagtcatggtggttttggttgtatcccatgacattatgaatctaaggtgttgtttggttcaccaactgtaacataaatagtaatggtaatgatttacagtcgaatgacaactgtaataagtttgaataagccgatatcagtt

SEQ ID NO: 3599 - DNA, 1046 bp, Zea mays
  misc_feature (1)..(100): optimal_loci_1314_G1, chr1:6779688..6780733, Cluster 22
tccctcctcgagatcataacattagcgcaagctatgttacttgtcataataatagtaaatctattgcataaataatctacatatgttttgtattttatgtcttttaacattgaataaaatataagttagaatttgatatattggtagagtaaataataatgcacatatatatatttagaattttttatgactttagtagttcaaccgattatacgaaaaatttgattgcacaatagtttttatcgttattgggatacgtatcagttgtgtgataagcattctctaaaatttctaaataattaattgaaaagttattcgtgtaaaaaaactattctccatcttagtctatttttttatatattatccgtactctgaataaccattttttctttccatctttaacaagccaaaaaatctgaaatacaaaaaaatctttatttaagatctatttaaagatgctggtggagtgtactttttatgaaaacctctatgctataaattaataatgatttagagggtctctaggaattactctgaatatctatcatttgcaggagcagattagtgtaggagtaggtgaaaaactacaatgttcttgctagaaaaggcatctgacactttatagacacttgacttgataggacagttactctttctcagcttccaggagagcctttggtgtggtcgtgccaggtccggaaagatatctaaacgactagacccggagtttatggagcctctgtcgttttttgtcttttcttcttttttatataaaagttgttttttatatttttggttccacctgctgctgttgtaaaactgctgcatagtacaatcttagatgaccacccctacccacttgcacggtggcatggccccgtcgtccgtccaatcgaccgtcgggccactgcaccggccgcacggccttgtccgtcctatccgacgtcgccggcgagagaggagcactggtagtaggtgtgatgacactttactgccttctattggcttccataaacatattacatcagcgagagagagcgagatgt

SEQ ID NO: 3600 - DNA, 1058 bp, Zea mays
  misc_feature (1)..(100): optimal_loci_131609_G1, chr4:1998593..1999650, Cluster 22
ttaggtaaagtcttccagcaaatgaacattaagcatgcagataaggcagttccttgttttcccatgatgaaaagggcctgaagatgctacttgttctttgtttatcaataaaaaaaatactactactaacttaccggatattcattttaacaacatatatgacacaaaacgttcacttaccaatcacgatcaatcctggaaatatcttacgatcaattagctataacctaatcactattgataataataataataataatggttattgaatctattcatttttcaaaataattatgcacttctgctgttatgtaaaataatataaagttacgtattttataataataatatttattggatgtattctttttttctaaatagttatctaattttggtattatgtaaaatatgataaactaactcatgactctaacatatatgtcgttaacagtacacatgttgtgccaacaaggctaagctataaaatacacatgttacatttcaccctataaaagataattccttaacaattcatataatagtaatactaataaattaattatttaaaaccttgttagtaaccatagcatatactttatatatatatatagttatgtaatttaactaaaatgtttgatatgtctatagtgtaaccataactgcgaatatataataattccttaatagaaaaactcatattcatcttgagaagtgtaggagaccacaggtggatacattttttggagtttaaaaaaactttagagtaaaaagtcagttattaaatattaaaattttctttaggttagcaccgctaaccctataagagatgtcacttaaagatatgtggtgcttgtttcaaagaattaatggtgcgtatgctattgtaatacttaagaacaaactctatgacccaaaaattttatattaaaaagtgcaaaaatgagagtaaatgaaatatacaataagcataagctagagtttcaacttaacttgaggatggagagaaaaattatgacagtcgataagaatacaattaaaaaaatcaaaatttggattca

SEQ ID NO: 3601 - DNA, 1290 bp, Zea mays
  misc_feature (1)..(100): optimal_loci_132212_G1, chr4:4208865..4210154, Cluster 22
aaggagcgtgcgctggcgagggctcttaccatggtttcaagcatccactgcactccctatctcactaagagggaggagaaggagctcagagtcaaggaatggagagaagggagaagaaagttgcaccgatgtggggaaagaaaggaattacccctccccccccccacacacacaccaaaaactcatattttctagtttcgcaaataaacaacgttgattcatggtcataggatcaggatctaagggtgtctatggttcaggctcccttttggccaatgtgagaaagggttttgtggtctagacccatgttagggcctagcacgcgaggggacagagaggcggctaataggacatcctctgagtgggccaacttaggataatttcctttgggaacaatataaaatagtgctcggtgttatttattttcatttttagtaattttctttcaaagaagataattatacaaatacttatataagtattgtacatttttttgtttaatacttgctgagaaaagttaagttaagcttactgagttttatgaattctttggtaagtttttcgacgcacataaaagtttatcctctgttaaatggaaaccatcatggaagttaatttagataatattgttgattttaacactaattcgtttaaagtttgtttagttctaattatgcccaagggtagtttagaattgaagcaatttattttagtattgtacatatatatttaatttaaaccaatgttcaattttccccatgataatgatataatgggaaatgaaactacgctatttcagtattgtatactccgagtagttccccgtgatgcaatgtgaaatgaaataaaaataggaatcgataaatataaggaggcaaagaaagcagaaagcgtcgaacgaaccaatattattgaccctgtttgttttggcttttaaccggtgttcgagaccctccttgatcgaagatcctcgtagcattaacttcattgttgttttcaagtccattttaggtatgacaggtaattgccgaatgatacatgcatcacatttgcaaatacaaagctataggcttcgactcagccgcatgaacgcgtgacaaagaaaccagcaagggtagggtgaaaacttcaagacgtgatcaacaagactacgaagagaaaagaggacagtgcccttagcaagtttcatagttcatatgtatgggactgatggcatagttgtaatttttatgaggctatacctcgtgactttttcgacggagacgagctgaattgctctatatctacgaa

SEQ ID NO: 3602 - DNA, 1066 bp, Zea mays
  misc_feature (1)..(100): optimal_loci_132948_G1, chr4:7012603..7013668, Cluster 22
agctgcaatttggcaatgtcaaaagttcctggctactatatgtcagtctcaatggctgcgccttgtaaatattccccaatttatggtaatcttgggtgacgtgtggcatgaataactaaattaattacattgtaaactctagcatgaaaaaccattaccaagatatttgaggaagtccaatagattgttgagaaccataacatgaactcaaactactaaaatactctaaagaaacatggtccacatgaacacctattgtaaagaatgaacaatactgcacatcacacaatttactctgatgcaacatggatttactatgatactacatgcattcgtatccatatggagttattcatttcaatgtgcactcgtgttttctggtccacatcgttggtacagataattttttgaaagccacttgaaaacaacgataagcttcttgcgttgctggatagatttcatatttctctaaatgcagctgcaagagagcaaagagattgagctggttaaacaccaatatgtgtcatcttgctctcgacctgcatggtcaggaaggagagaaacaactgcatgttccagcacacgacatcgtccccaacctcccctctggccaagaagcagagtgatggatcagagtccatagttgagatcgctaggtcgctcgtgcttcagtcaatacgtatggtttgccatttaggctgtttagcgggaatgtttcatactgattttttttttctagaatacctgcacatcattttattataaggtgaggtaactcatcaatgtaatttgtccttcatttgtggtgcactgacatatggtgaagttcaagggagctgcaagctttttactcagcaataatggatttagcaaccgtgacgagagagaaacagagactgcattgttgaaatagagggcacagtggactcgagtacaaaacaaagtgatgtacaaaatagtgtctggaagttgtaaatgaaactcctacaggttcacatttaacatttgtactagtgtagcaaagttgaatgatggaagccctctcttccttaaaacacaacactag

SEQ ID NO: 3603 - DNA, 1095 bp, Zea mays
  misc_feature (1)..(100): optimal_loci_133450_G1, chr4:9858844..9859938, Cluster 22
ttttctgtttggtttataaaattgtaagaaaaacagaccgatgtctatttaaatgaaggttttagtgcttgataatcaacactatagtttaagcttatattattaagaaaatttcatcagtgccatcaaaatctataccaaacccttgtatgtcataaaaaattatgagttcccttcaataccattaatttggattttaagtcccttcaatgccattaccgtcacttgcgaggaggacatggcgtacgccaccacggtcgtgctgcaatacagcgtggcgaggtgaagcagtcgacagcagtggtggtcatgagtttgccaacaatggtaaagttgagtgtgtagctccctacaaagcattaaggaaatcggtaggccgacactttcagttggcagaccacagtgacatcttgtttagctgtaaaccaattgcacactcaaaagaactttgtcatcttgtttagctgtaaaccaattgcacactcaaaagaactttgtagggaaatacccaggctactatgttcaggcagcatgaactatgttcaagctgttatattgagtaatgttcagacactagggactatgctcaggcaactactgtgaaaaaaaaatcagaacttaaccttgtcgacaacaaaacaggatgttcaagcaactgtgaaaaaatcggaacttggaatgtatgttgccaaaaaagaaatcagaacatgtttgcttccagaaggtaaagtttagtcaccccactttagtcaccatgtttgcttctttaggtactaaaagtgactaaagtttagtcaccctaaaccaaatagcatccatacatgagttcaagacatacatcatacccatacatgagttcacaaataccccgattctatttttggcaatataagcttcgacaatttcattttacaaaaacctcatcttggcagttccattttcctaaataactcggtcctgagcatgccgcgtagtagtcacagggctaggtggttgcgttgaggaggtgaggtgagaagagctgaaggggcatatggaggttaggctatgacgagtgagcccaatcgaacgaataacggtggtaaacagtagcaa

SEQ ID NO: 3604 - DNA, 1206 bp, Zea mays
  misc_feature (1)..(100): optimal_loci_133576_G1, chr4:10345822..10347027, Cluster 22
ttatcgttttaacattagtagcactacatatttctaatatgcaggtacatgtttgactttttgatgttctacattactaatatgtacattctgggcaaagtatctgtttcagaaggtacatattagtaaatgaaatatgtttgcgagtcttacaacattttggcattcattatttcgtttttaacgctttccatggaatgttaggttcccatacttgcatctgaacattgttcaaataaattggtaccaactaatttagaaaatttcatgaaattttatatcattgtaatgtacaacatcaaaaagtcccatcaaactctcaacaaaaataaccaaaagtaaaacttgtaaagccaaacccagtcccttgttttcattttgaatcagaatcaatacatgaattaggttggcacaacaaaaaaggcacccttttagtcaggaatatttggtcatattgagtatacctcataccaaaagaatgataagtaaaccacaacaaaaaatggaaaatcaagtccattaggtggggaagaacttatcatgttgcatgaacaaacctcatggctccactatatatccgtggttttgaaaaacctcaccatgttgcttgttaaagcacatccaacatagctagtgtcctttgatggatcatgtaaaaaaactcatctgcaggggaaacaaacagacagataaacatgttacaacaggtggaagaaccacactattccggtagcatatacaaagaaaccaagatagctcaaaattaaaaatatagatcaatgccaaattattctcacaatagtttctacatatttaatattatattacctcaaagggaaggagtctagtgtcacctagatcaagtgtatgcttgagcccaccaccaggccagtcgaacacatgcaggtgtcttccataaaattcaaaacatatctagatccttgatagaattactatatcctgtgaaatagaacgggagaaatttcatggttatcctcataatctaatcgttttttctatctaccaagtaccagcaaaggatacacagctcttctatgggtttgagagaaaaattcgtgtcagtttttttatgcttgcttagtgcatattatcatctttggggaatgtactttttggatcagatggctctaaataagatgaggatggatggagacgtggaatttgagatgaacatatgaaaccagc

SEQ ID NO: 3605 - DNA, 1211 bp, Zea mays
  misc_feature (1)..(100): optimal_loci_134378_G1, chr4:14033376..14034586, Cluster 22
gtcacacctcaaaatttgtactattggatgagaacacaaatagcactaaataaagtaaattatctaatagtttcttaaaaaacagatgtccaaagtttagttatttgttaccatttttcaaataaaaaataatttataaaaaccataaacttttttttctttgggtaagcctagtttcaaaagcaatttgaagttttagattcaaataccctttaaatttatcttaaaataaatattaaagtacggttgaacttggtttagattctcagaatggttcaaaagtatgcataaataatgttagaaaaataggttcaaatggtttgagaaaataaataaattttgaatttaaaatggtttcaaaataattctaaagtgattttaatatctgatttaaatatttatgaaagtaaagtttaaaaggtttttaaattattttttaaaagttcgaaacaaaatagtttaaaccattttcaaataaaatttaaaaatgtggatttgaatgaatttaatttgttttcaaatatcatagtttggaagttaacatttcaaaccgtttaagcaaaattccaaaaccaggcattcaagattatgaagtgtttcaaaaccaatagtgggtgaaaccttcttcaaaatcttagctactccatgtgtcgctttatcattattttggtctgccagtttttgtctctcggaccaagcctaatcctcgtcttgggcactggcctatcaagctggcccatccatactgtgtagcagctgtagcggcccattcgtgtctttttgtgaccaggccacaaccccatcttccatgccagcactgcatcagcccgtcaccattctctgtctaatgtcacgacctcatatatatgtcgggccattttcatcctcacagcccttttcctactttggccagtgatgaattcagctgtcacttggccatattcacctacctgtgctccatttagattatcttcagcacagcagcttacacatctatatttttatattcaaatttcactctacaaacagtgtaatctacaatataaaacagttcaaaacaacattttacgtaaccatatgggaatcttagaccaactgtggtagttcccaaaagaattccctaaacaagaaatttagagagtttttataaaatctactcttcaactgcttctgcttctgaaatcaatttgctaaatttacaatatattaaa

SEQ ID NO: 3606 - DNA, 1216 bp, Zea mays
  misc_feature (1)..(100): optimal_loci_1438_G1, chr1:7493408..7494623, Cluster 22
gaatcgggcttgtgaactgtttggaacatgggaatttttttccaacgcttttttcatgtgaaatttgttcatgataactataagattataaatctagttgaaatctataaacttattataaagtttattatctttgttcgtcgtcatataaaaaatatatggttttttcatcgttatcatagctataaactaaattggtggcaataatcggtagtgagaaatctacctattaagtcatgaactgatagttatacaaccaattatatgatatctgtgtgctgggggtagcggttgatatgataagatgtatttttggagtagtggtcgatgccatgatagtcattttttttttcaaatgaacaaattcggtgtacatctgaataacacaatgcatgcaggggtgccttgtatagttgtatggatggagtacccatggtgaagagaagagacatatatgttcgtccagctggacaggtaaaagtctccgttatgacgactcattaactcgtaaagtgacgagagtgctgaatttatgcgtgtatgcattgattgaaggtttggctagattgctagctaaaacaccggggcgattattgctttggtacttgtctctgggggaattaggcaattgaattccacgttgttgatttgatcctctcgaaacgtatgaataatgggactggctttatcacttatctgaagtccacgtcaacggagtaccgtctggattcacggggattctaagaatctggatatatagaggggaggaaaagcagactcaaaatctgaaaatcttatgcaaacatcaccttatacgattctatagaattctaaagacagggactcattcataattcaagtaacatcagagagacgggttttttttatataaaaaaaaatccaggatccggattttagaattattcattcaatccaaacgtgccgccatatataagctcgttggattggattgaggtggcgactatatatttccagcttgtttgaagccaagtactttgaaccgtaataaatggaagtgtgaagtggacgtaataaattaacgtcgtctgcgctgctggccatatcttggtatttcagtagtacagtacgttatcggtcgcggtccatattaacgcacgacgatctcgacgtccagaatactattcgccgggcccgggtccgggacgaccgcccaaggttatctgctgattaggta

SEQ ID NO: 3607 - DNA, 1251 bp, Zea mays
  misc_feature (1)..(100): optimal_loci_14679_G1, chr1:80862361..80863611, Cluster 22
tcttaagcatcgcttggtgtttccaaaccagtcttaaagggttgtactttagtaccggtatttgctagatccggtattatagatatgtctgcacattagtatctgttagtgtattaaacatgtactaaaggcttgttaaccatgtcgaagatagcacattgatgagacagaggcaaataccctcatttagcccgctatagcacattatatcccgatatagcccgttatttgcacttttgagaagcaccccgctaaacctcgtagcccgctatttaaaaccatgagtcaaactacattagacgtatatatgttttatgatttctagttttgttaggaactaggctcaaatttccagacaagtcttttatgggccatgatacgtgacttgtatcttgtaatgaggagcccaagaccattcaggacatgtccgacgtgggcctgctagtgtactatatctctcggtaatcgaaacttcagttttggccgagccctttcaatttaggcctagaatgctctaccttgtctacaataactctagccattcagtatttcagtttagcactcgagtatcgcagtcacccgatttttttctatatctacgaaaccagttcttttactcttctcaacttttaagaaccgttcatttttgcatccatgtaattactgatacgacgctatatcagaggagataaaatcaaactatgttaaaattgtaaggaggtaaatggaactaccaatatttttgaaaaaaagttcaaaacttatttaaatatattttatatggaaagttaatgcaattaaaaattataaaacctaatttagtcttggaaattcatagaaaatttattttaactcaaaatgttatgaaatttgttcatttttttttctaaagtcataatctatgttatgctaccaagcttgaaagtgtatagattttattagactcattacttttgatcttatttttagtagatgctcttgtatctacttcgataatcgatatgatcatcttaattacatagaagcgataggttcattgtgcctagaaaaaatctaaagtatccatgttaggcctccttggtagccaagatcccggaaggatccaaacccattctctggccccgaaaaccacgggccaaattaccctaggtcaaaaaaattcatttggtggcccacgctcctcagcccaatccgcaggggaggacggcactttcgccttggtctccgaaggccagaaagggttttctcgcc

SEQ ID NO: 3608 - DNA, 1035 bp, Zea mays
  misc_feature (1)..(100): optimal_loci_151664_G1, chr4:125487854..125488888, Cluster 22
taacttggtgaatcacgtggaccttccacaattgcaacaaatttgtccactactatgtctatctcatttgggagcatgttgcccatagcatacagagatggaaatacaatagcagcaatgacaatcacgcagttccgcaaaggaaaaaggacatgtattgggttgaactaaaaaagttctcaatgcatatagattaagaatataggtgaaagaatgggctctaaagaatatggtggtactattttagagtcataagaagaaaatttagaagtttcttgagtatatgggcattattaggaggtgttcatacaatacaagcaattgaaagatgggcactatgtttctatgaagaaaaacaataatgtgttcaaatgaaagttttcatatgattgaccctagtggttacaaaaaccttgtggaaaaaacacaaaaatggtattataccaatggggaagcatcttgaaatatggtagcttatgttttaatgaaagaatatgagttgaaatacttgatgtttccatcgatgagtcctcaaaagtgagttcatacctaatagggaaaatgataatctcactattgctctttagaatcccgagcaccctagccaaacaagagggtaaggcattttgcttggaagtatggatttgctatgaacattgacacatataagaaccaacatagaagtaaggacaaggaggaagaaagtgtgcataacttggaatgtcgaccagctcaaactgaaacatctcgcatgttgtttattaataatacttcatatgtaagcaattgccaatttaacttagcaattgccaaactttctagtatgtatagacttgcacatctcgcatgttgtttattaataatacttcataacctttttccttttagtattacccacaaggacaaggaaataattttttataataatttaagaataacttataggatttttataaacaaatataatggcattcgtagtagtagttatttgtatatttattttataagaatttttcaaataaaaagggtacggca

SEQ ID NO: 3609 - DNA, 1209 bp, Zea mays
  misc_feature (1)..(100): optimal_loci_154824_G1, chr4:145728456..145729664, Cluster 22
tgtttttcccatatatgacccctgcaggaatatctcgtcaatatttttttttgtttttcccatatatgacccctgcaggaatattcttcttaaattccattcagtattgaccattaggacagcataaagtttaactgtacattttccaattaaatcttaaattctaataaatgtatttttgtagtttttcccatatatgacctctgcaggaatattcttcttaaattccattcagtattgaccattacgacagcataaagtttaactgtacattttccaattaaatcttaaattctaataaatgtatttttgtagttttttcccatatatgacctctgcaggaatattcttcttaaattccattcagtattgaccattacgacagcataaagtttaactgtacattttccaattaaatcttaaattctgataaatgtatttttgtagttttttcccatatatgacctctgcaggaatattcttcttaaattccattcagtattgaccattaggacatcataaagtttaactgtacattttccaattaaatcttaaattctaataaatttatttttgtaattttttcccatatatgacctctgcaggaatattgtccttaaattccattcagtattgaccattagatcagcataaagtttaactgtacatttttcaattaaatcttaaattctaataaatgtggaccattagatctttttaattaaatttgttcacgctcttttttctgattaattccgtaatttttagaccctttcggtgagcgtggagtttttttttaactttgttgtagtaatatagtacatagattgacgagctataacatggttttttcctgcaacctgtacagatttgtattccagatgttttattgatgataacatatcagtctgtagtgatttggtaagacattagcgaatggtcaaagcatacttgaaagactttttaaaatcctaatacgaagttcctgacagatacatcaagctgcaaagagaccattagatcagcatattcttcttaaattccattcagtattgaccattagatcagcataaagtttaactgtacatttttcaattaaatcttaaattctaataaatgtggaccattagatctttttaattaaatttgttcacgctcttttttctgattaattccgtaatttttagaccctttcggtgagcgtggagt

SEQ ID NO: 3610 - DNA, 1063 bp, Zea mays
  misc_feature (1)..(100): optimal_loci_157922_G1, chr4:162346687..162347749, Cluster 22
gtttagttcatcgaccttaattttatttcatgaaggattggagtctttttttcattggtcttattatttttttatatattttctgtacagcgagtttgattcagaaaacttgaatccaaacatgaacctacatcgaagcaactacatattatgtgtcgtgaagaaatatgaggggttacaaattccatagccgacaaaaattagcttttttccgtcggccttttctaatcgacgaaattaaccacttttcatcggctgctcacaaaaaatagatactattcatctatacatttacatgagttaaatgatgacagaattagactatgcccacagaaatttgttatttttacaagtgacacgtagtttcgttaatctttatccgacaaaagttatttatattattgttggggacttgtggttgtaggagcggccacggaaggcggcaatggaatgtgaaaataattgtaccagagccggggcaggtcttggtgtatgtttaggttagaaaatctactagaaatcatctaggaaattctattttattcaacggtcataacaaaagcatgcttattgtcatggccataaatttgtcaacaaataggagtatctagtagcaagcatatataatgttgttttttttcctttcctaaattaattgacctcgacgtgagtggtcggaacacaaacacgagaagaaaggctgggacagagcggaaagctaataaaatggtgttcacgtgaaaaataaacaaggtaacctattctacataagaaattaatcgaatccgtcgctgttggtatctcgtggaaatggctacctgactgacagacgcacgttatctgcccctgcgccgctagctctccgctcgtgacgtcgtcttcgagactttaaagatggtacggtaataagtagtggacatgcatccatttacatgtcaaactaaggtgccgtttggttcctaaaatgtaacgtaaatggtaacggtaatagtttgtattcgattactagcggtaacaagtttgaataggctagtatcaattactagtgtggtatccgattacg

SEQ ID NO: 3611 - DNA, 1180 bp, Zea mays
  misc_feature (1)..(100): optimal_loci_159841_G1, chr4:174046875..174048054, Cluster 22
attaggttaattgatttatgccgaaattgtgatggttaaaatagatttttttaaaaaaaattctaaagatccaaatggccggcgtcccaacagaaacatgacacaaaaagatggaagcaatgtcgatcctccaaacagaacgaagatacgttgtgcgtcacgcatcatattggagtaggtagttcctccatttgtgtcggtggattaagcacagaaaaaaaaagataccacattttggcaggtacatggttactgactccaaattttgttttgttgaagcaacaagttgccatcttgacaagattcaaaacacatgacgaagtgttcttttctagtgggggccgggctttaatacattccttcagcatgggtggcctggcccccagtatacataggtacagtatctggctaagtagccggggggaaaaatacagtccattataataacaaggcacgagagccacaccaaataatagaaaattttctcacagagaatcgtgatcggggccattggcatctttagacaggaggacaccagcgacattggtacaatacctggctaaagagcatcgggaaaaaaaatataatccattatatatatataacaaggcacgagaggcacacccaataataaaataatgaagatcagtcatgaagacagcaatgcatgcaccctaccattacaaattatagtagtacagtgcatttttgattcgctgcggaaagaaggaacttcagcgtttttttgatcaatcgtgtattattgtaggcaggaaatagagttggcactttggtcaggccatcatttgaagtgagctatggcacaatcttttgctatcctccatctgttataaaaaagaatatatttctctttcaatgaatcaaatagtccaagtgcttgtttagaagtaaattttttttatagtttttaggtaatacaatgatttaatgataccatagtattttatgccataagatgtttgtttacaatcctgaaagatatgtttttaaaaccattgtattttagataccatggtatttttttttgagtattgaaaacttcactccaacccaaagtttttatggcattgctagcttttacctaataacatggtttacaatgttgtatccaaacaatatttctcaaaaccatgatatttgtggagctggttaaaaaaag

SEQ ID NO: 3612 - DNA, 1337 bp, Zea mays
  misc_feature (1)..(100): optimal_loci_160576_G1, chr4:178508665..178510001, Cluster 22
tttatatttgcaaaaaaaaagttatataagcacctattgaagttgtttattgcttgcgcccaaaattagatcctttactgttttggcttatcattattagtactttacattgcgctgtaaagcttatttgaatatgcatcgtgttgcacaacatcttagtgctttgttagatttgagttgcacaacatcatattcatttatgggtagccatcatcttttgcattcggattgttagaatcattgactaagttggaagtcatctcttcatcctagctaccgaaccgcttaccgcacttgatcaccatggccaccactcctaggaatttttcaccaagggtctcacggaatagtcaccaccatccccacctatcttccctaacattccccaaaagcccaatttgtaatatagaatctaggctactgcaacgttctactactatatcaccactatgtatatactttcagaagtgtcacttttctgtttctgtatctataataacacttctttgactatgtatgtgtgtcgagtcaactataaatatattgttgaaaggcttgcgcgaagcgcgatcaagttactagtactgtaatacatttttttgctggttaaagataaagagcgcataaaatataaaaatgttatataatattttaaaaatatttataaacatttttattttaatgattatttaaatagtgatttcgagagtaatttaagaaaagatggcaccagattaaatctgaaaggcaacggatctcggcaacagtttttaggagcacctgtgggctgtggctatgtctcgctgctcaccaagttcttattgtgttcgtgtgtatgtatcattctgcataatataattattaaggatgaatgcagagaatcatataacatagacgattataggatagtcaagtcctccattgtcgcccccaaccattattccggaaacaccgagagtttctgcaaccattttgcaatgtgagatcgtaatctatgctagcccggtacatgaccaacatgaagcatatttgtgatatccatgaccaacatgaagcatgtttgtgatatccgtcaaaagaattatattttatgtttatgaattttgtaatctttatttttagtaatatacttttattaattttatgaatcatgtaaattttatttttaactaatgtaatttaatctgttttacgaattaagtatatttatataaatctgtaaaggaaaaattgacatgatgatgatttgatcatcgattgatagtaaagatttggcaaagtggagtgataaataaaagctagcgattgtggatggtaggatccttggaccgagccta

SEQ ID NO: 3613 - DNA, 1131 bp, Zea mays
  misc_feature (1)..(100): optimal_loci_161541_G1, chr4:185331493..185332623, Cluster 22
gtaaaaacatacatattacaatattacagtaaaattttcttataaaatgtttagatacaattagacgatggatatatcgtggcctccaactcttcaatattttgttgttgaaatattatgtcgtaaactgataacctaactactaaatatatacccaggatcgagaccctatatacttggaggtctggggcgaaccaaccccacccttaggatgggtccaacatatctctggcccattccccacaataggtgtacgaatggggtagccactccaatggtgccccctcgcgagcgggtgggcgccttctcaccctatgtacgaggaaatctgatatttccacatttcgctaaacaatgctttatttgtgaaattatttttttctctttaattaccttaaaacaatgtgtattatggtactataaatatgatagtatttttaaaactctaaaattgatgtaaaaagttaaatagcgcaattaaaaaataaagggaagctaaacagagggagctattgaagaagaaataaaataggagggaaaatagttgaggtatttaaatataactataaagtacgaatgtgtggatttgagaaggagaatggtagagaaggtcttagagccgccactgggtttactcccacctcctccctcttaaaaaaaacaaaaaaggtgtttcctacttacccaaaaactttggcttttatcgggctatacatatacacacaggaactctataatttacttaaattttagagaatataaaaatagttcattaatatgatggctttaaattcttctaagtttatgtatatatctatatttctatatatatatatttgcagtacctctaatacatatttgttaattagtaattaccaaggggtgtactgagtactgacgtgggcgctgtatcaatctgagccggcccatgttgtccacagtgagtcatccacacggcccacgaagcaattccaactcaacggctgcgggctgccactgccagacacaagggctggttgacccaggctgggctctcggcccaacacgtgctaatgttaggattaagcaatggactgtgatcaattttgtactagttattatgttgcgtagccacggcctgttaagtaccct

SEQ ID NO: 3614 - DNA, 1191 bp, Zea mays
  misc_feature (1)..(100): optimal_loci_162197_G1, chr4:188677617..188678807, Cluster 22
ctctctctagtgcgcactatccatcgcaggcgcttgaaatttctgcagcatgcatgcatgcagctgcgacggcaacatataatatgtataaatactatacacggatggatggactttgttatcacgatcaactttctttaaagtgagacgcactgaacctggtcaccagtcgaattattacctactatagctagaagactagcttagaccccgttgcactttacctgtcttaaagttttatcttagctagctaaattatagttgaaagtgttaattagctagctgaagtttatctatagctagcaccagtagtgtgtttggtttccagctagataatatatatagaccagccaataatatatataatcttgtatttttttagaaacactgagcagacagtgataaaaagatctccagtttttatatagtcgtcctactctctctcggctaaaaacaacttacacaaatatttatacaactttcttagcacttaaattaaacgtggacacataacttcattacacaaattaacatttctcggaactttatgtgggtccacatataaagtcctcggaaaattctacaaatatttgtgtaagttattgtagctcggaggagggctatgtaaaaattatagatcgttttattgttgttttgctaagtgtttataaaaaaagcaaatataaattgatttagttagttattagctagaagaaatgccactaaacttactcaataaaatcaaccagaattttagttgttcagtaatagtattagttatttccaataaaagttttagcctcagaagataagaaatgattttgagacaaaaaaattaagctttttcatgtagtttttatttttagtaattaagctgctaaacctaaaattcaagaaacattaggtcaaatataatacctcattacaaacttatgtgcaaaattatataaagtttggatacagttaagtcacaaaactgaaatagacaaaattggtgccacggtagcaatgccacactagtagccaattaatacattagcagcaaatgttaaagccaagtggcaatgccacatcagcaaggccattcactataactgtattagggggttatttgctcagttttaaaaagttgtggagggttatatcgggagaggaagttgactgaaagttctacataaccccctttccttt

SEQ ID NO: 3615 - DNA, 1228 bp, Zea mays
  misc_feature (1)..(100): optimal_loci_162689_G1, chr4:190618258..190619485, Cluster 22
catgaataaagtaaattattaaccaaatcaaaaatcagtcgaagcaaaatgctagaataggcatggattactctttttcctgcaaactaaaagagtgtcaattttacataataggacgcccctttcataagtcgtcatagttacgtgtccgtgcgttgcaacgacgtacaaatacaaaatattcaacggttgcgcagggcaacatcaattattcagtttattgagaagtgcaatagcacaccacctccgaaaggtacaatatttatttattctggcaactttttattatctatgtactttatgtgaggaacaaacacagcttctacctttataaaaggtatacttttagtcacttttagctcctaaggcgaacctaaaatttagttagtttgtttagctcctggatccaaacatgccttcagcaagctcatcttcttttagaatgttgtttctagccaaaatcaataaatgcgagtggattgtttgaatttgtagacaatgacaacacagatacacaaaaattaaagagctccttttctaataacaaacttgatgtagcaaagttaaccagtatagtacttcaggtggttaagatcatacctactgttgccaaactggattgtgtccttttaaaataactcataatagtgtcgaggctcaatgcgatttccttgcaaaaacgatgaaattcacataacagaagagtcaaaacatgagtagtagatctgacagattaacacacatattgctagaaaccttacattgatgaaagttccatgtgtactatcaacaaccattagataaggcctatcaaacaagatggtatgataaattgttactgatataatgaaatcgagaaggcattacttatatcccagagaagagatcaagtaaacaaatgcaaaaaaagaaccatgcagaaacattaaaaggatatccaagtaatactaactatctgatacccgctaaatgattcctatgtaaatgtgtttcattctcttgtaaaaagaacccacaaacccacaaaaagaacccacaaatccaagagaatgtaaatgattccttttatatatccaatgaaaaagaaccatgtagaaacattaaaaggatatccaagtaatactaacattaaaatggaagcatgactactgtaaatgtgtttcattctcttggattttccttgtgtcctaccgctgcaaacatgtgggagtgctttcgaagaatgtgt

SEQ ID NO: 3616 - DNA, 1164 bp, Zea mays
  misc_feature (1)..(100): optimal_loci_163451_G1, chr4:194218959..194220122, Cluster 22
actttaacgaaagaaatttcatgggctccatatggacattaaagcctcttgaagctcctaaactaggaactagagcttcaagttactatcttagcatgtttatgactactgacccactatacataaatacatatgcaatacatcatcttcatattaatataaaccaaacaaagcatatcattgcttctgatgagcacaacttcatacttccgtaaaataacgaagtcatgagagatgctttatgtagcaaaaaacttgaatgccaagattacttagagcattttaagtgctacataatagggaagctatagccttgacttaccagtgagcatgttcaatctaaattcacttttgatgagtaaaatgcatagtgatcaaacttgggacattcacaccatcaacacttgcgagctagttatgcatttaaatcaagctatgtacaagttatgtcgcctatagctagaactgaaaaatgagaaaactagcctattggattcaatctatgggtagtaatttgatgaaacattgatatgtgctgctgtatactttgcccacatagagatcttactctgactatgcagcatatgtagtatatgcataatatatgtagcatatgcattatgtgtagagtatatgcagcatatgtagtatgcattctacacaaaagatgcaacctttgttcaaattaaaatgaacaagtagcgtctagttgatagcaagtaaattgttatattgtagaacttgaaaggaatattagatacataggaatcaaggaacttactaaagcatatgcagtatgaactccctccttatagtcctgaaagtgcgaaaagcaaggttatcttatttgggacattcacaaacacactcgctgctttgacaagctcagtatcggtaaactccaacctagttagctcagctatatatttttgttgtagggcttgcattggattctcatgtgcagcttcctcttggagcttagtttcacgctccataattccaaacatttttccaaagtgatttgaagcattcttaagatcaccatgaaatccacctaccatatccaaaaatgggtcacttaacttgctaacttcatttcctttgtctcgcttccttatcttggggcttgatgaagtagaatcaagtgagttcctctatgaagcc

SEQ ID NO: 3617 - DNA, 1186 bp, Zea mays
  misc_feature (1)..(100): optimal_loci_164332_G1, chr4:198850196..198851381, Cluster 22
ttctctttctcgctcaacgagaggttctttataggaagatgagattggttgtcctgtgaaccatctacagtcgtgacctgggaaaagaacaatcaacaactcagtgaattgcaatcaagattaaggtttgtcaatgagtgtatataatattgctgccatgccatgccacgaaaaatactgaaaggtgctaccaatgatgacatagcaactgcaaaatagcatatgcaactattatatgcataactgcttgtatatttgtaactgttatgagccataccaggcacatgaccgtttagtacatgttgatacaagactggtaaatacaagaaaactagcaactattatatgcttaactacttgtatattgtaactattatgagctacaccaggcacatgaccatttagtacatgttgatataagacagtgtgtggtaaatacaggaaaaccaacaaatcctgttcccagaattactgtgcagcaaacctggttttcaagttggacattgagagcatcaatactggttatgctcccatcgtttccagcttcccgaataattgcttctaactaccacaggaacaatttgttacatcaatacatgagaagtcaacacagcatatataatgtcactatacgaaggaagctatcacatactagtcccttgtagaatgcaatctgggacacataatactttgttccgagctgtgattctttgtcagcaacattattaccactccgtagtacaccattccatcatattgattgatgaatgcttgcaactcaaagctcacaaatgcgagttctttgttgatgttccaaagcgtatcattgaacagttgttgatcattggctgcaagccatatatgaaataattcaaataagtggttggaggctagacatttgacaaaatgaatagttgttgatcattggtgcttgatatatgattcagctggccaataaggtttataagtgaaaataattccaacccaatgtacaatgaaagccattatttcagacaaacagataatgcgggtttgaaatgcaagtgtaatttccagtaaattcattgaaatgattgtgatcggtttggctcatcagcaaatgagcagtcaaatttccttagttatatcttcgatttttttcttaagatagtgatacctttgatgagaaagtaagtgcagctacttc

SEQ ID NO: 3618 - DNA, 1046 bp, Zea mays
  misc_feature (1)..(100): optimal_loci_164416_G1, chr4:199285230..199286275, Cluster 22
gggctaaaaggatcccgaatgttcgctacttgtccatggaggtggtggtcgagctggcggatgcagagcgaggctcctcgtttgggcggagtggggctcctcatcgatgcggggtcggcgaggctcttcatcgggtttcaatttagcaaactggtgtctgatttattcctatgtggtttgtctgttctgtatttgtatgttgtaaacatgtcttctcgcaaaaaatacttatttctagagctactagcaaggtgctcatacgttgctacgatttttatttatgcttgaggatagaatttaaaacataaggacagtcaacaatcatggattcaatctctatttatgtatttaccatttaaatataggggcacaaacacaggtgctttatatagtaaagattaattgccctgattcaaatccttatttatgcatacttttagatttttattatttaaatatgagagagggtggtcgttaaattatggaaactggtgttttatatagtagaaagttataatcttctagtcaaacatcttaaaaactcccgagtagctactccttcatggattttggagtagatttgcttctgggagttttggagccaagttgattctgggtggggtggagctaatgctaaacacgcccttaaaaatatgttcttttgtttcgcgtctttttttcgtcgctagacctcctcgcgctcgttgttctcggtcgtgcaccgtacccgccactgctccacgctcaccccatcccgatcgatcacaccctactctgtagatgtgtgcatgagagggtatacataaatagatagcaatcaatagtctataaaaatttctctataaaaactacaatactaaaggaaagattgaataatagaaaatgaagtcttaatagtaactaatttcgcactggctctatttcactcgaaacaagccacttcatgattttataattctagtagcttgacttgtagtctatttgtacaacaacaaacaaattacaaatacaatttagctaaactagagaggtaagtaaattacaga

SEQ ID NO: 3619 - DNA, 1381 bp, Zea mays
  misc_feature (1)..(100): optimal_loci_1651_G1, chr1:8454255..8455635, Cluster 22
atgtaggtttttgcgtgcccgggaagcgccagaactgaagcccaacattactattcgcaacagcaaatgacacatacctgaaaatcacatcgatcaaaacaggaaccaagttgaatttaacgaattcaaagataagaatatgacttgtgctcaagccactagtgactctactcacacgagttgatactacctacgtgaagtcgccgaccaccatcaatacaaataaacgaacggtgaatatgttctttggtcgtcttttcacgtaagggacacccgtaggaggtaatggttggagttatgggagtagtcaccgtaaccttcattagctagcctcgccacgctatgccacgactcacctccggggcaatgacacacacgtgtggagcatccttggcccgtctcatattctcaatatgtcaacatatatagtctgtctttttaaaccgagtcaacaaacagtcaaaatacctcattattacattgcacaaagcatttaatatcggtctatattttatttgatttaattaaataaaatatatgccaaacctatatatagagatatagatagagatatagcttttatcactttcttttttattatagaatagaagagatatatagatagagatagagtttttatctattcatttattcatgttttttgtgtacgttctttctggcccttctttcaatgtccgaatttctaacttggatcaactgggcgtttcaatcatcttttttttcttgttttatttaaataaaagatgtcttgatttgttctttggaagctatgctacagacggaaagggggatgctatatcctagacgcctgaaaaaaatgaaaaaaaaaaccctgacgaattctcatgcgcttgctgtctagtctccgtgagaaagtagcaatgatttcaaatgcaatcaaacgcataggagttggttaccaaaaaaaaagaagcacataggagtctcttgagatccgaactagtcaaactgcagcagtgcagctctttccatcgcacaaggcagcaaagcagatcatccggcccagtccgcccacagcttcagcccatacatttcgggcccgaccgcgacactcggttctggcccaagctgcgcggtcaaagttaggcgccacgtggtccaccgatttggccgcgggagacggcgtgggcccgatccccaacgagcagtcagttgggctatcaaacaataattctgaaatcaggctcggtcacctaagagagcgaggctccggaaatcaggctcggttcggacttttgaacagctacaataaatctaatttagagcataaactgtatattttatatataaaataaaaaatatgtaccaaaaattcaggaacatattttaaactatatct

SEQ ID NO: 3620 - DNA, 1273 bp, Zea mays
  misc_feature (1)..(100): optimal_loci_16738_G1, chr1:92874037..92875309, Cluster 22
agaggtttttaggggtccacaagggtttttctgctaagtattttctttaaaattagaaaacttgttgtatttcatatgtcagaaatatggtatttttcaggtaacgatcttcaccattgattcatgagcatgtaaagttgagattcattttaatgcagataagcaaatgagtggatacaatatcattgaagacaatatataaatcaaacacttgaccattaggaaaagtgaacaaataaaaggtcttacaacaagctcatgaaacaaagaaagagataaagaaaataatataaattacatataagcttttttccattgattaatttgagaatcataagctttctttgctctaaaaataactcaagcaaagtccatcttgaaattcattttgccatattgaatggaaagttgaacttgtcgcaatattgcatcatttcataccgaccaaatagcctaacacatagatatgaccacttccataaagaaaggaacccaaaactgattgctgaaagaaagaatggcttccaaaggtcaacaagagtacagtagggatggttaatcccaaattggctagcaggctatagcaaatgggcattctaggcaaagatgaataatactttcttctgtcgacaagttgcaaaacataattataatcctccataaccatattttcagtttcagtaaattccttatgccgagacagtccttgagtaaaagccagaaaaaggcctttcatttttttgacagatatgctcagtggacttgtctatggccaatcaaatgagcataaggcttttgaaacaaaaaatagaagaattccatatataagtcagaggtcagtcttctaccaagtgtaaaatgccaactatcatggttagagtctaaaactgatggaaggtttcaaccaataaaggtaaatgtaagaggttatgcggagactgagcttgacatgttcgcttgactgttggatttttagatggggcatgtttattccattccttgcagcaaacccaattattatcatgcttcatttttacttctaactataaaatcagatgttttagctcgtctaactactaaatccctgtttgttttagtttattgtgagcttttgcacctcagctttgggactcgagcattaaaaggctttcagaagccaaatgtatacccttaaaatagtattaaagtatcaagtagttcttggagaaataaaattagagtttattttaatcgatgttttatttgtgagacatgtttcctttgaataaatatt

SEQ ID NO: 3621 - DNA, 1131 bp, Zea mays
  misc_feature (1)..(100): optimal_loci_168857_G1, chr4:223211262..223212392, Cluster 22
tattactggagtgtttgtgttgttagtcttctttaaaccatgtgcatctagcgtgatgcaaaaatcaagggtttttttgttgtcaagagagttgtgacttatgattatcttgatgcaataaattttcttttataaaaaaatgttccttagttttttttcctccttgatgggtcttcgtattagtgttttgtatcggtcaatttttttctacatttttccatcttaatataagtataagcaatcctcgttcgcgttcgagagaaaaaaaagcaaaggacagccagtattgtggcactagcagtggacagccgcaaattggaagatgggtgctgaagctgcaagacaattcgtgctaggggctctcacctctacagctgaagaacattcgtacttgaacacgaaggccctcatgccatatcgtattgttcagcttgtctgttcatctcatttgctaggagttggagaccgcagtagtgcagcgcgctggtgttgtaacagtacagctgtcatgttttgggttacactacaacttcatgttggttggactcatcaacgaaaatggaggctagtgccagcatatgttagactgaagctgtaggaccacgtgcaaacactaagctgcctcaacaattctgtaatcttgtacagtaacatctgatcaacgatcaattgtgcaggaaaccaagacatcgacaccaggaagcgttgatgcatcaaagatcacaccacttcttataaattaagtaaagcatgtacatgcacaggataggttatgactggtaagctgatcactgggtcatttaatttttttttttctacaaagttccagcagctacttaaatgcctcaattgccctaaatgcgctcttaattgaattcagtttctccacatcagcagacactcggtcttcaggtccaagagagaggttgcttctttttagcttaacgagtgagacaagacctttattcccttgtagtatttccttgcactttatcacttatcagctccaaaaaagagggcaaaatctctttcccccgacacgacatgagggcacattttttcaaagaaaaatgtgaaatgattgatactatgattagcctgtagtcaccaaggtacaaacaactcatttca

SEQ ID NO: 3622 - DNA, 1195 bp, Zea mays
  misc_feature (1)..(100): optimal_loci_173208_G1, chr5:4756285..4757479, Cluster 22
cacacacggtctttgtcaagcaaaatacgtgctctctttcaacttgtaacattcaaccctctgtttcgatatggatccaatgtggtgtcctaactttgatacctccacaacatcttaagacccctcctgctctaggacatgtcttctttgataatctttctctagtacatcatcagcgggaggatgttcttgctcatccccgtccacttaatctacaacctctatttctatatcccctccgtatccatatgatcatcggttgatgtccatcctcctaccactacgtctcctaccatcgacacacattctcatatcactaaagtccctaccattgatgctccttcttcgtagcatttttcttatcaataccctcatccatacgcgtacaattatccacatgacgatcctccttgtagatcttatggtgctcctccatatactaccccatatatatggtgctcttcctttagtttatttcctgtatggtgctcctccccatatgatgctcatcttcctttacgttctcctaaaggcaaggtagtgcccctaagtagccacaaacgatatattgtgcactgcgccactgttgagttccaacaacaaaatgaattaagaggaggacaaagaatagtaattagacatattttatgacttcgatacaatttttaggtcaatggaagttctttgagttcataaatttataggtttcgcgtaactactgcactccataaaccctgctaaaggcaacatcaagaagggatgggtccttctaggtccaaatatccgctacacaaaacttctctcctatactatgccactaccaaaggtataacccacaatatgactctaagaacatgataagaatggggttgttgagcttagcaattgaaatccgagtttaatgtagcctctcccctttaatgcactataaaagggagaaaagtaacagctaggggcattggaggatatcattccatgatatgatatgatcccaggttgaacacacccaagctaaccacaacatactcttgtgcataaggttgtgtagtaggaccattagactataacttccaccataaggttatgcacaacgaaccatgcatacagtcatgcaaaacattggtttgtactgtatattgtactatttatagagtaaagttcaaaatgagagatgggatggagatagccaaaccaa

SEQ ID NO: 3623 - DNA, 1131 bp, Zea mays
  misc_feature (1)..(100): optimal_loci_178230_G1, chr5:31952801..31953931, Cluster 22
  modified_base (477)..(477): a, c, g, or t
  misc_feature (477)..(576): n is a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
atgatacgtgtccacctgctaatgattatacggcttgcagatttcacctttttttttctcttcaacatatcgtgctctgggtagaaaaaaacgatggatcattgatcgcgaatggaaaaaagactctagagctacttttctatatatagccggctgtagagaattttttacatacatccgctgtgtcgtactgtcattgtcatctataaactactagtccaataatcgaacttgtgacaacatataatcatatttgatacttataaaaaataaatttaatatcaaaacgaatacatggtttatatatcagatattaatttgacaaaaatatcttaatcaaatggtcaagaaatgtataagttgaaaaggagtccgttctccttcagctaacgagatgatattatacgaggagcgttgttgttaacatttgctatcataagtaggctagctgggtttgtcacggctccatatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactgattgggagctagatccaagacataaaaaaaacacaagtgccaaaggaaactttgagacacgaacaccaggaggatcgtacactagcccaccaagctagcacctcgattcgtccctgctatgggcaatgtgcgggactcctgggtaaatggagaggttcacagagttgctactgtcaaactcctctcacggaagtgacactggaaaaatcaaattatagggtcgttacattcaacggaccagtcatcaaggtctacatattaggttatcatacaatagacataattaaaaagctttacctcacatatcgattacttcaaacaaaataggaaatataaggtataggatgaagccttaatctgggtatgatttttaataaatcattcaagtttcattgtcgcagggtggacataatcatcgcaaaagtagcgggaaagcagtcacgagaaaaatgcgttttccacacacacgcttggatgagtgacatgaccaatgactaggtttctgggcgcacctgcaactgcaacttcaggacttgacttgtatgtaca

SEQ ID NO: 3624 - DNA, 1228 bp, Zea mays
  misc_feature (1)..(100): optimal_loci_179731_G1, chr5:39942440..39943667, Cluster 22
aaaactgttgtatattcgtactctgttcgttgtacttgacagtgttaagtctttacatgtttttataacaattcaaattattttcacaacaattcaaaatattatgacaacaatttaaattattttcaatattctaaaattattttaaaaaagtttagaattttgaaaataattcaaattattgcaaaataatttgaattatcatatgtaaagtctaaaaataggggcaaaactatagttacacttaaaaatagaggtactgacgcaattgttccttgtctatttcttaagacttaacatcgtcattaagtataactaacggagtaggagcatacaacagttttgttttagaaatcagaggcaaaactatagttacactctaaatcaggcaatgacacaattgtttcttgtctctttattaaaacttaacacctttaattacaactaacggagtaggtgtgtacaacactttttttttgaaaaacaagggtaaaagcgcaaagtctaaaaaatatggacaaatatgcagttacggtccaaaacaggacactgtcacaattacctcatatattataatttatttaaactttattcttagcgtatatgtaaaaaatatactaatatctatgtcatcttttggttacataaaggtctctataaatatattttgactgtgccgttatttaaacttgtatctgcaattgtatttttttaaatgtattggcaaaaattaaagaaatttaacttgaaataaagcatccaccgttcgagtgctctatcatatcgctgggacttgggagtaagaaacgacttgtctctgttcacacccattcttctatgtaagactaggtgaatgccgtgcgttgctacggagtgaacatgttataataaaatatattgaaattcaaaaatacaaattgccatgaacacaacagcacagtcaatttcaggaatgagcacatatctttaggtgagaaacatcacaaataagacaaaagaaagcatgaagcatgtttctcgtgtcacttttatttaaattcaattcagatttgaagatagaaacttgaattctacaagaagaatgagtgaatgaccagacaatcattttttaggagacaaaaacacaagcaaaaacatattgagagatctcgatagtgccataatggcaagatattgtgcatgaacaatctccagaacacgaatttgttgctttgatttctctatcaat

SEQ ID NO: 3625 - DNA, 1021 bp, Zea mays
  misc_feature (1)..(100): optimal_loci_179997_G1, chr5:41791895..41792915, Cluster 22
taaaaagtagctacttcgggagtcatttcttgagatttaaagacccaaatagaaagtgcaatctttaaactatcaccatgtgtcaaattatgcatctcaatgttgtatgcacttagaatctcctccaataagtcctgaacagtatggcaaaggccaacagcgaagaagtctccaaagacaacacatttatccgctttaggtatcggatgtcccattcctcggtaaatgaacttgatctttaatgaagtttttatatgaataaaaggggcaagagttgcctcatccatcagggacttgccaaatctcaacgactcggtttttatcatgaataagttttgacttagagacttggacatattctaaaccatcctgaaaaacagatgaaggcacatagggaatatgctcaacactagacatctaacacaaaaataagcttcgatcaaaagcgattgttcaactttcttatatacccaaatttggtcgagctcaactattaaaaacttggaatcaaaactattcaccatctaacctccaacgacgaaccgcaagacttgggatggtgtgttttttttaatctttgttcgaaatcataatttcacggatagacgtccaaaggagaacttcactttggaggggttgttggtggtgatttgacattagacaaacgtagtccctgctgtttcggcatggatcaacaataattagtcttcctctaatttacttgatatatgttttgaggagcatcctgttagaagagaaaacaaagatatagcaaagacatacggtccacttcgcctgagtgtgcgaagactcaacgtggagatcaaggtcggttgcctctcgtcgctgagatgaccaaatgaagctactgctagacatacttcgtcttcgttgagaggcaaagtcttgaaaaattaattaacgaagatagaggttgaatcactcctggacgatatggagcctgtgtagtagtaaagattatgtggcgagataggtcctaaaatatatgtttatatttaaa

SEQ ID NO: 3626 - DNA, 1144 bp, Zea mays
  misc_feature (1)..(100): optimal_loci_183198_G1, chr5:62694901..62696044, Cluster 22
caggtacattgcttttctctcgatgtcccgccaaacaatcagataagctaagggcaactccatgaggctactaaaaatgttcctcaaaacatgtgataagggctgttgtaaattgtttttccataaaacaaaactacacgtacaataggctgctaaaagaactaatccccaaatttttttgaacaaccatttgggccacactaaactaattgggccacaacattgtgttgttcctgtacctcaacatgacaagactttctgcagtagcagcctgcagctcattcacacttgtatcaccattgatagacttggcaaataaatgattgtttaccattctgaataaaacatgtagcaggttcaaaggatatagaatttctaacaaaaacatagaatttctaccaaactaagaatgtctaacaaactgataatttctaaatggacagtaacaaagctttattttcagcaacataacaacttgtgtaactggacaacaacaaagcttcatttgcaagaacagaactgcctgtgtacctggacaacaataaagcttcatttgtaactgaacaacaacaaagcttgacgcatattcatagtgctacactattttttgctacatttatctggcatcatgaaacatggttgttttttggtcaccacacaaatgtctttatcctacttgcgtatgacaattttgatcaatctatttatgttctccttttgagcatcatgtatacttctaccatgcatatctaattattatcaattttaactttcaaggtactaccagttcatgaggtgggaacctttgaatgctcattacaaattttaactttcaaggtgacaacagagagaaaatgaaactaaaaatgctgccataaatcttaagcagtttgatctggttaaacacaagagaattaaacaacacttagcagcaacccctaccaattgaaaattccatatacatgacacgagcagtaccaagcttcattactccagatttcctttttagcaaaagcaacagtaatcaaaagagatatcaaactcaaaataatagtactatcagattaacatagattaagacaacattaaacaaactccttcataagtatgtagcaaggtatgaacattaaccatattgtgcacc

SEQ ID NO: 3627 - DNA, 1191 bp, Zea mays
  misc_feature (1)..(100): optimal_loci_184969_G1, chr5:76730639..76731829, Cluster 22
agataggttcgaaacaccgacactccctaacactacatggtttttaggcaaaggtaaaagttcaaggcataaaaggcaaaggtataatttaagatatttttattttactggttaagacataataaagtgtgtaatcttgtttagaatagatggatgtactactaagacaaagttatggttcatttgatagagctctgctccatgattctttagctttgagagttgattctccaatagagtgattccaaacaattctctagtagaagtgaatatatgtgatgaaattgtttaataaattttctatgaagtgattcccgaggggttgaagagcgggtagcatattaggaacgacagaaagcagaggttttttttggctcgtgctctctagtaaaatagatactagattcactctgctcctaccatggaggagttcagttttttgccatttggctgccaaaaaacctcttaaattagataactcaattatctagtgacattaggtttgaattcatatgcattgcatatggcttggagtgtaaagtcagttaacacatgaacccctagtcggccattagaaagtgcatacactttttagtgttaccacaataataacgcttacctcgacaacaatgtgtcaaattttatcgaagaggttggtctaagtagaaccgtgttccaccttaagtaccctaagggcacgagagtgagtagacctcctttaggcacgaaattgtaagagccaatatggaattttggctaagatggtccccgatggtctactaagatatattctatttttattgacaactattctacttgaaatcataagttggacttagatacaaatcatattagtttgaaacagcaagtgtatcagactgaacaagcatattcaagcaccatccgaagattttttagttgcaagataacatttcaactcttttaactatgtacggaggcacaaacatctcagagtatatcatattcaagaccgaagactagattttcaaatgaagcttacactcctggaagccttgagctcgctatgggatatatctagtgtccatgaatatgtacaatgttcaagtgatgcatgttggacctactaacacatggttaggtgggctcaaacactcggggacaaacgaaactttggtgcacgacaggacgttagctgggaactgtagcatc

SEQ ID NO: 3628 - DNA, 1069 bp, Zea mays
  misc_feature (1)..(100): optimal_loci_186956_G1, chr5:88999498..89000566, Cluster 22
tgggccggagttgcggcccgtgggcgtcgggcctagcggaggtgtggttttggaaacatggagggtgcatcgggtcaatttgaaatatatgtgagaagttatttgtaaaaatatgacacggaacgaccattaaaattgttgctttgatatagtagagatagaaatagagaattctaccatttgtgaacatcctaatttttaattagagaagatttttaatacatgtgtatattgaaatgtcaagtgtgcactcggattcttctgcctctagcttcaccctgtttgtgtattacgtggcggctcgaatagacagcagccgtctatatcactgtgatgcccagatttaattaagcgatggcccatgcccccacatgtcgcgcgcgattggagaccggcaaacagttgagcagatcatgggcattggacaggcgattatttttagtccacgtgcaacaacgacgcgggccgggatcagagagattgcttggaacggcaccggataatatacctctagggctagtttggttgagtaaaaatgatctaattttatcctcaatgggaatctaggaggagaactagctagcccctagttttagaataatgtcgacgtgacgtaaattcgaccatgtttatagaaatattaggaacatatatcttcaaataagtttgttgcaaaaatatattgtctatgtcagacctaagtaacgcaggcacacatgcatacctgtgtcaggcctaccattgctcacaacctatgattggttagaaagggtaagtacattttcgaccttctggcgggttgtatgttagttcgattgttaaccgtaaactataaaagtgagtagtagacacccctcaacagtcgaaccggatagatttagtttgtattttccagaaataatataaattcagtttgatctataaaagtattaattaattttctaaatcaaaatatatagtatgagttcttttttttgaatgacacatatatatagatactctgtttagaattagttagatcttgtctagttaaaaaataatgaacacgactacagtaataaaacaaagt

SEQ ID NO: 3629 - DNA, 1049 bp, Zea mays
  misc_feature (1)..(100): optimal_loci_202819_G1, chr5:189886618..189887666, Cluster 22
tttgacacttgctcagaggctcagagccacaaattctccattgtgttccagctcttgaaggctactatagcaaatgcagcattaatagtttcagtttgaaattgctgtacacgtgttacaggaaccttttgagcgtcggtgaaattagtcagtagactacctgggggaggtcaacataattcttatcctctaggccattatctggaattggaaatgacacaatttcctccattgcagtatattctgctgctgaaagttctttgagtttccgcctggtaacacacccctcccccgggctccattatacaactagaaaacctacataattccacagtgtctctgatgagggaactggccgtgcaaaattaattaggtatccgatcaaacgcgcgccacatgagccctgaaaaacgctctgatgttaaatgtgtgtatgattaaagtcagcgacgtgcttgtactccaccttttctgcttcagctacgtgtagatcgttgactgactatatatcatctcatcagttgcttcaaccactagattattgccggctaaaaatgcccctccaagctttcgcgtgtagtcttgcggtaaatattctaacacttctttctggtacatttcataaatatatctgaatttaaagtaatttcaagcaacacacttatataatcaaatcagtacgaataaattattattattattactactactattattattatataatcaattagtacgaataatcgtcttgtgccagtacaaaatagattttgtcagatgtgtgattttgttctaaggaaaatttcactctcagagccgaaaactgcagaacgtaatgtctatataaattgcaacaacctaaaactataattttagtatgaatatatacaataatcgttgcctaaaacgaagcaaaaatctagacagctaaaatttaacgagtcaatattctaaacgattgctgcagtttgttgttttttttttcaataaacttttgcgtggtcaaattccttccgatatcacatgcacgtgacacgtgtacatgagca

SEQ ID NO: 3630 - DNA, 1295 bp, Zea mays
  misc_feature (1)..(100): optimal_loci_204904_G1, chr5:201609443..201610737, Cluster 22
cagcagagcacagtcaacgacatgcatagcttggatatacatgcatatgctacacggccaggcttttagcttgcggccggacagacacggtgcaccacccaagcatctcatgcgataggacaggagatgaagaaaagcggccggctccgatgcccattgaccacctttttctcccttcgcaacacacacgcgtggagtccatgcggctagctagctagcgacccacctcaggggacgcaccaatggctagctattacgcagcgctatcagctctgaaggaatataccatgcaaaattcagtaaagttgcgatgctacaagagcgcattttacaacaaacacatactcgtatccattttgctatagctaccctaaaaattgatgaagacgttattctttcagatacgtggacaagacttggcttccgttaaagtcacacaattatatttgttcgcacaacaacaaacatcatttattacttacaagttttggattattaaacatgcacactaatatttagtggaatagaaaacattcagtttatacttgggatttttatatgtgaaatatattcccaaaatataagtaccacagaaaaattacatgatcaggtttcatagattaaccattacaataaaaacaaagcttaattctgattaagcatgtgggagcaagataaaactagagatcaatattctgtgtaaacaaatggtcatattaagtattcattgggcataacaacgtcatgcaaacctagataaatcaacaactcaatcacacgtgcactaatgaagctgaaatttttttaccatagattaagtatcacatgaatagcctccataaaacttccatgacatttggagcacgtgaataacagatatgaatttagccctataaagcataggcaaacggcaaaccatctacagccaaaaaaaatactaaaatatgccatattatataaccaatgtatcgatatactcacaaggagtttagccaaactgatttttttccccattttatgatatactcacaaggagtttatttactatgagtttaacaagtttcggtaggtttatttataaaagaaaaagaaaaacattgttatcattcatatattacagattttgcattgtgaactcaaggtttctaatcccttttcgaccttcttcctcaacctaagaagccctgcggtggcaggctaggcgcctcggcccggggacccgaggcatcctggccacgttggcatgcgacccggtcgcatgtaggccggcggcagtcgctcggtggcgccatgcg

SEQ ID NO: 3631 - DNA, 1050 bp, Zea mays
  misc_feature (1)..(100): optimal_loci_205043_G1, chr5:202391124..202392173, Cluster 22
tcaatttatgttatctggatgtcatttttgacagagaagcatctaataataaggatgctacactgctactgaaaaaactggccattatattgcatgtaaacaattgcagaaaatacattatagtcagcgaattttatattgggttaaatttcatctgatatactaatcacgagaaagggcgacatatagcttcgtgaatgagactatattgttggcagtttgaaattaaccaacgcacaccaattcaattagaatacagtttcgtcatgtgtttaggatatcttattaagaaacatacttatattatgtccaacattttacatattctatctccatatttaaactctattatacaaataatatagtctacagtataaaacaatattttaatgaccatatagaactcctcgagacggtctaaatttgcatcttggagcaagagcagtccacctcaatacctcatacaacctagctaatagtatatatagtcaataacgggttacataaatctttatagcctctctcagtatagttatatagtagttagctctttatcgtcaatatgtagctcgtttatctatcttataaagtttttattttttatttaagttgccttcttctctttcatctccaccactctaggcaccctaggctatggctagcaaatcgtgtatatagtcgtgcaaaacactgttttgtactatagaatatttatagatcaagtggacttgaaatgtaagatgagtaagctaacagagacaaccttagctcttaggctatctccagtggcctcactatctcactctacatttcaaactccactttacatacaatgcttttagatcgtctccaacagtttattacctatatggtcatccaaaacaatgttttgcattgtaaactataagtggagtttaaatatgaggatgtagataggtaagctactggagatgaataaacttacagtgcaaaacaatgttacatacactcgtatacacgctattgcttgagatggcctaatgcatgcatgaggaggtagagaaagcgcac

SEQ ID NO: 3632 - DNA, 1282 bp, Zea mays
  misc_feature (1)..(100): optimal_loci_205563_G1, chr5:205509404..205510685, Cluster 22
tgatgatcgttccaacccggttgaagatgagatccggtgtcattaaagacagtacatgtgacagtgtagatcaacttgacatgcagacgcgtgatcgctgctaaaaaacttggttcgtcctaacacgtgttggttctttagtgtagcgagctttcggatacagtactcttcacgccgtcgttgtaatgatggcattagggatggaggagtttgaggtctcgtagcagtagcaccgaggattcacttgtgtaaaaccacaatggattggttttcttttttacatttagggttgatttggtggccgaggatcccgagggaaagaaattctcttgctattaaaaattgtgaactacaaggggattttttcccatggatcccctttggatcaccctctttattatatacgagatgcaaaaacataagaaagtaagaaattgtcttgattacaatctccatgacaagacaaatcagccattaagtaaagaacgccctctttattatatacgagatgcaaaaacataagaaagtaagaaactgtcttgattacaatctccatgacaagacaaattattgtaggtaagtgtaaaaaaaataggtgtccaactgacgctaaaatctcaagtcatgtgaataatcatgcaaaaaaaaacacgaagcaaacgaacgtacgtgtacgtccggctttaacttaatccatgtcatgttttatttcaagaaaacaagacaaaagatatttatgttgactttatcctctatatttttacgtgagcctaaaacatcaccatttttacttccactatgcacgagtaaatatttgagatttatttcgcatttttatgataaaggaacactggaccatgtccaaaaaacttcaacaaaatcttgaatggaaatacaagtgactgtgtggaacaaaatcttgaaatggaaatacaagcgagcttaggtactgtttggtttacatatttgtaatataataggtaacaaataacgttaaatcatgtttgtttaagtccaaccgtaatcgaataccacactagaaaattataccagcatattcaaacttgttaccactggtaatcgaatgcaacccgttatcgttaccatttacgttacattttgttaaccaaacaacaccttaatccatccggtttcgtgctcttgtagtgcaaagaccaaagagagacgaacaacctgcattgtaaaaatataaagttacatttctcgttagctaattaaagctagtaccagtagagttaaaagtcatgggtctgaattctag

SEQ ID NO: 3633 - DNA, 1247 bp, Zea mays
  misc_feature (1)..(100): optimal_loci_205574_G1, chr5:205531075..205532321, Cluster 22
ctctttccgctttgttctaatcgatctatgacgaccaagaaacaagcggcatagtcacacgtactattgaatattgattgattgattgatagtacaaaatgtttttagatgactcgcggactccgacagtctagtcgacacgatgacattatacacctatatactgacggaaagaaattcaggacagttggcaagtctttgttgctgaatccgtcttcgatgacctgtgcgcgcggcttcaaactttgacggtgaaaattaggtgctcaagtgagggtgacagcagggtctggctggtcatgtactcgatccagtatgtaccatctggtggcaatataaaagctttgacggtggaagaaaaaaactacatgatcgctgagtggccaaggttaatataaaagcttaataaggaaaagaaggtactaattatacatagatttcttgtgataatctaatggggcttagattaaaggaagagatccatattactcccttcacatatggacaatatccatatgcctaaagattttttagttcgttttacctctccaactatttgaattggttcaatctatcccttaataaaatgtcttttttatttctttgtgacaagctaagtctccaattcaatttttgatggttactagctaataatgacataatttagcctaaaaatatattatgaatcatcataattattttgatacggtatagatcaggtaagataatgattttaatggtataaaactaaatattttctgaggtgattgaggacatcataacttatattaaaagtatgttaagaatttttcatcgttattgcatatttagttttgtaccactaaagttattgtcttatctgatctttaacatatcaaaataattataaaagttataatagattttttagggtaagttatgtcattagctactaacaaacaaaattttgaactgaaaactcagtttgcatatagacaaataaaaaaggcaaattttgtcaaggggtaatttgaaccaactcaaataggtggacaggaaaatgaactgaaaatactttaggaggtcatatggacatcattcataggtgagaggagtaatatatatggacttcttccaaatatatataaagaaccaaggtatcctatgtgcaactaagactttgattaagcattgttatctctatcacaacgagttatgcaacctaggttacaaaaccaagctgctagcctatgactaagctaggaaga

SEQ ID NO: 3634 - DNA, 1139 bp, Zea mays
  misc_feature (1)..(100): optimal_loci_210421_G1, chr6:15489011..15490149, Cluster 22
cccagtttcctgcagcaccaatattgttatttttcttacaaaactaacataaattcacacagatatcatatacagtacatacatattcaaatagcctatattagcacatgtatatcacatccatatcgattgtctcagtttcaaacacatttagtctagaaatctcaagcacacataagtatcaagttcatacacaatctcacataagtccaaatccacacaaactcacaaacgtccaagtcgatacataaacaagcaccggaggtccagagcaatccactacgatggaggagtattggatcctcctcccgagcccgccaaaaagccgttgacgtccacatcagggttagcattatcatctcgagcatgggagctggtagaaccctgcaaattttttaaagccatcaatagtcatgcagatttcacactatgatgcatcggtacatttgttaatctatctatgtactatctattacaacatgtttgaataatgttgtttcagctggttctgaagatgagtagaatgtttatgccttgcatggtttatcagttttattttgcaacttaatgtttgagtttgtggagcaatggctcaaaccattttgcaagtactgtcaaactcatttgttcaagcacatttctctgattccggtgatgtttatttgttttttttcccaaaatctgctaaatttctgtcaatagttagcagcaacactggaggtgactaccttaacaggcctcaagttctaccttaacaggcatatcacttgtccctgcatgccccatagaccatggattgctaaggtgactactggaggcccccatgtcatctacaaatatgtgcttagcccttttaacccgtgtactgttgctgccatcgtcataatagcttacagcaaagtatgagggctggtatgaagaataatcagtttctgcttcgcctagaaagcagaaagaatactaaactagaaatgtattcattgtatttttcatcatgcaagctactgcactaatgttagtctactgaatattgtagtcttacctatatctattagtcatatattcaattttattgatgctaataaaataatactatacattatgtagccataaagtgactttttttggtgcactcattc

SEQ ID NO: 3635 - DNA, 1120 bp, Zea mays
  misc_feature (1)..(100): optimal_loci_220931_G1, chr6:85604694..85605813, Cluster 22
ttgtgcgctcttgaggcagcaaagaattgcagtcaatcgcagcttcttgacatctctgattctgtctgtaggaacgcggcccaagtgggttaacatcaagtcggtaaatgatcttaagacaaagttgtcttggttctactggttggcattttcgagaagagcaagagggacctcttatgctttgctggatcgattttcctatatatcttcagtttgcctctacctactttccatacctgaaataagagtgtttgtatataggtgataggtctgttctgttgctgctcaatgcctcaggttgtgttcgtgtgtagtaaatagttaggaagtgtggtgattttccaggtactcttgtatggctaggcagtttcagttaggcacaaccacactacatccagttagctaggcagtttccaggtactcaatagctgatattctcttgagtgcaggtgcttttgaagggacattcactgcttcataaccgaaatactgactggttaactagtttttgttagaaagaaatgcacacacattgatgtcttctggtatgttttatgaacagatttgaagcgactaatcatatctttccctttttctcatccccatatttggtgtatggaaatgtttgtccattgtccctctttgataggctgttattgttatttaagcgcgttctcctgttgaacccttgtcaataatatgacagtgatatggatactatattttaagcttttgaatcaactgaaacacatgaattcagtggatatgtaatcattgtcatgtattaagtgataaacttgtgactttatatattcaagacaatatatgaagcatttctgagctgatgttcttactataaataaaatcaaggagcatagattgtgtactatgtaatattatttttaacagtttgatggggaactacaactactacaattgatgcttcagctctacgccttctttcaaaccaaacgttcacacgtatcttgtgtatgtgggtatcaaatgcttggtgtatgctacatactcttttccatatgcagtgaggagcaacaaaattagaagccccaacttgcttttggttcctctgcccattgttttgatagttcatggttacggt

SEQ ID NO: 3636 - DNA, 1170 bp, Zea mays
  misc_feature (1)..(100): optimal_loci_222591_G1, chr6:96388661..96389830, Cluster 22
ctcaactatgttcatccaagttcatgtttccgtcgtgcacttggaaaaccagatataggtactcctccaacttcagatgtttccatcctatatacactcaaaaccacgtcggttttatctacgtatagatgtgtacactatactatcatgttcaactaagatagcatgtaagtagaaaattatagatcgtcattattagatgtaccacagccagaacatgatgatatagtgaaagtagtagtacatcctcacgtactaccaatgacaacacgttcacatgtgctcctcaagtttatcgtgaacacctctacaatatccacacatgcagaggtaaaacatggtggagtcatgtgctagcaccgtgcacgtggcgagagaaacgacaacatcgtcttggacgcccacaatactaggaatagaggtgatggtggctaagacaatgctctctatcccgctagtctcttcatataggcttttaccataaaatcacattagcgttttaagggtcattattgcattttagatatatgttcaaataatattgtccattggattgagtaagtaagtgagaaaggattattcagcgatctgaattgttgctttcattgtgtattaagtgtgggtgcaacttgtttgttggatttagtgaggttatgggtgtgaattttgcaaagtttaaactagtggattatacaatgatatagattactccttttgttaggagagttactatccattattcctacaccaatcagcccaactggcacaaccaaactcaattcataccatggcatgttgtggtgcgacatgcatggcacgagcacatcacgtcatggcttcactcgactcgactcacgacaccatggttcatctaggctcggtggcagaggacatgcatgtggcatgcccttagcttctctcttattctcaatagatgcacaaagttggtgcatttgatatattaatgaaagatggattaacaagaagccacttcaccaaacaaaatcaagggcaagtagtcatataattaagaggagtggagaagatgatttgcaacttgaatgcctatggtgtgcccattacaattgaagacaccatattcaccaaccaaagaagaaatcaaagaaaaagtggttcctttggctgcagtaaaaagggcacttatgaagg

SEQ ID NO: 3637 - DNA, 1045 bp, Zea mays
  misc_feature (1)..(100): optimal_loci_224717_G1, chr6:107303480..107304524, Cluster 22
gtatcgtccgacgtccagtcgtcggcgctgccctgtccagtatgacgtccgcctcagcttgcctcaccactctgaatgagggggttggtctatctttgggttggcaaacgagtttctgctaaagtgaagcagaagttggtgagaattcagaagaataatagagtgacaaatgcattgaatggtaccaaagctgcacttggaaaagtcattgtaccaggtaatgtgtcatctaaggttcatgttgaattttttttatgttatttgctcctaatgtttccctgttgcattagtactttttattggttactcctattcaattacttgatgcttatggaatttgacactgcatatatttccagtcaattattgatgcttatagaatttgatgtccataagataactgttctgattaagtttgcaattgcacatggatttgccaagttaacagaatgcatcaaattttatgcattgactacaggggaaagaagcgtgcgcgcgttgcttgctctgcctagaacaacaatgcactctccctctacagccatgtcaaaattgaagattacataaacacatagattgcttcatcagcatctcttacccaccaacaaacgataaagactaggtgagtaaatacatgttcgacacatacctcccccctccccaattcaccaaagctataagcccatactgtcatacatttacattgtattatttgcctttgtatttttccacaagaaacaaacttcctcaaacatggatgaaagtggcagtgaggaatatctgcaccatcatttgaatcaccctcaaaaaggtcttgcaatagtgaccaagtcttcttaacaccaccttttacaaacttctacccttattttttatatatataggatgaaacaacagatgcaaaaacatgatgcataactactccctccaaaatattataaaattcgatgcatgacctacacatgttatatagctccaaaattttgtcaggaagtctcaaacttttgtctaaatattttaacagttaccgttttatataatttta

SEQ ID NO: 3638 - DNA, 1214 bp, Zea mays
  misc_feature (1)..(100): optimal_loci_224895_G1, chr6:108309169..108310382, Cluster 22
taaaaaattgtcttgtaatttaagctttctcatcatttagatatttattatcctttatatatttcaaatgttggctcttatcgccttccttggttgtggcatgcattcacatgcactatattagtgaggatatgggttggcatggaagctaatgcttttgcgcttccgcaaaccgtggccgccacaaactaagaaaggatatgatcttcctattgtcgccttagtgactagaaatcacccaacctcctcgtcgacaatggcgcacgtggatcctaatacttatacttcattggtagccgacattcctcactaaaggtcccaatgcgcaaggaggaggtgaaacaaaccgaggaggaactccactactagaacaatctatgactccacatactattgcaacaagtctccacctcaactccaaaggtatgactccccatccgcttcctccttttgctctttcactagtgcacaagttaagtacctattactatatactctagaaccggaacgtgttctagaggaattagctagttcctaaatgtaagaaagtggtctatgaatgtatcaaaacaatattagcatacacaatacatataatatattcctagatagagttgaacaactatgctctattggtcgcaataggcaagagtgtaacataagggtaagggaccaacattgagtagtaggagtcctctaccgagaagaagagcatgataaagaagctctgcaaggccagcgagaagataatcaatcaaaattgagttgttggatctgtccatcgtcaaaatggatgatgacataaaaaggacccacatgttggctgtaaatgaattgatcaaataattaaaactagagaggaaaaaatgagaaagtggtggtggaggaggattatttttttgtatgaactatgtaattttaattatttttttgcattttatttactttgtttgaattatgagtttttgtttaaattacgtgttcgatgagattttttcctaaacaaaatggcgtatttcattttaaacaagaatatgtaaaaagaaagctaatgtggtgttaaggtggttataggctgacggtaaagcttatacactggaacactgtgatagataaggaacaatgacaataaatagcatggtcggtgatatgatctgtatggctagatggacgagcacaagccacttggtatgggtccaatttagacatgacct

SEQ ID NO: 3639 - DNA, 1191 bp, Zea mays
  misc_feature (1)..(100): optimal_loci_226052_G1, chr6:114083818..114085008, Cluster 22
ttgtgattttacccctatgtttcgaaaacgaagctgctgtttgtcccccctcttaacatcattagtgaaaattagaattaatgattaaaaattaagaaaacaaggggtaaaatcacaatagcatgtgagagaaacgcataatcataattaaacctaaaaataatgttgattttttaaggttaattgtgattatacccttctcccaccttaaaattgtgattttacctcttcttttttaaattttaatcattaattttgattttaactaattgtattaagggagagtggcaaacagtggctttgctttcaaaacagaggggtaaaatcacaaagttagaaaacgaggtgtaaatttataattgcaaggtcagagaaagatataatcacaattgtcccttgtcatcttacccctctgtttcgaaaacgaagatcattagtgaaaatcagaattaatgattaaaaaattaaaaagagaggggtaaaatcacaattgcaaggggagagctgagagaaacgtataagcacaattaatcctaaaaataatgttgaaattttagggttaattatgattgtacccttctctcgtcttggaattgtgatttttcctcttattttttatttgtttaatcattaattttgattttcacttgcggtgttaaggggagaggcaaatgatggcttaatttttaaaacagatgggtaaaatcacaaagttgaaaaacaagagataaaattacaattgcaaggttagagaagagtataattacaattgtcgtaacaaaaggtgtatcattgttttataatgggatgtacatgaattgagacagttcgcgcatggcgtgtaggacaagatgtttctcaaccgcttgctcgtacgagatcacacgatcattaagttctcgtaaacttgtcatatgaagagcatatgtccaggtctttattaaatcactctaaattataatttattatttagagagctatttgaataaaattagttctctgtatcttttttattctctaagagcaaaggctcttgacattgttcctaatgtagaggaatatgtacttggttcaaagataccttccaatagcctctttaattggatttctaaatataaacatcttctattatacatttattgctagtcaaagatggagaatcgagatggtcctctagtgtgtttggttgga

SEQ ID NO: 3640 - DNA, 1237 bp, Zea mays
  misc_feature (1)..(100): optimal_loci_226257_G1, chr6:115559670..115560906, Cluster 22
  modified_base (483)..(483): a, c, g, or t
  misc_feature (483)..(582): n is a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
tcttgttcgtcgattcaggttcatcagacttccttaagtttaaattatatatataacgtaggataaattttgttttaataaatcataaaatatatgttttctattaattaggtagatgtgaatgtagagtcaacaattaagattcaaatattcacttatacataattttaccttatttttttacataaactctcttattaaagtagtagagaaaagattgcaggagtgcgggttgattctaaagatatgtagttttttttaaaaaatattgacgcgggacaatcattgaaactattgctttaatagtagaaatgcagatagagagcagagaagtaggtcaattaaaaaatttagcaatatttgtgtattgattatcaagatgtatttattataacaatactagttctacatcgtaaatattaatattttttcatacacttagttagttatcaatacaattctggtctatttatactagtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctccccgaccggatgaatcatgctttgattcgttcgtgaaaatcgactcaataacatattcaatggcttttaaaaatcgttaatcatgatcgaagtgactgaattgttagatattggtgagaatttgtaaagtttatttttctagtgtgtaccttgaagttgaggtggtccccgattattaagggtcgagtcctcttcgaaattaaagagaatcaagagaaaaattagtttattttcttctaaatccctttcaactgtgatgtgtattgtattttcatttatgttttcttttcatatagtattatctaagggttagacaaattttagttgtcgcaaagtcaaacttaaaacaccagctttagtttcttaactggtaatgttgcacacattccttgaaaaaatgaacatgggcgtatatcttctaattccattggaccatttagagcatgattatgttagctccgtgttgttattatattatttacaaacaaaataatcgttgaatcataatcacgcacatacataatgcatcattgtattgatatcaggttcatcgtgcccttattatatttgggaaagcttgttgaagctaacttgctatagatgtgtaatcttcgtatatcgtccgagcgcttcgttaatttcaaaaaaat

SEQ ID NO: 3641 - DNA, 1137 bp, Zea mays
  misc_feature (1)..(100): optimal_loci_227691_G1, chr6:123430674..123431810, Cluster 22
tcctatgacaccatggacagaaggggagttttgatcatactttgttcatggtaatttttatgggaggttctaccaaatttgttcgagaaaattctctatatgccattgcaattttgcccagtaccttatttgctatcacaaatatccaaatcccttatgtgtcactcggttacaatttgttttccttccatgctatcatcagtggcacaaaagagtaagaaatttgcatctcctaatcccacctatgtcattagcattggcatggaatggtaagaaattgcatagcatagaagggattaggatatttgatggcaaataaggtagtgggcaaaattgcaatggcatgcagggaattgccccaagacaacattacatgcagtatatactaatataataccttagaacatcaagttagtgcatattgtctagttccctatacctttttatatttaaatgttccatctaatttgctatccatgtttataattattcaactttcactagatactacttataattatgatggaacatggcattacgcacgtgctagactcaatgcgaatgtcattatcatactaccaatagaccatggacattcttaacgagtaattgatgtattccaacttcactatctgaccattgcttttattcagtcatggaccaaacatcactcgttttcatgtgcaggacaaggagtatcctctgcaaaaacgatcctagtctaaaagaaaaacttatgctcggaacaaactttttggctatgttgtcggctaataatactcaataataccaaaaaaggcaaggcagatatttttatgtatattacctttatgaattcattcacatgtttattggtaacaagacagtggataaaaaataacgaagtacttatgaaaatatgcaccatatattttgttgccaataatattatccaaagtttctggtttgctatattaattatttggcaaatgacatctaatgaaaatgaagaaagaacttctcccattgaatgcgatcacggcaattcaaggccaacttgtagagttgttatataactaggttgtatcgaaagatggaaagttccactacgacaaaagaagtcttccatgagaattccaagttatatgaataaaaata

SEQ ID NO: 3642 - DNA, 1167 bp, Zea mays
  misc_feature (1)..(100): optimal_loci_228729_G1, chr6:128732559..128733725, Cluster 22
gttagagaacttgatgactgaatagacaatagataacagggaaaacattcctgtttctaccactagctgattattaaattttcgtatcacttatttcaaaatcattcatttgaaatgtctcttcctggttgccttcatcccattgctagtgattgagggggtacatcctgcaaaaccggagaatactgctattgacggtttgctctttttgtccagagattcgtagtccttacttttctccttagcaagatgtaatcatatccgtctatagtatttaaagaagaaacacttgttgtgacaaatagcattttatttaagtaatttaccactaactgaaaataaaaggtatgacaaagggaaggatggattttctgttgatgtcaagcttcctgttaagaatgtattatctagagaattacaccgtacttcgattatgatacaatgcattgcatattactcaagatttccaagaaacttatatacctcttgactgtttagttttgtagatgtacttttataaaatagttgagtttactatgagtagatctgatacatccctttttaaagaagctttagtgagcatggcaaaagattttggtcttcagcctttgttccatatttttcctataattgatcacagttctattcttagcaagcttaaagctaaacgttaggggatctagcaacagtatgtcaattatagatgcctgtattacggcctggatatcatctttaatattcagctcacctgagcatttctcccagattttcgtttcacttttatttttgaaatcaagttgttgatagaagcatttagctctgccttggcattcctttctgctatggcggatgccctagatccaagagattcatcactactactttcctttacaaagaaggaagcatcaagaacaggcaatttgaagttctcaagagggaggattactctagcagagtaggcactaaaggatccctcctaaactttagtactttaatcaccatgaggtgactaaatttacagttttctctttctcttctctactactataaaagaccagtttctaccatcgtcgtgtgttaacacttttaccaaaaaaccatattttttgtaatcaaccgcggtccaatcctccacgcaagtggaagtgagaaaatacatagaatgta

SEQ ID NO: 3643 - DNA, 1068 bp, Zea mays
  misc_feature (1)..(100): optimal_loci_229012_G1, chr6:129905090..129906157, Cluster 22
taatttttttttgctttgttatatttgaaccaatgcgaaattttaattgaagaatatcataaatgttgacgctaagtcaaattaaaagttatgttttgttataattatgttcaaatgtattttagaattagagtaaagtttaagcattatacatatttaatataattcaatattgaattttacatgcatatggatttaaagtttaattattcatgaagcatcaccatctaagatatctaacaccctaggtgttatctctggactagagccactaaatgactccaaatatctctcttggagggagaagatagatatgacattggttttgatagaaatagactataccattaacaatcctaagccttgtagccctatactagcaattgaaggaacaaccaaggtggctgataatgctgccttgacgatagcatatgatctcaaacgtgtaaaatgagagagatcaaataagaaagatatgatagtcatcggaatatttatcatagagtccattaggggagtaatcccataatttctaagtgccaccgagtacctcgataagattcaatagcaacttactagttcctcaaagacatatgatgtgactattattaaaaactgctacttaaagtatgctatcttagaataagagagcaaatccgtttgtggattccgggaggggtaaagcatttagccaagttgttgtaagtttggggttttttggagtaggacaattgtgccaccataatttgtgtttcctttcctagtgtggtggttttttttgtactccagcccttttaagcgctcatcttcttatttaatataacatgcaattcttgccagtataaaaaaacatttacgccaatgaaggctctgtagccttctcaggcttcatctgtgatgatacttacctttcaagtcttgatgtgccccatgactatacctacatctcatcaacttaaacatatgcgtcccttaggctattcttaaaactgagggctgatctgttgactaggaagttcatttcctcctcaatcccctgcactacccctctgacccccttgtcatcaa

SEQ ID NO: 3644 - DNA, 1320 bp, Zea mays
  misc_feature (1)..(100): optimal_loci_233119_G1, chr6:148774502..148775821, Cluster 22
cggtcatgatccctggagggttttaactatggtgaggcaggttcgcatatcaggtcgtcaacaagctagctagcttgatatacgtacactatatggcgagtttagtgggacctgtaccaggtggctaattaatctttggtacgcaccagtaaacaccacccaagtctttttcaggcttcaatgcttcagagacgaacgacggaacgagcgacattgcaggcaggaactgcgctgaagcagctggcagtactatcatctggctaccactgcaggagctgccccatgcatgcgttgcatgcacatttactccatgtctccatatgcatggtgcgaaaaaaaaacggcagtgccctgctactacactcgtttcaatccaatccttgggcgattggcacgacggcttgggcagagaaaggaggaaaaactgcagtgcagcgccctccgtgcattttttgccctgagaccgaccgactcgaccgggcaatgcggctgcgtgatggtctgatgcgtggtgtctacggctccgggcacgtattgtcaccgtaccgttgagtggccaagtcatgccatatatatatagtcggttgggtaactgtaaactccaggataccatcgcacactgacgcattttgagctccaccagcacaagccggactggagatgagatgactgctagctgccgatgggagataggtcaagctggcgccatgggcacttgtagattttacaacgtagctcgaattgtttttgctaccctgtctttccgatatattataatttgccatcaataatattgatcccttctcattctagtatttaagttatccgcactcatactactctaaattcttaaccttaaaaagaatattcagttattagtatatgtcgtggctctgtctctgtctgtgcacttatgccttacgcaaacatgcatccacacgtaaattgcaatatatcctgctgtgcacctatggtatattttagttttttcaagtagcattcatgtggtgctctttgataattttaggacgttttctcactatcttttctctgttacttttgattactatttttttattttgttttatcccttgtagttttttttatatttcatgaggtgctacaagtatacttttatctaaaatattatgcccgtgagggtagaatattttttccttagatttaaatactttaatatagtttataatagtataaatatataggtaatatcaaacatctaaatggtgtagagttgcgaaatgatttttttcttaatcttctagtctaatgttcaacctctcctacatatcatttctgttc

SEQ ID NO: 3645 - DNA, 1281 bp, Zea mays
  misc_feature (1)..(100): optimal_loci_233766_G1, chr6:151779747..151781027, Cluster 22
agtaggtgacacaatattatatactcataaatccatattattagtttgtaaccataatttaacacaaagaagaggcaacatcttgcactaattgttcctctgaagatcattgcccacaatcacatgtcgattttttgaatgttttttagagttcacaacaattcaagactaaaatgatgcatcatgtgacaccatgtcataaactaatttggagatataaaatttaatctagatgttgtcatcatcatatgacaacaggctatcgtgggtacgagagaaagagagagagagttgagggatacaaaaaggggtgcaggctggaggcacactaatcgtgggtatcgcctagctaccagcacatgggtgaatatagaggtttagatcacaagatgtgtaataacatacatcctttttgagtatggtggattgattgagaccaagataaataagattacaggctcaactatctaccgagctaataactgaataactctcccttcccttttggatctagtgagagttctattctagttggtctctagttcacctcatatatcaattatatatagagtaagagagtccttttgaactgacccccactatgtactctactcttcccttctatagttcaatggaggagagagtgatacatgcctgctgagtagtggatcctgtctagaagaggctcaactatccctatcttgccatagatagtcatactcggtgcatattttggacatgtcacaatattgagcttatcatattgtggcgatagatatgtcttgtcatagtgccaagtgccaaagtccacgcatttgggtatggcgtagttactaaacaatatagttgcatttacctttgtaatacttgttggtatgtttgcatgttcaaacatggctatagaagtgatgttgcataccatatagtggtctaggaacacatgttgctaataccatggcaacattgcacctctttgattgtaatgtcgcctatcacatttaatgtgatggatggtagccttatttatctctctagtaccacacaaccttcttgagtagagatagacgtggcataaaggtcatacttttttgggttgcctttccctagggatagggccagccatattccttagagattgatgtggcactggggtgtactttcagaggctgttgtgctctaggggaagggatagccatccatggcatgtatcgtatagtagccttgggtatgtctactgctaatgtcatggtaatagtgcacctccttgatcgtaatatcttt

SEQ ID NO: 3646 - DNA, 1385 bp, Zea mays
  misc_feature (1)..(100): optimal_loci_234196_G1, chr6:153663301..153664685, Cluster 22
gtatgtttctgctgtccgttcactttattgacgtgtcatacatgtcttctcttgactaagaattttttcctaaacaccattcttagatggtcttgtcgttcgcccatttgtcaataatttacttggttctccatcgatcagaaagagatctttgtgaggcaaagcttttcttcaatgcccatcccttgtaatattgaactgaaggttaacaaaatataagggtcagagaacaaaggtcgcaatccttggaaccaaaccaattcatttgtcctaaaataataattagaaactattttgattatgagggacctttagccagagaccttctccataatatcaggttatgtctacagagattgcaataaagtaaagctatatttttattaaaaggtacatgtaataatcattgtttgaaattaaacttagattcagacacaattttaacgtctcattttattatcatggaaaaatctattggagggaattttagggacgaagattacgatgttagattaaattatcatctcccaacaatgcaagtaccgtgtaaggtcctctccaaccattcactctatatatctcctcttatttgtactttataatatattttactaccttcccctaaaacattctccccccccccctcctacctgtactttctaatatattttactttcttccatttaaagattctctcctacatatagtatgtctccaaccattctccatatacaacccccctatacactataacttagttaatcaacacacatttatcattttttgaatttttttttaaaaatcatataacatttatagtaccataatacacattattattgtatcatggatcttaattagagattaaaactacataataaatgtatagggggcatgttaggggctatttggcacactttctaagctatatcctatttggtaaactgcacaacacaatgttgggttgtattgcgcagaggctacttttatgtctggtaactgcgtaaacgaggatggtagttataactgccaacttctattcaccaacatttacaaactgacaacaggtactactagctacatcaacccaaatacatgatgcacaactacaaataccaatagttcattctacgttctcgtaagttaacattactaatcattacaccgaaccaaaatataagatgcacatcaagataatgatcaccaagaactgggatattagaacataatttttaatatcaccaaaaagactagctggcttggcatcttttacttcttcgtggcacttcatgcatccatgatcttccaactaccgattgtaggcgtgcaatgcttcatctctggttttgtagctcttgtagcaacagaatcaacattcccaagtt

SEQ ID NO: 3647 - DNA, 1252 bp, Zea mays
  misc_feature (1)..(100): optimal_loci_237329_G1, chr7:723164..724415, Cluster 22
gcaatgaaaacgaacaagaacaacatgtcctattttctattttgatcttgtcattttcttatttgtggatcatgtttttgtatttccaaaaatgggatatggttttttccatccgtttttgtgatatcccattttaatgcatgatgaacccatatttatcccatttttaatatatgtgttgaatgcataacaattacatattcttgtgttatgttaatactcatattaatcaccaaatatgcatgtacgtatgacatgaatgaaagtgaatattatatcaatattcatacatgtacaacatttgtgactttatgtatgcatacttgataatattatattatgttgtatttgtttatttttttaggttttgtgtccatatttgtctgtttgcatattttcgcatatcccgattttgttttttatcatgactttttcgaacttgatcccattcttgtcaaaaaaaatatggaacataaatggaagagggttttcccataaaaaactagatataattgtcttattttatctatctttttaggccttcatagattataaacgagtttatcttttactattaagtagcttattttatttgtataatcttttatcaagctactagaatgattagaagctagcatagagttatttagaagtagagtaagtatatgattttgcatccaccattttggctctagtgttaatacttattttttgtagaataattttataggctaccctcttctagacatctagattctatcaatatgttttagaaaaaaagtggattatatgatggaattatccaaaaaaattaaaaaatatgggaaatttatcaacaaagatgtagagtaactcatatacttcctccatccgcgaaaatatgtcagcctagttttatcttacaacaagaacaacaaatgatagtttttcgacataaaatatgtgtgctatggaattgtatttgatgatatttatttgataatacgattaatgatagtttttacatatttgtgaaatttaagatagtttgacttattaaaaaaaactagaatgtcattttttatggatcagggggagaggaaagaataaaagaatcaatcacaaagcagtcaaagtatctaaaatttggtcatttttatataatcaaatatttataacgacacacccttaaaaattacactttcatagtgtacggatttagtgccatggctgtttgttttctctaatcctaggaatattccatcctttttgc

SEQ ID NO: 3648 - DNA, 1204 bp, Zea mays
  misc_feature (1)..(100): optimal_loci_2376_G1, chr1:12656983..12658186, Cluster 22
ggtagcatttgccgacatcatccaaagctctccatgacattagtctttagggcctctttggaagcaagtgcattggaggggattgaggtgcctattcaaaattaaatagtaagaggttatagtcctctcaaacctctccaatactcttgctctcaaacaagcccttagagtctttagtgagcctttgggacttcggccgggagttgccctcctgtgttatgcttctcgcttctctgccttcactgtgcttttatctgctgcaacattttccctgcattcatgaacatttaaagaccttattatatttatctttgaggatcatcgtttgaaacctttgcttttcaaataacgtcagtttcaggtcttcactccccaacacaaagtaactggatataactatatgagtatagtaagaacttatttggttcctttattccaagaattaaattttagcccctatcctttttggtttcagtgattaaaaatgatccctaaacataccctaaacaaataaatatttacgcatgacgaacagtttgcgctgctcattattggtagttgcagcactggaattgcaaagaatgaagtgtcaaatttgggacagctccgactccaaaaaatttaaattagttgctccagaaaatcatgtagttggagatataagcctttaaaaggtatttatttaagtcatcttgtttattatttagattaaaaatatttttaaaactatttaaattaatattacaaactacaacttcacactaaaactagaacatagaacataccccattagaaagaacatgaatgtacgacctttccttgatcctactaggaatacgatttggactgcccgaggagtgaagcaaggcatattcatctctgaattgtgtttactaggtgataatgctttatagtgtcctcgtagcactagatatgatccttattcgccgaacataatgtctgaatttttgggttttggttccttcatctctgtactgtacacataatattcacatcggttgatcggtagcgtatttgtgctctatgttttcagaacaagaacacatattccttttaactcgccttcctacctggaaggcgtattcatatggaaccccctgtcctcgcactccaatttttttcgccggtggggggggggggggtcagcagcgtatgatcggttggttcatcagatctgtcctcc

SEQ ID NO: 3649 - DNA, 1246 bp, Zea mays
  misc_feature (1)..(100): optimal_loci_238496_G1, chr7:7011331..7012576, Cluster 22
cgaaaacgaaggcgctaaaaccaatttagggttcctgcagcagtggctgatgagtgccatgactttttttgccaatacaaaattaaaatagttgtgattatggagctagttttataagttggagttccttttttccttcttttttttctctctctctcaaagatatcgtagtttccctgaattcgtcagtttaccatcagtttaccatcggtgcctgaataagaagaaaaaaaaactcgacttacagggataaaatcaaggatttttttaaagctggtgccctcagttttgctggtgtctttatttttattcttagtcgtgtttttttttgctcagttttactcttgaagtgctatataacagaaagacaaaactgagtaaaaacatgactaagggtaaaaatgaggacaccagcaaaactttgggcaccagcttaaaaaacccgaaccctaagattaattgtatttttcccatcttaatttttgcacttgagggagtatttttaggagttgtcatgctataaattaaactacgaacacatggttgatacgtgcccacagttttggttgagtttgaggactaactacggtgtgagtgtggtattgtacaacatatctcttgacttgtgatatgccggataagtaaggatgatgacatgcaatttaacaaaagggagatatcagatggttttatggagatgagaaagtttacactgttacaaattttgatatgacagtcttaaaacagtgcaataaaattatgtattgagaatggccttaggccacatataaatgtcctttaattaatgacagtattatgacatggtcgcatgtacagatcatggatggcccccacgcccacgggatatacaccgctaagaagaagattcaagtattcaacaaatcttcgccacgtagctcctagtgttaaacttaacttcgcccagtatatatatcttcgaccaaatgtcaaaactgcacttagacgctacaattactacgagaagtaaacaagattaagacacatgcatgtggagcccccctacgtaccttcatatgtcaacccttgctggcccgtaattttaagtcacttttctttacacggccaagcttacttaagtggcggctaacttaccactaggcatactaaatcactaatcataatcagcaggtaacacgaaagacacgtgttgtggatcaggatctgatgggttcataggatttaatacgagcggtaggtttggggt

SEQ ID NO: 3650 - DNA, 1248 bp, Zea mays
  misc_feature (1)..(100): optimal_loci_249178_G1, chr7:77958235..77959482, Cluster 22
ttgaccctcagatagaaggattatgtcatcaaataattctaatgtctcctgagctggttgcagcaatgaaacaaccattgtaagatccatcagatgggccatctgttgaagaaatgtcataatttcaagtgtggtagaactgtcaaggcctgttgatacatcatccataaagaaacatcttgcacggccaactagcatctctcctgatttttacagccatggtggtaaaaagtaactgataagtgataagattacagtatgttaaaaataaaataatgaggctacatgaatgattaagagtctatttggattaacacctgggaaagctacctaggcaggtagtgctccgaggtgcctgattttggacgcctagggccaaagatgatttgcctagccaggcaatgcttgggaggtcacaacccaaatagatcccaagtgcatcacatattgcaaacatttgtaaagcatttgtagaaagatatgatatctggctttgattactcccacaacttgattctactatgctccaaaccaattgcccttaatctataacctggtgagtggtgactactctgctagccgagccagtagtagatgtggactcattgttgcaattgttaagtttataataatattatatatactaggtttaggtttgtacaatgtatcatgatttgacccttttgcttcccaatatgcagggatgggttccacttgctcagtagcaagctgcacacagcaccaaatgagttcgtttgctggtaagaatccagttaatcttctgtcatctttttgaggcgttcttcgctgttgggaatttacaccaaactaaaaatcggaagagcattttaagtgtaatgtcattgtcaaattggttgtatagaaacatagctaagatgttctaaatgacatttacgttaaaaggaacatgatgtttttggatgaaatcaaacaagttggtgaacattctgtactttcatatcctttccccctcaaagaaaccccttctgttaataaaaataaggacttcttgctcaaattttgtccgtacatataaggatttctaattatcaatcatgtggtggccagaggagttgcttcggccccttcaatgtgggacatgaaagacttttccatcctcttaatttgtcctaagattcacgagtctttcatatttgtggatgaagggactatattaatactaatctgctactagtactctctccatttcattatattaggcaatag

SEQ ID NO: 3651 - DNA, 1027 bp, Zea mays
  misc_feature (1)..(100): optimal_loci_255888_G1, chr7:117782315..117783341, Cluster 22
atgcttacccccacaggtcgagtttttttatgttacaaccatgaaatcttgtaaagtttttaagccaaatcatctttggaaacacagatgtgtcctttttgtaattgcatattgttctttgcaattgcagtattgaatcttgtttttcatttgaattgatgtgcagaaaatgttgctagtttagaacagcgtcagattagctgtctacaaatccttgtgctttgtagtttctacaagaacaaaatattttggaatttggaagggatatggtacttttgtattaagcaaacgaacctgtacaaagctgccataatacttttttgacaacttatctaaaaataatttgagtatgtgcctttctttgtcagtgtgcttgcacatattctgatgattatttggcaccatatttgcacatggctgtatttggtactttcttctcatatgggagggttaggttttatatgtattttactaggaacaaattttagaacccacttgatttgaagttcatcggataggaaccttggatgagctggcttgtagaaatgaaatttgatgagagcaaagctatccaatgtaaatagtcatggtgtattttttgtgttttgtgatagttgactatttgaagatgtcaaaatccctttccgcaccactttgaggtccacagcatatctttcgttaaatgaatttatgatgtcattaatggacttactgctgtgtgctgtgacttaaaatatagcattccatagctgtttcctggacaaaattattagttggctttggcactgtcacttaacctatacatcagggccaagtacgcaaaagacaatgtttctatgtaccctatgcttactattttcttcatttataagttaatgaagttatccgtaagatttgaagggatgacattgtcaagtacaaatcgtcaagcttgcaacattgttgtagcgctatggacaagcttgttatttgtccccagcaattatggcttttattctagggatgattttgtttacttggttgtcca

SEQ ID NO: 3652 - DNA, 1263 bp, Zea mays
  misc_feature (1)..(100): optimal_loci_260336_G1, chr7:141789680..141790942, Cluster 22
taattagttaaatactaaaaaatggtcaatctttttttcttggttagatacactagagctaatctagaatatattcagctagacagtgattagcgtatggatccaaacacctctctctatataatcaccttcgtcatctcatttgcgttgagtttacgtaattcaacaccactacattgtggccacggccagttctcttgtgccgacagctaaacagggagagcatatgccgtactctggggctctgaactccttcatggcgatcggtctcggatgctggctagctagaaatgactttgacaggaatccaagcactgcaaacatcttcacagcattaagtggcactgttactgcattaatacgttttctctgtacactgtactcttccatgggaagcagaaaaattcatttctcatttagttagatatggacagggctcagaagttatatcatacccctggaggacttcatgattttaacttctgcataagacgacaatggcttcaagcgccacttgctctttcaaggaactattaatcgacggatcgaccaacatgcttgcattcatgcataggatgatgtgatgctgttgggacgctgtagtatgtcttaatatactcgtttcgtattaaaattgttgatcttacaaggttgaaattttatcgtaaaatagttgtcattctttacaatgcacttttcttttctgtccatataacttttattttttatatgcatatctctattttttctctctctccttgtttttttatgtatcacacatttctatctagaatttgtcctcaacaatacctagatgatgaatggatgcaatgtaaagttcttttgaccaggtagatatgctcccaggtactcgaggaacaaaccctagatatagctttgacatgcaaacaatctaagtggagctccatgtttccatgaacctactgcgagaacctcaccatccaaaaatagtccaagtcatgtatattttaccacccgagggcacctacaccgccctaaaacaaaaatatacacatctcgttcttgttcacaaccgtgagaacctcagaccatccaaaaatacacatcgttattgttcctgctgaccatccacctacaccgcgaatcgtatgggagaacaaccgcaaacttgaaacacttatagcttacagtgtagacttgatcacaaagaccatctgtgaaaaagtcggaccgtccgagaaaattattcaagttctagtaggtaacaaaacttgagaattt

SEQ ID NO: 3653 - DNA, 1221 bp, Zea mays
  misc_feature (1)..(100): optimal_loci_260765_G1, chr7:144210046..144211266, Cluster 22
tctctcatttcaaactctactcgataaatagtgtaatctacattgcaaaatattattttgcacaaccatatatttgatctactggccatatcctaaggtatagttctcgttgactccacctatataactgtcgatggcttcactcctccttataatcaccacataacagccatttttatattgtttatggttagaaacctataaatattagacagtacatttgattggtgtaataatattaagtttgtattgcaataattaaaaagttgttaatcagagtactgccaaagtttataaagttaactcttgatatacctaaaaatccttataaattatggcacagaataacatcgatttaaggtggtgttagagacttctccaggttctaactccagcgtggagatatattttataatataaatttaaatagtttaaaataataaacaacgtgacttatctaaatgtcttctaaatgattataactctagctccataattttctagagctcctaatgacctgctccaccaactccagcaaattttttagaggtggagcagtcccaaacaccttatttaattgcatgaaggcatatacggtcttaaatgacaactaaaataagaggtgttttacggtgcatgaaaagcataatagtgccaatcagccctcaattaagtagtagaagataagagacagttagttttaaattataaggcattctagaattttctatgtatattattttaaacatatatctagatgaaatgtatagtaaaaactatttttaattaatagtcacttacaaaacaagagtactatctataccactatataatttattgatttcaactctgcaaaacctactcgaccaaatcatctcacacccataacctcccataaagtcaccaaacaaattacacctacacataacaaaacaacgataaaaatcgctagataaccctcatatcttttactcaaattcaatatcaaatgttatttggatcatctttcctctcacatctctcacatgcacacattatcgaagctaacaaatattttatcagggtcatcagtattatctactgcatttgtactatatagaattactttagtatagaactactttagttatcagtgttttccattatatattcaaaaaattatggggttagatggcaccattgcctcctcccgcgaccccgccgcaccctgtccctctatta

SEQ ID NO: 3654 - DNA, 1243 bp, Zea mays
  misc_feature (1)..(100): optimal_loci_265589_G1, chr7:170306248..170307490, Cluster 22
atccatcagacttccaagatcaccatcatgtgcagattgttgatcctcgtgctaatgtgtataagtgagtgctttcgttcaattttcaccatatttgtactgatactttttatattcggttattgtgtcatcctgaccagaaaatgaatgttataattactctagccattggttatactttcagtacaaaatgtcgtttgctatggcctaaattatagtaccatcatgtacaacttttttcctcgttataacagtaatccattagtcctggatatgacaggcaatgttataccctgggaagtagttcatcttgtccatgttggtcacgtgagtaattttagtaatttaatgctatcatttatgattttatggtttaacaagacatggatgtgttcatggaaccacgaaagttctgtgagctagaattgttagaagtgctcataactttgatctgaatttcttctgcatgtacttttccatttttctttttttcttgtgggtgtgattgaactcaataatccactccatatggaatattgaacgcaataaccaagtccttatggaatagaagtcttagctcataaagcattccagatggaatattgtttatgtctattgtcttgccagttggatgttggagttgcactaggaatgctctagttgatatcacacggggcacattgggtttcagtaaatgcactcactgtttgtagggtttctgttgatgtttccttttttgaatgaatatcaatgaattataatactaacttaagcacatcgtggatgataaaaccaagtttcacactgtaattatttgttgaatgaaaattaaaatattgttattttcatgccattatacagttaaatataaattcaatgtccaaaactgtcgtattcagcgtgcacaaacgccttgtgcttttttgcttgtgtgcctgcatgtgtgtttatgctattgtaatgtgttttcttctttattagtagattcacgggttcaatgcagaatcaatcatcagatcataacatttcaaaaaggtcaaggtcacctactttgtcctacgaggatgctgatggcacgaaagctcatgttaatactggtggaaattctagaaggtatcgaatgatgtttgttttttctggggtaatttaatacattttgtgcatagtaaccttgctttctgtagtgcttaaacacctagttctgcagcaaaatgacttcgaggtattaaattatgttggaaat

SEQ ID NO: 3655 - DNA, 1277 bp, Zea mays
  misc_feature (1)..(100): optimal_loci_270318_G1, chr8:19117284..19118560, Cluster 22
aaggcagagggactataggctaagattgagtaccctattaaaaatactataaactaaaattattaaaacaaactttacttattatgaaaagcattaaagcaattaccaatactagttctctctaggaaagtcactgaacaattatagtagctttatattaatcgaagcatgccacttagtacgagatatcaaacagatgtaattgttactagttacaatccacgcaagaatactgcaaggaggtggatgtaattgtaagagtatgtgtagtcactaaaccatgcggggcaagaatcgactcgattgcttgtcggtaagttatgttcttatagatatgaatctaagctagtaggttcacgagctaattgtcatcacatgctaaatccacgataaagtgttgtgaaaaccccagtaaatatttactacaagaagccaaaattttaatagagttgctcttcatgattgtagccgacaacaatcaagcctctcaatattctttcgttgtctctaagacatataggttgtgaactagcaagagtaataagaaccctattgaagctagatgcattaactcaatacaaatcattagagatcactttcgaactcacttaactcactttagaggtattaatgttactagagatgtgtgggagatgttttcgtaggctcacatgtttaccatgttaagaaggtaaggtattttcttcaaagttaaataagctctatttatatatctcaagaggcaaggagccattgaccctttactatagaaaagtcacgggccatggaccatgtgacaccatccatcggactatgtcatatgggtctgatgtcctctaagcttggcacgtggttgaaatctaccattgtcgctccaacgataaacactcttatcgagtctgactaatataatgtccatatattacaactaaacataaattatttgataaaatgctagttcataatgtgtcttaatcaacacttcaacttcttcgggtatcaattgcattaatacaattgtaatgcaagtataagagataaaatataagcgtacctgattagatacttaggtaagaacttatcttatttattaggagaagagataaggcttatcttatctgattgttacgtgagataagatttatcttatctggttgctaggcgagaagtgtgagagagaacagatttacacatctatatatttcgtgtgtaacacacgatacagatcattgtcgaaactagtctaaaagtagaaatgttgttagttgacgggcatg

SEQ ID NO: 3656 - DNA, 1323 bp, Zea mays
  misc_feature (1)..(100): optimal_loci_278641_G1, chr8:78355170..78356492, Cluster 22
aaaatcttttatttttatagtaatatagaggacggtgtgtctttggagacggtttaagcctacaactgtaggacgagatgtgttaaaaggaggcagaagcttttaattcttccaaacaaccaaagctagacagcaagaaagagaagtgtaggcctttatataaaagttgaagtgaagtgtacgtcggtgaagaacattttcttgagacgttgatgagtggagtttgaccgacctggagtaacaagatttcctacggtaggcatgcaattttctcatgtcatgctaaaaaaatcactcagaaaaacatactggtcttattgtagaaactgattttagaataacttaaggtgtcctaaattttagtttcgccacttttagtgcctaaactagcaaaactaaaagagttctaccaaatagatgtcctaaaatttaggagagtgactaaaggaactaaacaccccttagtttgccttgttttccacatgtaccaaaatagatctaaaaatttgagcaaatacaaattgtctctctgcatggaaggagagggagagagagagagagagagaaatgcctagagtacctttcttgaagcaggggtagatgtgaacagatcaagcagttgtgttcattgtcttcgagctggagttctcagcattggcgattgacaccttgaacctctggagagacatcaccttctcctcaaccgatgtggctcctctgtccatagcctacaagagcagaatcatactgtattgttgtacaaggatgcaaccagggactcactgagccttaagacaaccgatgccaattctggcatagctatacatttagctttctcgatagaatgggctatgactcatgaaaaagtaacgatttcaaagacaaatagcataccatagccaaaacctaaatgaatagaaacacaaaacttacctgaagatccttcatcgggtttcaatcatgttccatgaacaccaatgtgtcggcagatgtcaagttcaagccaagcccaccaactgccaattacatagctctctaaaaacataccatgggttgttaacagaagcacatcaatggtttggtctgaattgaatgctttaacaatttcaaaactgtaagctctaggtgccccgcaacggccgtatggatggatactagtcgcttgcgcgcgccagcgcgcgcatgtacgaatattttactttggcgtcaatatgatttactatcatgagtgttaatgaatgtaaatttgaggaagaaaatagctacaatttctgatggagctgtcactgaatttgatgtagatgctaatagtgacatagataa

SEQ ID NO: 3657 - DNA, 1298 bp, Zea mays
  misc_feature (1)..(100): optimal_loci_278782_G1, chr8:79131164..79132461, Cluster 22
gcccccattcaaataaaatatacatgattgtcattgctgcaaatgtgctgggctatttagaaggctaggaataatgtgttttgaaaaaggaaaaaaaacttattaactctcctaatgatatcatttgacacgcgggtgcgttgataacttcccgggcatggctcagtaagaaagagcttaaggatcttctccaggagggtgccaaactgatgatgagtgcgtgctcggttatgttagttgtcgttgtttttcattctgtttggcccctccccttcgtgggtatgcatgtggctttttggcttgtctggtgagatctgaaccagatcatccaagagtgacactgtcccgcagttgctttgcacctggccgtttgttctggctgtcacaacttgaaactctgtatttctgttatgatcataatagaaatggggatctcccttgcattaaaaaaaatgtatgtacagtgcattggctaatgcatatcacattctgtgaatgcaagaaccagccttatagactgtactgcacacacacttctgggggaattacttgacagtgctctaacccatgaatcaacctggaaaacaaccaaatccaatgcaaatcagtctctgtcacacgtattttttttctttctgcatttcagagtacgtgtcacctgtatttcggaggtacttactggagcattcaaacttcaacaacatcacataacagcgtagattcatgtgggctcagatctgaaacacagaaatgtcacgagttcagtaacagctaataacatccaagtgcatgccaaatttacctgtagattttagataatagtgtataaacactgtccttgtagaacaacatccaagtgcataatagcatcatctaatagagttgggtccatcgctatacagtcatatacaccaaaagtcccatagtcgtctcgttgttaggtttcaacacttgtgacaagagtgatgcaaaaggaacagatactgacataggtttcgtacacttgtaatgtaacttcatcaacattttccaacccgcaaggtcaaagcacaaaaaaatttcaaataatatcatcagcatatctcaaaattaatgggctattcaacaaaagtgtgcatatttaagtgagattccctttcctcaacacccgcgcgctatttgggatcgtacttgagctttggataattcaatccgccgccaacgaaaattgttggtgtcgcaatcatgattgttgcggttttggaagcagggaaactttatatagattattcagcaaccttgtcgtcgtcctcgttcat

SEQ ID NO: 3658 - DNA, 1065 bp, Zea mays
  misc_feature (1)..(100): optimal_loci_282320_G1, chr8:100760471..100761535, Cluster 22
ccgcccatgcctccaaacattctgcaagcaaaaaaaaatggaagtagtaagaacgccgtcggtttgggtgtgcatcggccgtcaggcgacgctcgccggagtagacgccggaagttcaggggcctccgtcggcggcggcgtttccttctcctcgccgtgatcagcgtcttccttgccaaactcctccgttttttcgtttggctcagcatgctctttttcttcgactgtcgtggtcgtaacttcctgccacacgtaggcagtgagacaaggcccgccgatattttcatgacaatattttttaatcgaaatagattttattagtttacattcatacaataaaactttcttcagtttaacatttatcatgtaacatagttgttgtttggttcacatatttgtaacgtgagttaaaccatatttatttaagttcaaccataattagatatcaatctacaaattgataccgtactattgaaacttgttaccgccaataaaaatgttaattattaccattgtcatttatgtaccggttccgaacacatctgaatagtttttgcagaccgagttttcgttgtaaactcgttctacaatgaaattattcatatgctactatgctagtgaatatttcattgcatgccggtcctacaatggaattataattgccaaaaaaaactaccataacaagtgtagccacactatttgcccaagccatcatactaattattttataacatcaatcaaaggataaaaaatatttaatgcagcaattaatcacgatgcacgtacatgcatgagaactaagagtcttttttatttagttgtaaaaatcttattcctaatcgtaggttgtgagaaagctactgtgacctaaaggttataagaaagctaaaatatacttggtcgaaacatcgatcaacttagattctgtaagaacataatagcttatgacatggatgataaaaatctaaaaaatataagatttgaggcgaccagagaaatatatagatttttaaaaaacaattgtgttgttatatatttttatagcggatctgattcagaaagtta

SEQ ID NO: 3659 - DNA, 1098 bp, Zea mays
  misc_feature (1)..(100): optimal_loci_282619_G1, chr8:102406405..102407502, Cluster 22
tccaagatttttttacaaccacaatcaagaatttcaaatacgaaggcagggtattgaaaacaataaaggctacatatcttctatcatagttgaaccatgtaggtgatacatcaaacagctgtcgcggatttaaaaaatcaaactgttactttgtctcagacaaaaatgcacggtagatgagttatttctaagctatgagttgcagtaaatagcggagctattcagagctacagtgctcagagctaacacagcaagacaaggtctgaaacagatataggtggattatatttgaaacattgctcttaccaaaagatatcttgaataaaaagatgcagttggtttttttaaatgcaacaacgtcatagaacatttttttgtgcccctcatcaacaagacagaacaaggaacaaatatttgcatcaattgtatttgtattgtagccatattgtttggttttatttgttcttttggcgaagtttatgaattttcctgaaaaggaatttcattttgataatgaaggaacagagagcatggaagcattcaatcactaactaatctgcaattaacataccatgcagttcaaattaagtcgaatggaatagagaaatccacaatgttcgtcaaattaagtcgaatggaatcttatcacctgtggcagcgtggcctcttccatagacaatgcgaaggtacatagaggggagaaagatgcacacccaagcatcgatgaactgaaataagggatgattcaaacctcatctcttaatcctttttctcgcacactaataggcgggcttgtttagtgtaactttcctgatcatacggactatacacatccctgttaatggaatcaagacatctttttattcaggatgaaaagcggaccgcctaagcggcgactgttgggcagtgacaaggccatggtccatggaatggaaggaccactccaactcatgtggttatgcaggaaggatttggtctttgaaaaaagaattgttgctactcctttgcgggttatctatccggttatccactagctacgaacatggattattctacagaaggtatcctcatcaggattcggttacagcgacgtgtcaa

SEQ ID NO: 3660 - DNA, 1001 bp, Zea mays
  misc_feature (1)..(100): optimal_loci_284165_G1, chr8:110582631..110583631, Cluster 22
ccctatgggcccgagaatcttttccccgacacttagtgttcgctggagcttttagcatttggaagatacttagcgccctactatgatatcgtgcacctttgttgagttggtgcatcacccagtgtaatcatgtcacgtatgatgtactggtggacttcgtgaccatggtgatatatttgatgtcttttgataattgatatatttgtaattattatcatgtagtgaatatttatttctatgttgaagtattccccatgggggctcaaacaggaaaaggagatccatgggaacgagggatagagatgggtttgtccctgttaagctaaacgggacagggacaaggaatgagtttcagtgaacgaggggcgggtggtccccgccccgttgccatcctagggtgggtgaactagtgatatatactggtaaagacactggccctagatttctctgaaatctatagttatacagtgtgccaactaaaatggaggaggtggcactactactcttatctactgcaaaatgtgctaaagtaggcaagattattgatcctatctgctagcaattattgttggaactgatcccatcgagcctgaatggtctcgaatagggttagtattttgtctatctgaatttttacatatatgtatacttacgaacgataaaagttaggatctcatgtataaccacgagtgcatcatccgcattttactcgacacgttcctatccctatacaggatatgtaataatttaggggtagttttggcttttaatctgagccctacgtatgggtccaaagtagagtggtatatagggcaaaataaaaaaaatcaacctagacgatatagatagaatgttttaaaaattaatgttaaacactaaatatagaaaactctactttttttcaagcatgagttcatacgtcacgcttctcacgtgtagagcatattctattctttcccacgtcttgtttttagatagcccgtgacaaaacatacaagccc

SEQ ID NO: 3661 - DNA, 1030 bp, Zea mays
  misc_feature (1)..(100): optimal_loci_28732_G1, chr1:175890836..175891865, Cluster 22
gaaagcttcttaagaaggtccggtggcaacagctcctttagatggtttgaattgaactcttgttgggcttaccgacaattccaacaattaaattgctcacctctttttatcacaatttaaatcgtgagtgaattgttcacctcattttaccggcttaagttgttgtgttaaattggttggtgcatacaatttaatataatatcaaagccagagatcacaagtttgaatcctgttaacacaattaaataaaataatcattactcatttttattccacaactgaggcttgagagagcctcgatgtgaggagtgttagaatacaagtgaactgctcatcagattaaaattaagcttttagattaaactaattggtacatgcaacttaatataaataaaataattattactcgcttttattctacgtatgagacctgagagagcttcgatgtgagtggagcattagaatacaagtgaactatccacctctattcatcaacctttcgggttaaattggtaggtgcattcaactcaatacatataaccaatatcgatacctttaggttaaagaaagtgcaatttttagtaacaagatctttttatcaacgggagaatatctaaagtacaaattaggtgaaatatgcaaagaaactttgtcaactcatatcaattagttagtagatcctacaataacttcaaaaatatatatttggtttcctagacttgtgataagttagacttgtaataagttaaatattagatatgtatatatatgcagctctcgtgtgttctagaaaaaaaaacattccttgtgtcgaatcagatgcctgtgcctaaagttgctaggtaaggaaataataaacttcaccaaaactgtttcttactcattcatgtcagtataaatgccaataagaatgcactgttgacaagccatgcagcagacaagttaatgagtcctgatgcacatttcagatgtttgcaaaatgttaccaacaaggcaatactagtgtgagtgactaacatcatgtcacata

SEQ ID NO: 3662 - DNA, 1409 bp, Zea mays
  misc_feature (1)..(100): optimal_loci_293392_G1, chr8:159947819..159949227, Cluster 22
ttatcgtcgaaaaccattctaccattctaatacagagatatacatatctcctgcatatgttatcaaaccaaaaaaaaatcaatggtgacagtgctttacagatttctctttaagagcaacatttactacttgaacttccgttcctccaaatcatagaatcttggcacgacatgtatgagacttttgttgcctttgaagaaagtttaaaggcaacataatgatctgaattcccgattctgtatgatattgacttgacatatagaagaacagctcctgcgggaatccgcccgataaaaattcgtagaagacgctttgaaaaagaccagtgttttaatcctgtaggcgtggcaataagaaagcatcatgatttttcaaacttctcagtatatctggatcatcttcttatcagtgtcaccattcacccacaccatgagattatttatgctgcatctgctagtggaattctcaaggaaaggatgcgtctttattgtcttttatacaagtgggctcaacattcctcgcttcgctttgttctttccccttgtgcaaagcgattccatttcgtttccgctttgagatgggaatggccgaatgggggatcgctcctgtccttccgtcgcgccacgtggcgattccacgcgcgttagaaggtggtggcagtagaaggggcagatcatctgagctgtgattgactctttcttgaccacatgccctttgtgtagctcattaactggacattctgatgctctatcattttgtagatacaataccagtataaagttctatttttttctaaaaaaatggatgacgtactataagtaaggctatttctagcagactttttatctcaccccttatttaaaaaaccactcttcaaatcgtgtaatctaccgtgtaaaacggtattttctatgcacatttatacggcttgttgaagatgatctaagtgtattgcaccggcattccgaaaaaatagtggtagatcagaccttttttgtttctattgttttatctctactatattaaatcatcagttccaacagtcgtcccgcgtcaatatttttcaaaaaaaataccctgcatttatttaggaatcaacccacacactcctataatcttttctctgctactataatagaagagtttatgtaaaaaataaggtaaaattatctataactgaatgtttgaaccttggttgttggctgcatattcacacccacctaatcaatagaaaatatatattttgtgctattaaaaacaaaagatttattatatattctacgtataaaaatcgtagcaatccacgggacacgtgaatagtgtttgttatatgtatttgtttcgagcggcgtttctttatttattattacatgcactgcacagttgaggcaaagtcgatcgtgcgtgtg

SEQ ID NO: 3663 - DNA, 1200 bp, Zea mays
  misc_feature (1)..(100): optimal_loci_294580_G1, chr8:165998316..165999515, Cluster 22
cgccaacaatctcccccgccaaaaccgcatatcctcttgtttaggtaattttgatcacattatgccttctacttctcattatttcctttcaaaattttgggatgtagcttgtgaaactctggaatctaattcaatagttcattaaggtcaatatttgctatggaacatcctaggaccattccccatgagtttcaatggcttccacaactgaacaaatatttgtcccccttctagaagcgctccccctcagctggtatatctaactattacaatgtacaatttggtattacaatgtacaaatatactatgtgtttgcccatataataactacctaacagtaaacttttaaagtatgtagaagccacagtcaattacaatgcaacttcttatctctatgagctctaggttcctataccaaggaaaatgcttaagttgtgaatctaatataagccataactattgtgttcacgcacaacaagatttccatattatatgtaaccaactagtggccaccatctcactttttgtattcactttacagaactatcagatactctagggctagaaattttcaaccatgttttgtcgcctattgtcttcctctaaagaaatcgacatgctctcccaccagtgatctagaccttcttgaaactattgctgatagggtttgtgacatcaaagaagtcaaatctggataggtgcaaactccccgttggaatccgcctgtttgtaccagctggtcatactgaagccgacatgtctaggctttctttatccttgaagagagtttatgtgccagtcctttgagactgcttttgatccacatcggattcccttgaagacggaagtcgtccattttctacgcgctttgtactctaggcattgtgtttggtaaatgtacataacatgtacatttctatatgttatgaattcaccttgttgtcgctcatactttgtagaacagtgatgttggagaatattgcatttgtgctatatatcttgttgatttccatgagctttgaacctccaattgtttaacattactattttccttaactcattcagtacaactccatgtgaatttctggatatgatatggcatcaaacaagcttatcttttgctctcaaattggttgaaacagttctaattcattttaataattatctgaaattctgacactggaccattgctttgggtct

SEQ ID NO: 3664 - DNA, 1007 bp, Zea mays
  misc_feature (1)..(100): optimal_loci_294598_G1, chr8:166084482..166085488, Cluster 22
gtgtttttgcataactaaagagctgctacatcagtttgagattgctcaagatagtagacctttctcccttttggaagtatggctaataaatttgttgaagacacatagccttgccttggcttctttttatgcaaaatatggccagaatgaaatcttgtattgcgtggcttgagggtgataccaacactcgcttgttccatgctcaggccagtgaaaaaactatattgccaatattatcgtggatgatggtcaagtgctcgcggcccatgaaaataaggctcaggcattctttagcttctagactgggctatggaataaatgtacataaccctttgacctttaaaggatgatttatttcacactctcaccttcaaaataggttgtttaatcctctcagccatataaagcttgacaaataagcactagacaattttagttgtcagttttgatgacatgacactgatttaaacgacaccagttttatcatcttattgtatccaaaatttatataattttgtacaaaaattgttaattagatattatatttttcctaaattgtctaaaattttaggagtacagattaattactaaaaataaaaaactatataaaaagagcttagattttttttatctctgattcatttcttatctcataagcctaaaaattatacttgagctatataatactattactaaattactaaatattttgttttattaatcaagttaacttgtttttcttctaattactaaccaaatcaattgtacattattttttttataaaaacttactaaacagtaataaaattatcttcaatttgtacacaaatcttctcctaactaaactaacatagacaaattttctgagaaatttgaatgtggaattgctagagctgtagtataaaaaacaagagcatctctttctctactccaaaaacaactaaaacaaatttagacgtggagttgacaaatatttacccatcattgccgcttgttacaaaatggtt

SEQ ID NO: 3665 - DNA, 1292 bp, Zea mays
  misc_feature (1)..(100): optimal_loci_295308_G1, chr8:168930979..168932270, Cluster 22
tatttctcattttttgtttggcctataaaatagaatgagttgatccaatattaacacatttctcataattaattagtattaatatgagtaatgaggtcatttcaccagatctaaagaatagatttataatataccacctcgagtggttttttaaatcaaacacccacttaatttcacctctatcccactgctccccaccttccagctatgcataccctactccattactccgacatatgaccataccaactttgatgtattttcttattttcaattcaattagtttatatattttagaattttcgattattatgtaatctgtagttttaatttgctaaaaatatttcattatgtcatcccatttatttaaaatagagaatataaaatgattaaatctagaagagagaacatgacgtggtggtgatgcggctatggaccaaggctgcagcgtttgtattagaggagcaaggctgaactagttgtactggaattaacttaaatcaagtttaaaaactatatcacggtaccgacttagctgtacactttcacaggccgacacgttctgatcccagcaagcaatagcattcagatttcggtgcatgaatccattggtttgatggatcttgctaatagataaaaccataaacttaaatgaacttaatcttgacactttaacaacaagtcaagatggccgagttggtctaaggcgccagtttcaggtactggtccgaaagggcatgggttcgaatcccattcttgacataattttttaaatttatttttttcagcttactttactgaatgcatcactgaatgtctgaaactttagcgaatacatcaccgaaccattttttatatttattttttcaccttactttactgaatgctccatggaagtctgaaacttattttactgaatgcatcaccaaaccttttgaatataccattttttcactttgctttactgatgcatcactgaatgtctgaaactttagcgaatacatcaccgaaccattttttatatttattttttttcaccttactttacttaatgcaccatggaagtctgaaacttattttactgaatgcatcaccgaaccttttgaatataccattttttcactttgctttactgaatgcattgctgaaacttttcaatgtaccattcttggtattcaatcttttcaccttaccttgctgaatgcattctgaaacttttggatataatttaactttctttgtttagtgtatgtcgtttaccttttgaagtttatttttctcagtttataggc

SEQ ID NO: 3666 - DNA, 1168 bp, Zea mays
  misc_feature (1)..(100): optimal_loci_295702_G1, chr8:170760685..170761852, Cluster 22
cgtcgaggtcgacccctccttttatagaccaagtagggggtttacagatggcttctcaccagaagggagtgtaacataaacacagtatccacccataaaaattggtcgtgtgttgattcccttgcctgtgtgggttctctgtcgtatctctaatattgtcggtggtggatatgattcatgttggcgagggaagctcgagtgtcatcattagtgattttgtcctcttcttttggcgtcgcggactgagacctaggacctgtaggtcatgagtgagactctggcccaaatctcgtaggttgagtgggactctggcctagaacccatagatcataagtggacggaggcctgacactattcacgttgcgtctaccaactatcgtaattaatacggcatactcggctcgatgcagggcagagggggtgtcctgtggacgtggtggagtcgctcgtgatggattggacccataacatactaaccctggttcttatccgtctacccgaagatctcagccccagcctgatccaaatcagtttaatatattaatataaattaattttatacacgttacaaacataaataacatattaaatagaggttatacggatgtactagcgtgcttgtttgttttaggttattgctagcttctatcagccaaaagttgaaacaaataactgttgagccaccttttaaaaagctagaaagctaatttataagaaaataaactaaaagagtgttaggaggttttatgatttttgtgtgctgaaaggctaaaagatgttacaaaagacattttgacaaaaaaaaaaagagttactgttcacaagtaccaactaaaagacaagggctagaaaaccagtttttgagtcaaaatgtaaaaaactcttaggaggaatatcttttcatagaaatggacagccaaaaaagtttgacctaggacgaatgaagatgaacttatatttgatttaagtagctagcaattatttctagacagtgtgaattcaccaaaaaaaaagattattccagcagctggtgggaacacttaggccctgtttgggaacacagtttttccaaactgcaattttttgggaacacagttatgacattactacagtttacaatgcttcagttttcgaatacaacagtatctaatacatcaaggtgtttgag

SEQ ID NO: 3667 - DNA, 1059 bp, Zea mays
  misc_feature (1)..(100): optimal_loci_300312_G1, chr9:15169965..15171023, Cluster 22
aggtgagagctgagcagagaggatgactgtgtgagggagtgatagagtggagagaatgagcgggttgacgaggtgagggagcagatgcaacaaatatccatcaaggttaatgtctacaacccatttttttgttttttggcacaaaaaacatgaatatttgaacaacatttttacggctcatggagacctctagtttttattagaaaattttattgtttttaataatttttttgaaattccacgttttgaaacgaaaaaattcagaagcttctaacaaaaaatgttttcgcctagttcaataacggtaaaaattgtcggtaacctctggaaactgagcgggaaatttaaccgtgattgcgggtgtgtggaggtgacgtcttctcaacttcaatcatagaacgattgattaacttggatagtttagagtacaagaagaccttaaaatcagtgattcacatacaatatatcattatagaatcttgtaactcttgtgaactgcgcaaagacaaattcgagggaatttatatatacacacagtgaaaattgttgataagtttgcgattgcaagtgctcgaaacaacgaataaattaaccaaaattagctacatttactcgtatacgcaattcatttctgtgaagtttgaaacactcaagccatattctatagccaaaaagctttttatcatactttaggggaacagtaactaacaacagagtggcggtcctaagattttgaatgcccgaggcaagttttaatgtagagacccttctaatatttttatatatacatattaccaatataagcactcaatatacatataaaggtatttatatcaaataacaaataaataaataatttacatattacaatattaccttaaaagtttattctaacattataaatatgattaagatatggatacattgtggttgttagttcttcgatacttcaccgctgaacttgtagaccataaattggtagtctagccaatataaacatatatttagggttaggccctttgtaattgggggccagggcggccgcccctctgccccacc

SEQ ID NO: 3668 - DNA, 1024 bp, Zea mays
  misc_feature (1)..(100): optimal_loci_300325_G1, chr9:15301984..15303007, Cluster 22
tgttgcaacgcacgcgtatttacctagttataatatatttttctagactaatttatggcattagctactcaccaataaaatttaaactgaaaactcagtttgtacgtaaaagaaataaaaaaagataaattttgttaagagatggattgaaccatagggataaattgaactaaaaaaactttatggggttatgtgaatcatgcatagatgagaggagtaatttggacgttttccttttaacaatatagaaacaaatttattttatagttatttaagtttatgaatgtttcatctatatgaaactagcatattttctcgtattgaaaaatattaccacatcacaaaaacatacttatgtgacaacagataaaactccaactgagacttgacctaaacaacagagaaagaaatgtgcacatgaaactcacggtaagacttagcctaagcaatagagacagatatctttctccctttaatgttaggtagaaatgtatcctagagagttaaagaatctttttaaaaaatagtatttaaaaaaaattaggccttgttcattcgtaccaatatagctctggattaacatggattggaattaaatccatgtcacaagtcatgccccaaaataatttaagtctagtcaaattttttattcggttaaacacatcatgaattataacccaaaggtttagaaattttttaaactatgtaaggcatggattctattcatagctcattaggtatggaacaaatctatgaagatattgcacaaatttatattggaatccatgtatcaaaagaataactagctttgaaagatacatagattaaatgatggatttatcacaccataggattaggtgtggggtatggattcaatcaatccacacccggattaaggatgtgtttggtttgaagaatcaatccattctagatgagatggtgcatatattttataaattggtgaaatggctcattcctcatattattagtaattattagcttatgaggaatgaaatggtgatac

SEQ ID NO: 3669 - DNA, 1005 bp, Zea mays
  misc_feature (1)..(100): optimal_loci_300544_G1, chr9:16980235..16981239, Cluster 22
ctggacgttggcatgcataaatcatcgaaaggaaatataccacacccccgttcaccgttctaaataaattataaatcataagatgttttcagttttttttaaatacgttattttatgtcaaatcctaaaggtcccccttttcattttggaaactcctaggttctttattattatgctatatttctagagttaacatggcggggaataaagtcacaaacaaaaatgatacaaaagcttgctctcgctcaaaaaaaaaacacattaggcgtctgacttcatcttggatctaaggctatctctaaccattcttcctatatatcttgcttatttttactttctaatacattttattataccctcttaaaatattatcatctacatacagaaggtctccaaccattttccccaatataattgtctctatacactataactcagttatttaacatttatttaccattttttgattttttttttcaaaaaaaaatcatacaatatttgttctatcataatatatattattataaaattatggggcttacataataggattaatatcacaaacaaaccactaaattaaagtataatggagcataagcctctccctatatatacatggagattccttctctctatatatacatggagtatataggaggagccgtcctagaactgtgctcccactatatatggttgagggaggcatacagggcagtgttggagtcagccaaagctccggcgtctttcttaatcttatctatgactctatgagcacatgaggtgtctagttttttttcttttcaaggttcaagcatttcttctaattcccttatgcacaccttgctcccaaaccaattaagagtacatgagtgccccctatgtatattttggggcaccggaagtaccgagtggttcttgcattaaccactacttcctccaccagagaagagtgtatatttagatcttataaaagtaaaaaatatcgactaaatttagaaaatagca

SEQ ID NO: 3670 - DNA, 1233 bp, Zea mays
  misc_feature (1)..(100): optimal_loci_301465_G1, chr9:21968990..21970222, Cluster 22
agcccgtgtggccacacatgcttgcaggcatgcctttctcaccaaaaactacaccctgtgtgttgtgtgcatgtgtgtgaatgtgtttgttgtctatgtggcgcatataggcgggcccgaggggtattcatcgaataccccatttttgctaaccaacaaagatatttaaagggaccattagttatacatgttataagataggattaaatcaatctttttttgtttccttttgaaattttgagtataaattgtctaaatcttaagcccgccttttttgtatgtcagcgcgcgcacgtgcacgatgcatgcacatgtgtaaatagctatccttaatcaaactaatttgagaagtcttcaactatatatataatacttaatagtataatacaatagttaagaacatagcattgtcgataagcacatagtttgattaagcattgtcgataagtcttcaactatacatgtgtaaagtttttgtttcctttagggatgcgtgggtgagggataggagcagaaccacggtgtacgatctacattaggtgcttatagagtagtagtagaaatgtaatagttaagaacatagcattgaaaacatacaaaggtaaatgactaataatgacttgttcttatcaatgacactaaaattcggacaagatgtacaagttaataagagaagggacaaacaaaaaaaaagtaaacttacttatcgacaatgcatttgtaacatgaatgcaacatgtcatgagttatactagctagttagttttggttacttcttttgggtcttcattttattttattttttgaaatagatataagatgtcatcatttttaatggttgcaaatacacctcgctcaacatgacatgccgtcctaagattcaaccgttcaacataacacaccatttcttgttctagagctagctggaggaggggtgtttgtcgagttgcgaaacaaaaactttcggtcttcgttgagtagaggttagtccactagtcacctcaattactaaaaccactcatatatggagctttcgggaagaaggtttttctgttgggttgttaaataggaacttcagagagaaacatgatgctaaagtcttggtcctctcttcatcgtgcatttcgtaacaactaactcaccgaaagagcgagatctggacttgcagactatatataattctagttttcaattatatatacatcttaaaaaaggttggaaagttgaaattag

SEQ ID NO: 3671 - DNA, 1192 bp, Zea mays
  misc_feature (1)..(100): optimal_loci_306860_G1, chr9:57619088..57620279, Cluster 22
acattttattggaactaaataagttttttttggactttatggtgttgaggtgctcattgatttcttttcaaatgactctactactattctataatagtttggtggatgcaggttttttacatccagtttcatcttttggaaatcgataatcaatgaaagaacatattgttcctacaggttaatccattctgtcattatagcaaccatgattgatacactgactatgatacacaatgattatggtacttactatcaaaccttcatcatgcaaaatatgttgcggttgtgttctactctataaagaagagtgcattagtggttgcacagtatactaatggttagcttttatagttgttaggaataatgcatacccattatgactttaaacatgggtattgtgtgaaactcaaaggtttggctatttttacttaatagaatagtctacttatagaaaaatttaaccccttatccaccccaaaatggtcataggaaaatacatttattgttgaatatgtactaccaagcataaggtagtttattttggttctttcctatcaattggtaagtgtttattttcttagtattgtatctctattggaaaattctgattatatgttgcatgatgaaccaattgtattcaacggagggaactaccaaccatgtatagatttaaatttcttttctgcttttttagctgatatgcttttgattatggattgttggatttttcagataatgcgagattggtgaaggtagattgcatattataataaaaattatgttgttacacctcaagtcatccattgccataaatttctcatttcatttaatactatttttccattcgcgcaaaaaagtaataagtgccactttcttcatatgcaaacttcctagagtagaccttgaaatacttttgtgaattcccttctgattagtttgtaaaataaattttacacatgaggaatcaagtaaacgatgaacaaattacgtgcacgcatctaacaatttatttctattttcctttgtgatctagacttgtatgcaattccttagctatcagttgcctcagtcactcactccaaacatggaacttacatgactcaatttctaagttttgactgatttttcctctttttatatctatgtaaacacatagtgcatagactcgcgcgaagcgcgagtaatttactag

SEQ ID NO: 3672 - DNA, 1045 bp, Zea mays
  misc_feature (1)..(100): optimal_loci_307610_G1, chr9:62249602..62250646, Cluster 22
atgtgcatagatcgtgtctgttttatatatgtgtctgttttatacagcctatttgccaaacaattttagttaaatagattcactttcgatagagaatcaatcgaaatcattatactagagaatcagctctcggagctaaagaatcatgaagcggagctctaccaaacgagcccttaacttcttagtgttggatttttttattgactttcctctactatattaaagcatcagtttgtggttccatggtttccaccattgtcgcaccaaattgaaattgtaaaaatgctaaaattatgcattataaatagggatttaaatcatggttattggctctgaacccacattcacacccaccaagccaagaaaaccacatgtctttatgttttatattctatattaaatataaatgaaaatcgtagcaatgtatgagcactttgctagtaaaataaaattttaactcttcaacacaacaaaagtgagaaaagcttaactcagcaggcttttcagttttcggtttatttcccagaaaccttattccagcttttcaaaagcacaagccctatatatgtaactattatctattttttattattgtaatattaaatagcaaagtgcttctacaactcctttcttttttccctttttacttccaaaaatgctttgaatctgatctagactcttctcatgcatgaagttatatcattatattatattttaacatataacctagaacctggagattcttgatgtcctgcaaataacatgaggtcttcttagcctatcttgaacataccatgcatatggtcgtacaaaacactgtctgtagagtgcactatttacagagtttgtgtttaaaataggaggcgtgataggaggtggaataggaaagctgttggagatagccttaagctatctccaatagtcttacttatcgtgcttcctattttaatttaaactacactctgtgaacagtgtagtctgcaatatgcacaatctgctagtgacagtcttaatagcctgctagtacctacttctaaattagaca

SEQ ID NO: 3673 - DNA, 1053 bp, Zea mays
  misc_feature (1)..(100): optimal_loci_320824_G1, chr9:137342115..137343167, Cluster 22
cacatactcaatgcctcaacaagtgtcgtattgttgaacatgcacttctttggtgcatgttctccagcttttaagaatgacaggtggcctatgcaactcaatactccggaattgaggatctggtagatctcaataatatgtcaacactgataatgtacttttctttttcttactttatgtcctgtgtaacctataagcattaactccctggtctcaatgcccaagaagaaggaaaagacagcactaattcaaccacttcaggtttctagtcgataaattgataaactataaggggttcattttgacaggagccaaacagagtaagatatcaagccaggtagaaatcactagttcttcatgttataaaaacatgtgaatatgtgatgatgttgaatgaatttgcgaaagccttttctcattccatttcctctcaataaaatgtactgtctaaaagaaagtataaagttggttaaggcaccaacagttcctccattgcgattcatggtgttaacgcagtgtcatcaccatcttatcaatttaaactcagtgtcataaactagtatatccctgaaggtggattcttgttgacttcagtgcaaatttgcatttctgagtcactagggcagacccactgcagaggttcccacaagagtgaggtctagtgaagggataaattgaggctgaagggataaaccgaggcaagccttccccccacaaatgtggagaggctgctttgcacacgcgacctgatgactatgtgagatagctctcaccactgcaccaggcctgctctttatccctgaatcacttgctgtcattatatttaaattcacttgttgtggattttccacagtatagtagtgtactcatggtgacatatgattttcgggccacagaagaacaatctaatcacaggatgagtatcaacggtggataaaaatttaacgaatgcagctcagatcaattaggcagaaatgtgaccttagctgcaaacagcaagtgtcatcacgctaattttcttactaaagagcaatgtggaaagcaattgcaagg

SEQ ID NO: 3674 - DNA, 1247 bp, Zea mays
  misc_feature (1)..(100): optimal_loci_322364_G1, chr9:145498914..145500160, Cluster 22
gacgatgacagccagaactcaactatccacctccactcgaccacgccaacaacccttgcacatggccaacacctacacgtgaagtacaacaatcaaacatgtacgtgtttggacaatgacccctccaccctcatatgcatatatgcaaccaccaccacttgagcctacacatggacaatcattttttggtattataaacatgaatccatatggttccatagccttccatgtgtattatttttgtttggtcattaactgtttgtttgtcattcatgttatctcgctagttttatttcatatatttgtatagaaatatatatggaattggcccatacacaaatgtttcaaacgtgcctaaatattatgtctcgaggtaaatatatggatactttatcattcaacttgtttgaacatatgtgttatgaaaaaactttatatgagcatatatgtcattattgtgttccattccaatcacactttctatttgcatatgtgttttatatgtgattttggtgatcaaattatgtgtgaatctactagtattcattatgcaacgtgaattaaataagttacaaataaatcttgtcatttttttaattttcaagctcatgtaatatttatcactggaaaacactaataaaccggtcattaagtataatttcttggttggtttatacgaaaccgtttttaaaaagaaattggtcggtaaatttgaaaatcgctagttctggcttgattttttgttttccctaatgaccgagatttaggttaaaaatgaatcaccacttccttccgctccccaaagccttcgcggcttcgccacatgttgacaggcaacatcacaacaactatataaccaaaggtaaacaacagtataatacccaaaaacccattacatggtctctcaaagcaaattatttttgaagttttgatgtaaaaccatagtgttggagagtaccatggtatttttttaccaaaatatctttagttatcttaacatagtatttttggagtatttgaaacttcactccaacctaaagttttttgtctatgactagcttcttgcacatatatactaaataccataatttgaggtactttatttccaaacaaatattgctaacaatgctgtaaaaaatactatagtttactttatttccaaacaaatctttactaactattaagaaggtaacatagaccacttttgtgcccccgcctccccctctgctcgactcaattgcgtgcac

SEQ ID NO: 3675 - DNA, 1280 bp, Zea mays
  misc_feature (1)..(100): optimal_loci_322891_G1, chr9:147985005..147986284, Cluster 22
catggtggacgcgtcatactgacgaaaacgtagagtaggaagttcagagctggacagcgtagttggctcctggatatgttcttcgtttataacagaatctttacacaccaacagttaagcaggctaagataagaacatctctaacattttctaaaaaaactcttaatcttgtttttttttccttgtaagattggagaaaaaatgtcctccaacagctttctatcttaattcctaattttctgcatttgaaaaaattgactaggccctgttaggaagcaacctattttttaaaaaaaccagtttttatcttttatctaggagagaccagcttcttattttttaagaaattaaaaatctaatttatataaactaagttataaactggtatgtttgaaccacctcaatatttataaaccattttttaaaaaattgtgtgtcatgaaatgacttgaggtgaaaggacgtgggaggagaataaagaagcaaaataggattttcaatacaaatgaaattgacaagagataaagaaagtataaaagcgttatggtgatttaaaaatatttcaggatttctaatgtaaaattttcttctatatatgttttaggagcagcaggatttttaaaactatcggagaaagttgacaaatatactccctgtatttttttaagccactttaaaattttattaatttaacatttgattattttatcaatttagccattgatttttgaggaactatggagatgctctaaagagctgaatctactcttactatatatgtaccaaaactgaagtatgctcaagtccaaaataacttgtatcttttccagttcataataaagaggatggcacacacaattgcgcaacataaacagagctgacaccgcctacactagctagaatataaagcctccaagtacgaaggcacatcgccatctatccatgcatattatgatacgatggcaacgaccccacctcaccaacgaggcgccactcaccgtagattcattggtggacagaattggaatactcacaagtcacgagaatgttgtatacatggccgggaagtggccagcaatgcgcaaccaacggaacgtacaggggagtaggggacgagcaggagcttacagcaggaagctttcgagcaggagcaaccagcgccgccggctcaggatggagacgacactgtcctatgctcggctcccttctccgtgagaatgaaaaatgttaaacgcatctttctaccaaacagactattcatcctcgtttagctaggcgtg

SEQ ID NO: 3676 - DNA, 1231 bp, Zea mays
  misc_feature (1)..(100): optimal_loci_323175_G1, chr9:149474935..149476165, Cluster 22
gactatcgctttgggaggttaatatgtacacatcatttggagatgactcctagaaaaacatttaataggcgggtcttttctattttcagagacgagaggactgaccgcctctacaaaaggtatctactgacttaaaataagtcttcatctcctattttaaaaagtgaaaagttttaactttgataaaaatatatcaatactaataatattaatatttgtgataccaggtaaatactatcggactgatcacattatatctttctattgtaaacctattttagagatactaatgttgatattattatttttaaacctggtcagagttaaaattggttgagtccttaaaatgtgagatgcagactcgttttagaatggctagagcatttgctaataagccatttcttgacaccggcatacttagattatcttcaacaattatcctatcacatcttctatcttattccatatttcaatcttcactctataaacaatgtaatctacagtacaaatttcttattttatatgatctgctgtgaacaaccgcaccttcataaataacatttttagaaacaaaatgtctgaaaaagtagcaaaccatttttttaatcttgggacagaccctagacatgcaccttggacaaccatttgaaggagaaaaacaatagttttcaatatattgcttccataaatctagatgaaatgtttcgatagatcataatactactttatttttatactttacacaatgatatttctgctttttacgtccattaccaatttgttatgttcgttttggtttgttttcgttatcctgttagttccgtttttgattcgttttcaatttcgtttctgaaataaaatgtggaaggagttattccaaatcccaagcggtcctcttttttatccctagtaaccagtaaccacactgacccacgggacccaccaaccgaacccaagctgcgtcgcactatccttttgtcctcacagcagctgtgcggagaatccttatcatacgctccatgaagacgtttgaaagcaaaatatttttagagttttgagataaaaccatgatattagagaatatcatagtatttttttgctaagagttgtttggctatattataaaaaacttgttttgaataccgtggttttgtaggtaccatattatttttggagtatttgaaactccactccaatccaaagtttttatttatgactagccttgcacatg

SEQ ID NO: 3677 - DNA, 1269 bp, Zea mays
  misc_feature (1)..(100): optimal_loci_32559_G1, chr1:199758410..199759678, Cluster 22
atgcaaagcaagtgtgaatatccttttgccatgttttttatgatgaaactatttttcactacaattgtttttcggtttcttgttcctttcttttctctccccactccctacctacgattactgcataccagtaaattgtaaggaaactgttttccacttctggttctaacgtcttaatggttatgttacccatgtgtgcctttacaatacacaatggtttcaatttcacatcttattttcaagtggattttaataacactatcttcagttatccaagtccctaactacaattagtacataccagtaaattctacaaccacctatgaataactttactatacacatatgttccaaatttgcatccttttcccactggattcatgtggcattatatttgcttactaaaattcagacactccctacgatctaacaaatgtgttacttgctacataggtcaatcatatctaagcggtactacaacaagtgcatggtactttaatcaaaacattcatgaggcacaagactactacatcaagtaaagcacaataagtacaaaactcagaacttttagacactccctacttttgttttcccctctatacacatgctccttagtaatcttatgcatgtagttaactgcctcaacctaatacttaccaatattaatttttgaaacaaggttgtagtactacattcttcttataaccattttttcacaaatccacaattagtgcatagtgaaccatgagaaagaaaggaaaaaaaaggtctagtgacatttatgtggtccaaattgtcacattacttgaaggttacaaagcagtgatggtccaaattgtcacattacttgaaggttacaaagcagtgacctccaactgattaaacccacaacagcagtagaagttgaggtttctcaaacacctaatttcaaagacaaaactgttcaagaactactcgacatggatccagatatgttccctgtaattattgccaaatccttttatattccactttttaaatacaccaagaaatgagcttattctatttgtaacatactttttaccttatatgatgtagccacaaggctataaatgcattgtcactatctcacgactcatacaagaaagcaaatggtggttcctagcttgtacgagatgcaaaaagtcttcacctcaaacatccattggatatcgttgtacattgtgtggctatacagacataaaatttgggtaaccctgaacatacacatttgatttgtcatagttcatt

SEQ ID NO: 3678 - DNA, 1111 bp, Zea mays
  misc_feature (1)..(100): optimal_loci_326752_G1, chr10:11803598..11804708, Cluster 22
attgatgagagaagccaaatcttgattatagaatataaagtgatcccaagctttgtgagtttgcctttgtggcatcaatgagttgagaagcttatgagagttatcctaatcttgatcattgagaaagtcaaggatctttggtttgttgcactcactctcttgaaaccttgttcctaggtggcaaggagtcatcaacaagcacctaaggtggtgtggactgttgtggtgaaaattgcaagaagggctattcttcttgttgaaaaaggaaaggagccttcttagtagaaaggttgaaagagaccattttgggttcaaccccaagtaaactttgtttgggtaactcaacgactttcacaatggagacgtaggtaccttagggtagcccgaactctagtaaaacaaattcttgtgtattttcattggtttgcctcgtatttattcatattggcttctgtttacactaatagaatatgatgatttgagaccatagaaaatgtgtggaagtattcacctatttatataaaaaactatatatcaagttgtatcaacattgtaagaggaggttcaaagtttttagcggacacagtcagctaagccaccatgtatatctggtcaaatcaattttggcgctataatgatccgacaagggaaaccttgtgtggccaaatcctatagttggtcaagccaactttcccaacgagctctattattagttgtgtttatgttaatatttcttaagaaaatttatagagcgtattcaccccctataagcattgaacccatactttcagttttctttaaaaacaataaatctaatcattttttctattctttgacgtaaaaaataaacttttaaataaggaaaaatgatatgatgtacacatggttataaattaatgcatgttgaagttcaagaaaaaaatagtttgacaaacaaaaataatccaaccggggtgagagttcgttaagctaaatagtaagctctttttatgtagttttttatttttagtaattaagttgttattcctaaagttatagaaaaaccaggacaaatataacactcaattatcattttttgtttaaaattatttaaattttggataccgttaga

SEQ ID NO: 3679 - DNA, 1043 bp, Zea mays
  misc_feature (1)..(100): optimal_loci_327218_G1, chr10:14522456..14523498, Cluster 22
tggccaaaagtgcagcaggaagccgctggcactcctggctactgttcagacgcaggcttagaatttgaagggtgagtatttaaaattttagcggagcataattttttggcaacctaaatcttactataatagtctttagacatatataattgattatagtattatatataagttgtttgatagcatttaatatatatagcatataatcgaatacacattacacaactagcaaactagatcataagttcataactcacatgacaaagaatagatcataaaagttgacaacattcaacatatcaaagtattaattatgtcgacataatgaagtggatagtgacaatatcttaaatatatagaatattaaatagcataagaaaaattatatattacaagacaacttttcattgcgcatgttggtagccggccagccgcatcccctgctctcgggcgtctatgcagagctcagcaggataaggagtaaaaagtctgatagcctattgtgctgcttgatgggatgcaaggtagagaaatgaagaccagtgaaaatcaaagtttggacaaaatagctataaaaagtgttattttatatttaatactatggttttttatgatactatattatgtggtattggaagccaaaatatgtttgattggtacagttaagacatagttttaaaaatcatggttaccaaaactgtggtatttttggagttttggaaactccattcaggatctcgattttcttatgttatctctacgaatactttggttttataatgaaaccaaacacatataagttattagcaatattgtggttttatcgtggtaaggtgacactgtagtattgtaatattaatatgatgtacaattgtaaattatgatattttaaaactacattactaaacgtgccctagatatatacacgattttttacgaaaataatggtcacttgaatactcttgctttccatgtaggcccgcccctggttgcctcgagactgacatacattttgctccaatccatacgtacatgattaaaat

SEQ ID NO: 3680 - DNA, 1048 bp, Zea mays
  misc_feature (1)..(100): optimal_loci_336212_G1, chr10:73219434..73220481, Cluster 22
taaggttgtttggtttatagtcaggattgtgacagagccatcataggagaatactttcaattcttgtcgttctcagttatcccttaaaatcggatggatgagtctgttcccccaagagacgaggcttcttacatcccatgcatgtgtatttattccttatgcctcggtctcattcctccaaccaaacaaagacagggatcaatacatctctacctatctctcaaaccaaacaaaaaactcttaatattccatcccccaactaaataagagtagagatcatttcataccatcccccgctgttatggtgttgttaccgccttgtcaggttctcgtaaaatctgtactacaactgcccaattactccacacttagatcaggccacctagcgaatgttggcctagcaaatgtcaaggtcaactaattacatttcaatttataatgacattgaaaggaatatgaccaatgctaaaattttcctgatctccagaatcacatttgcatctagtagagtatatcgccaacataaaaacattattttattctaccatgaaaagaagtcactctcaagtaaatcaagttcaaatccagcattaaatagcaactttgtggggggggggggggggggggggtggtgagatgtgatgcatagaagatcatatgacgctggtcaaaagtctagggtgcacatgtattgttgccggcttaccgctgattgccgtttcggttcttttgatctttggcgtgacttataccaacaaaaaaagttaggtatttttttggctgcaatctaatctacattaataaatataatcagagtaaactatactgcagtcaaataaaaaattgcatcaggctgtatggtttaggttctactagtggagaggaggtgaaaacagcgtgaaacacgcgccgaaaatatactttctctattctaaattatatattatttttaaggttgttcggttgtgtctaaatgaaaaaagattggaaggtattaaatctcttagaaaaataatgctgcatgtacaacgatgtttaatgtagagac

SEQ ID NO: 3681 - DNA, 1266 bp, Zea mays
  misc_feature (1)..(100): optimal_loci_338912_G1, chr10:87163127..87164392, Cluster 22
ctgagaggtcgagtactcatgagacatattcgatatgctgtcggataggttatcagagaggtatgcagttgtatactcgagtgctatactcactagacatatccgatgtggcactggataccaatgcaataatggctagttttttaaactagttgttagaaaagaacctgatgtgtccggtagagagattgagtgtgcaccgaacatgtccgttgcacttaactgggctgagtggagggtaacaactagttccttttcttaggactatttatgcccctaacttgttcatatgaggtctcttgctaatttcaattgttaattaagaaaatccatttaagagtgagaaagaaaatttgactagtgagggacttaagagttgataattacttaattagtgacctcattaatatattaagggtggctcgtgtgtattcatcacctcgttcagagcttcagaaggtaatgggtgtaccatagcattgtaaaatttcataatgattctataaggtaacgggtgtgtcgtagcactgtcaaattttatatcaaagttgtgtgtctagaagacttgaagagatctacattttgtactagtttgtatctttctcgaacaagccgttttaccccccattttaataatttcctacgccattaagttgctcctgaggagctagagtgacgatcgtaattcataagagcaagtataataagttgatgtaggtgggcggcaagagataccatgtcagatttatggtgatgtagaaggaagagaagtggagagagagagaaagcatgcatgtttatcactagtagccggccgagagtggttgcacacggacttcaagactctttgtgagagaggggtggaccaagtattaaatgtataacttatattatgagatggttattatgtgattaggcttttagttggctatattttacatggtaatatcataaaagccccactatagactatattattaaacttgctctaaccttctggccgccacagacatatgtcccaccgttttatcagtagctcccatgtgcgacatccctgtacttgtcgggtattgtataataagcttaattgatgaatcattcgcaggagagaagtaatcatactagagattgaacattatctaagagtttatgtcatgttctagttaagattaaaccatgtcaacttatgtgtatgtactccaattaagttcatctagtttgtaggtggcagaggttcctaacgcaaataattaacgcaccacataa

SEQ ID NO: 3682 - DNA, 1326 bp, Zea mays
  misc_feature (1)..(100): optimal_loci_338914_G1, chr10:87165570..87166895, Cluster 22
tagggtcaatggtctgtttgttagacgagatgtaagggagcaaaacatatctactctatatgcttctcgcgtgacaaatgacacaaaactcgtgctttaaaagagcgaagatgtattatcaatcactattaaaatttactttagtactggttttaattcaatcgataagaatgttaacaattccaaagccttttttagagtagtgtcgcagtgacgatatcgtaggcccaagccatcgtacgggcccgtgcaagtgcaagtggggtcgtcgtttggttggttgcattggtttggacgtcgttgacgccttttatggtttgtggtgtgccgaccactaccagatacgatggagtagctagtacgatcctgccgactccctgtagatagctaccacatgcatggccggtgaccaccacagtgtttcaggataatctgtcggttgatgatttctggtccaacaccatacttaaagaaagctagctagagaccatgcatgatctgtagaggcattatattagattgaagacatcatggctgatcagattcaatagcatttgagcacggggcatccgatcgggcaaacagattcatcaaccagagctccttaattaatttggccggctgaacctatctaaatcttgtgtccttaattaatttgtgctatataccatcacaattattattggcgtatactctacatcgccggtatatagtttatgagcattaactatttgctttactgatggtggcctacctgacctgaccatatatatgcacacaaatttttcttcttcttctttatatatgtgtgtctgattgaggtgaagctcatgtgaccatcatgtgacatatgaaatgaacatgcatatataccttgaagcttgaatcgatgcatgtcattgtggggaagcccgacaagaaccggccgtcacatgcgcatagattatacgagcagagggaaagattttaggcagtctggcatatattgtggggaaacactacacgaggtgttttgttcgagtaatcactctattcaaaataagataatacatcatgagtaaattcctcaacaacgtgtttagtttgatgaatgagtcggtctatcatcttctcactccttatctttttatttggtttatggaattagttgatccatcaccatttcataataattattttattctcataggctaataattagtaataatataagcaatgaattcattccaccgaatttatagaatggactcatgatgcgccagctcatctagaatgattgattttttaaaccaaacacccccaaatttggtaggatgacccatcctc

SEQ ID NO: 3683 - DNA, 1214 bp, Zea mays
  misc_feature (1)..(100): optimal_loci_340122_G1, chr10:94032505..94033718, Cluster 22
tctcctaaaatatgaacagaaggccatatatatatatatatatatatatatagaaaattttataagtatagtatagctgaggcatgattttagtcactcaaataacttaaatgtgtattcttccatatcaaatactaatgtacaaagagtatacacaatgccgatctcatgttctagagaaaagcatcatccatcatgtattttttgagatgaattcttcagttatatcttcataattaatgggttagcaaacagcgacggttctgtcactccatgtgatgataatattcctattatactagtggctgtcgcgcgtagtgttgtggaagtaaaaaagaacacaaaagagaagccggatgaagactccagaaataactggggacacgcaagccaatttgtagagaaactataatcttacttcagttagtacatgtcacttttcctggctagcatctgataaaatatgacactgatgaaataataaacctaatagcataaatgaggtaatacagtttgagcagcgaggtgatgcaaatgaaacaaaaacaaagcaaagttatagaaggtagttgggggaaatacactgccagaccgtttcagataaattttagagagtttaatatttcctgaccttctctttctcccgctaactcttcccatcctatatattatcaaagattaaatgattttatttctagacatcaggcgttatagattttccgagtaatgatattgtcagtgcccccactttgtccaagatattacagatgcagtaacaccaggctagaaattaagatgacaacattttacagcctgatgacatggggccagtaagaaactgggcgcataattgtcgtttatcttcacgccacctcctcacagtgtcatccaactctgaaaatgcagaaagaagaagaagctcaaggagttcaaaacattttacagcctgatgacatggggtcagtaagaaactgggcgcagaattgccgtttatcttcacgccacctcctcacagtgccatccaactctgaaaatgcagaaagaagaagaagctcaaggagttcaaatgctagccgcttcaaaaaaatctgggactatactgtacggagggaaaacccaaatagaaatgtaagctgacggtcatattactgatgtggctcttcttttatttcctattgtttctcaaatgtatattgcttactacgttccatata

SEQ ID NO: 3684 - DNA, 1192 bp, Zea mays
  misc_feature (1)..(100): optimal_loci_340357_G1, chr10:95207906..95209097, Cluster 22
aagactgttggatgcggtctaacgtgtcgcgctcttggagatcactgtgcgtctgcgttagtatgcaaatctcgaaacccctgcggtcaacttggccatgattaaaggtaaaaagagaggactgaactgtatgtgatggtaacaacaccaacaaaaggaaacgcgtacgtcctctactactgttgcagtatcggaaaatcatctgcaatccaacagatatttttcagccggccaacgattaatcagtcgttgctacgagaatgtacaggggaacagtgaaaccgaactttatgaattctattgcagtttttatgtagcaatggacaacaataaaaccgtttagacttctggaagaacaaagcaagacattgtcttttatatagttagctaatcattccatagtttaaaaatactatagagccaccaaatgctagcgtgtgtttgtcccggattcgaagagggcaccgtgacaggtgtctgacctaccttccacatgtccaacggtatggggtgctggctggtttgctttgcagtataaagtcaaaggtttccagtgtgggctggacaggtgatggctggtgtaaccgtgtaaagctagatacgcatattagtatagattaattatactccctccgtagtcgtcctaagtaaatcgctatcaactttgaccgtgatacctgatgttttataaaattttataatataaaaataaaaatattaaatttatcgtgacttaaactattataatatataactcttttagcttaaaataatttaattatatagatatatattaagttaaaattaaatagtttgatttagaacaaagccaaaacgattaactcatgtacgccgagagaataattttttagttggaggcctcatgcatgtaatcagtgacgtggtgcaatgatctcttgagagattgcatgccacgtggaggatcactggtataaatggagatgacgtattctgccaatcggcggcaaccagtgcgtgcattttctagccagatggaccaacttttgtctgacatcactgctggcgcaaatacatgttttgagaattgttggttccttctttgccatcacagacactttggtgctgtttggttcaaaaaatgtaacgtaaatggtaatggtaatggtttcggctcgattactgacggtaacaaatttgaataggctgtatc

SEQ ID NO: 3685 - DNA, 1138 bp, Zea mays
  misc_feature (1)..(100): optimal_loci_342106_G1, chr10:105303547..105304684, Cluster 22
gaccctggcgcccggtcggtagcctcaatgatcgcgcgcgcttcggccattgttggagccatgatgagtgatatcgatgggtgccatgcatgcaggcgatatcgtccaaagctcgatctatccttatccttgctttagagtggggactagaaactatatcaggtgtaatatgtctttggtgtatatagtgtacatattgaattgtgattatcaaaaccaaatttaatgtgctctcacacctccctttcagtcttatattctcactatcccatttattaagccgtacatgtatttagaaaagtcaaccttttaaatctttgactaataatttagtctaaacatatatttttagtttatgcatgctatttatttggattcatatacaaaagttttctaagatgatagtatttttatatttattgatgatatattctgaaaaatatgaaatgatcaaagttttgttgtaaagactgccaaaaacttacacgctctaattaatgggatagagggagtatattttacaaacaacttcacgatttaagataggcaccaaaggctctctacgaagaatttgagattgagtgggatagaggatatgtaatttgagtgggggaggtggatgccgctgccgcctgctgagctgccgcgtcttttgcatagccaggtcagcctttgctccctgctttctctctcacgcgttgtgcgcgcgccgatgccatgcaagggtccttttcttttgctggcagactctgtttttcagggaagtagggatcgatcgagcttcccctttcacacacaattgcctatccatgcagacatgcagaagtgctcccttcgttttgtttctttatataccagagcacaggatggaccacagtccacagtatattcgtcctcattcatgtacgtactctccatgcacaaatactacctccgtttaggaaaaaaagatacaatttcgttttagatcaaggcttactaaatttttaaaaagtatcattaacatatatgattcaaaatacatataccatgaaaaaatattttatgccaaattcaattgtatttatttcatataacacatgtatatatgtatgattaaatttaaaatggtcctacttctcaaaaaagtataaactga

SEQ ID NO: 3686 - DNA, 1008 bp, Zea mays
  misc_feature (1)..(100): optimal_loci_344806_G1, chr10:119761412..119762419, Cluster 22
tgtccctgatttgctgtctatggtactcgttcgatgacttggcatcaactgtctatatggcattttctttaccacggtatcgactcggtatgcttctacctcagtccctgattgggctgaccttgtgttgacctcggttcttcactagttgtgctcgtctactagtataactaaatagctagtaatagtgctaattgctggaatattttctaccttattgcttgagtgattgattgatggtgcggctagcatcgggtgcgcaaaacaaccgaaacaagtatggccatgaacacggaaattttctgtgaaaagagctttcaggattaaaaaaataacagcccgacaaaggtgatcttcaccagtattcagggtctatttggattttggaccaccttagattacagtaaccaatctgacaaaaataatctccaggtgacctataaacacccagcaaaatggactgtaagaattatataatgcatctccaacctactacgagagattcaaggttccaaactagctggcaatctttgatccagattaccataatcctaatcatgatctagattttgtagtaagctaaagtgaaccaaatggggcctcgatatatttggaaaaaacattacaatgagttgtctgactcatcatacacattacaagaggaatatttatggtgatacaagataagagttatgcagaaacagttctgctaaacatattgctcagtgtcttgtcagccgaaactcttatctgatgatgattaaaactccatcaaagatgaattgatcactactaactcaagaacacaatgaatagtctatttgtttttatgttatgcaattatcaggggcagatggtctattatggcttattatagcctgaaccataccatgtctgaaaacaaaattaacagatatgtgacccaattctcataagaccacaaatccacctgtccactcgaaacagctgacagccctcagcagccagcctctcacacggtcacatccc

SEQ ID NO: 3687 - DNA, 1358 bp, Zea mays
  misc_feature (1)..(100): optimal_loci_347361_G1, chr10:134587949..134589306, Cluster 22
ttttacatacctaaaaatttatatgatggatatttaatatatatgaatattaattaatatgtctacataaaaatgtactagcaaattctttccaacgaggcatatatacaaatagtaataatagttctttctaatgggacatatgtctaaagttataagtagtatagtaatatatagaaatattaatatgtgtacattaatttatacaaatggacaatagtagtagttcttgaattgcttaggtgttctcaaatggagtagtttcttcatctttataaattgtgatttacaaaatttattgataataagtattattatactaaatttatagcggagacactttacatttaactaaacatcacctagaacatcactcatagcgattggacaacagtgacaaggaggcaaagtgataaatagacaaaattgttgttggtttcactttgtctcggttgaggtgaacttacccttttccgcaaactagcccttaaagcatgacataaaacaatatattcaactagccctaactgtaagagctagtctacttaagcattgttcataatacatcacttattgctctaagggtgagttgctagtttgatgtattttcttatttcctacctaagggctagttcatgattcaacttcttctttatttcacgacgatccatcgtagcctttttttctatagaaaacatataaaatcatgttaagctcaaaaataatggatatcctagttaaaataaccctaaaaccaacaactttaagtcatgatcctaaaccctaaacagtgtaggcattatggaccgcaagacaatggaaaaacatgggcaaacaccattttctatatatcatgcttgcatgtgtgtaggaaatgcaaactccaatgccactatgctcgcatcattttctaaaccctaatgcaatattcaatgcaaactctaaggtgtggtaataacagaaggtgtgtaggtgcacaagaataataccagtatttgagtaatcaagaatatgttataacaaagcttcagtttcgagcatgctcaccagtggaacggggcagttgcatgtgatggcaaggtatccttagacttagtggtgctacaagctcacgaaaaagaaagacttgaggaatgcaaaatttatagggacaaactttagtaccattttaactaagaactggtactgaagattgtttgagcgggaaatgaaagttctaggtgggaactaaggaaaacttagtattggttctttttaagagccggtactaaaaacaatgaaaaacattagtataggttctttttcagaacctatactaaagtcgtgtgagcgaaaacaaaaacttcaaggtacgaccg

SEQ ID NO: 3688 - DNA, 1207 bp, Zea mays
  misc_feature (1)..(100): optimal_loci_347747_G1, chr10:136620657..136621863, Cluster 22
cctctgttccatagtgtatattactatcctgtttgcggtcttgtgggggaaagaaagtctaattaaatcccgaaaaaaaaaacaaatgtgtaacgattatactataagtatgtaaccactttcaagacattaaaacatggtcagagaataaatatatgcgacagtttttctacgtgctagcatcaaaattaaggcagttcttttgatgtgttttggaggaattttgctgggaatccgaccgacgtaatattatcgtgtgtgtggcagagtcaatgcttatcttttcagatgcgtggagaaaaattatctgccaaaaagaaccgtttttcagacatggggtgaatcatttgtaataaagtgaagagaagagattggggagagggagaatatttggcactgcagccaccatggacactgcagccaccatcgtcatctccaaattttatcctctatgctccatcttctcaaatttttcactaccattttaatacaaatttttccaaaatccacaatcgaagcatgtccagcaaaacaaagagtgtggttcaacaccacttatcttccacttgatgttttggagctagcaagtgagttgcacagatactttccattttcctgaataatttgagacattacgtatatcttgtgagaatatatatatactagcactaggtattttaatttgaaatttgctagaataatatcggagaagaaatttagtgtatataaggtcttcagcaaattggcctgagtagctagttaactacagttgaacaaacatttaaacaagggtcaaatttttatgcgtgactcggtctaagtcaagtatcattatcgattttattttactataatgtaatacggagaagttggaaaacacgcattattttgaatgttttctgtggtttcagttccacctctatctggaattggacgtgtgaaaatgcttgctcggagtcatgggcaggacttaataagtcaaaaaaaacaccgtggtcaaaatgtaggtgtaatggcagtaacttatataaacttgttctaataatgcgacgtgttggatatatatgcacatggaaggttttgctttcaattgaccggataacaaagcccaacccaacctgcacatgtgcatgcaatttcttatacacaaatataatcatttgcatctatgtattctaaatatcgtcgtatgaaagatttcttaaca

SEQ ID NO: 3689 - DNA, 1322 bp, Zea mays
  misc_feature (1)..(100): optimal_loci_349892_G1, chr10:148122432..148123753, Cluster 22
acttgagttggcgtccttgagatcccaaagttccgtgagatgctccgccagtcacctttgccaaacttttcaaaccaaggaggaacaatctacaaaatcaaaatcaagttatagagcatttcaatagcaatgcagcagatcctaggtggatgaaacttttgagaatttaagttgtattgtatatgtccagcctctggaagaaagaaacaatgtttaaattaaaattttaaactcttgcatgcaagttacttatgttaaatctaatcatctagaacattcaggtttcaggaggaaaaaaaaggtgaatgtgtcatctatgatatgtgacaaattgaattgttcttatataaaagataatactcgacggtgtgcccacgtcaaatataaagacatctctttaactatatgcataacatcacatacttgggaaatggttgcattcttaaagctgtaactactatttaatattacttacttccacccaacgcttatgcttcatcattaaccttatgtattttcactttctaattacattcaaacacaatttcagtcattctcaaccattaaaacacaagcgtggaaccaatctttttagttcaaggaaacgaacccatcttttttatttgacaaaaagggggactgaatcaaatatgtcacctacctaaccgaaatactatcaacaaaccaacgacaatgggtccctacttgtacataccaataaacaagaattactttgggtggatatgaaacttttgatatcataagttacactgcatatgtccagcctccagaagaaaaggacaatggttttgctgaacttttgcatacaagttacttatgttaaatataatcatctaaaacatttagatctcaggaggaaaatgaaagttaaacatgtcatctatgatacgaggccatgtagattgttcttatataaaacataatagttgatggtgtgtgcccatgtcagtgataaaaagatctctttaactttatgcataaacatcacatacttggaaatagttgtattctcaaggtatttgtaactactatttacgactacttccaaccaacgcttcggcttcatcattagtgatatgtaatttcactttctaattacattcaaacacaatttgagtcattcaaccattaaaatcacaagtgtggaaccaattttcttggttcatgaaagaaaaggaacccatctttttttagaacaaaaatgaactgaattaaacatatcacatacctaacagaaatattatcaataagcaacaataatgggtccctagttgtggataaaaacaggactacttgtaaaa

SEQ ID NO: 3690 - DNA, 1173 bp, Zea mays
  misc_feature (1)..(100): optimal_loci_35342_G1, chr1:214303352..214304524, Cluster 22
ctttcgagaagggttggttattagagacaacaagatccaagaaatgttggaggtggcaatgaggaagatgacaacacacaataatggagccctagcacttgtctccagctcgatagatatgccgaggtaacttaggttattactaaccaagtggtcactctagctaaatggcattaaatgtgtttggtcttttgagaagggttggttattagagacaagtggcatgagttgtagtaggaccaagtgagtcaagacaaagcttgttacaagtattataataatacacattatttaatttgagcaaatagctaggggagccatgtgaaccacttaaaatctaggatacatagaagagtatcattagtgtgcttattacagacatcatcccattaaggttcaaaaggtggaatgggaaagtggatgacccatggagggctcatcaaagtcttaaggatgatgtttgaattaagttgaaacagtatttcacttcccatgtggtgatgatgagggatcaagaaccgcttctaacacaccatgggccggcatcacactcaagaactttaggatggaaatgaacaagttagtcgaggaggataaagagctagttcgagaaattagtacacaaattagcatgacttctaggaggatttcaagcaatacaagttatctgatgatgtagggaagtgtgtgctaagaataaggcaaacatgaataagaaagtagatctacattggctcagctcatgtggctaaattagtaaaatgcctgtttgggacatggaagttgaggcaatggaacaacaaagtattacacatcaaactggcaagtgggagcctagatttagccgagagccatgttcaaagaaagacagtatatgcaaggaagctcaagatctagggagataaatatggcaaagatcctatcaaattagaagataagattgatatccatgtagatatgataaaacccggatgataagagtgaaacacatatattgatagagataagctacccaaaccaggataagcttggttgcggtttccttgttagattcaatcgttgtccatatcctagagttgattaggatcaatatcttgcaaacatcgtccctccttggactataaaaggagggtcgaggcgacctcattgcataggcaataaacattgccaaat

SEQ ID NO: 3691 - DNA, 1378 bp, Zea mays
  misc_feature (1)..(100): optimal_loci_36469_G1, chr1:220062546..220063923, Cluster 22
gtatacaaattaggcagaaaaagtaccattcttatgaccatctcaaataaatatctctagacaaattcaaagtaaccatagatagcaaggttaacatgttatgccattccattaacttgatctcctaattgtgcggcgaaaagataaattaagattcgtaactgaaaaaacatctgccaccagagcagatttgttctgcacaatattaaagagatttggaaattactcactaaaaggacggctggttaactatttatcctttcaaaatctggtcgtttgaccattcctcactttaaagtaaactcaaacgatgtgaactcttctctttgtagtttgtatgaccccagggcccaggtcggtttagtccttttggcaatatattcaggcggggatcctcttccacagttgacactcaaaaaaaaacttaagatacacattaacacatgtggtttaagtgatcatgagactgataaggttgctattttttgtagtaacaataataacgaataatggtttttatgaactatttatgcctgccgtaatttatttcatttccagattaactccgagatacgatgacttatgtagaacactattttttttcttagtttaagtatgtgatgcctcacctcttttagtacagttaaatgtttatttaaacatgttatctattgtatacttgtttaaatttacctataattatcatatgacctcgatgccaatgcattgtcaaaaaggccaacaacagaacatggcaattcctctagtctagtaaaaaagggccaacaacagaacaggacgatactgtacagaagctgtgctggccttctaattcatgtttcctctcagaagtttgtgttgatccagcggtggagcatggcctcagttgcacacttgcactgcatggccgcctgcacaataatgtgcccccatttgtgggtgaacttattacttccagggatgagggacctcaagattaacgtgctcaatcattcattcgcggccgtgacaaaaatattctttgccgtttggaggttggaatgtctcacctgattttttttggctgctaataattcgataccgtcgccggattacgaatgcaaatgataggatgatgtgcaaggatgcgtgacagcgtcagtgagtatttcggttttgtcactttcggttttaagtttgcaaatctctgcagattacaggcattgcattgcattgtaacttttacaccaccattactagtataatacacatacgttgtgacggtacaccaattatatttgatggtatgcaatggttctataacacgtaagagccaagtgataaatcagtataatggatctcccaaaaaaaataaatttaaaattaaagtggacccatt

SEQ ID NO: 3692 - DNA, 1147 bp, Zea mays
  misc_feature (1)..(100): optimal_loci_38817_G1, chr1:232338757..232339903, Cluster 22
aaacatgatcttttatgcattctatcttccaaccacgtgtagttgataccaagaagtagatgtacagtctgacctaatacacaaaccatcacactcacaatagcctactcgttcggggcacgaacactacaaaatgatgtacttacacctcacatacggctgtgatctaaagagcgagaggcagaggagggataacacactaatggtgtccgtatgaacagtacacatcggaattgtagtgccagctagattatttctaatcatccctaaatgatccctcactttactatagagatgttaccaatggactatcaagctcattaagactctaaaggcctcgtgaatcatgtcccatctatcagagtctaataatggatccaatccaactatctttaggcatatattcatcattctcatagttgcactagagttaactattaaagtatctttatattcttacctcttaaaaatgaccttgtaggttcatccaaccaacagtcatgacccaaaaaaatattttcgatcaactattagcattgaccttataactcttaaaagttcatgaaaatatatctcgcaaaacctatgccgctcatcaatgttgtctttctgccactcgacacctagacaagtgcaaggcgagtgaagtgctaccctcgtcaattcggcgatatctcgcaccacaaccaagaggtgatgtagagctatgtgttcatgatgtttagtgggttatgcgtttgtaatcttgttcacctttgtgttcatcaatcgatgagtagtgagagaacatggggtattacatatattacaacctaaatatctttaaactatttgtgtggtggctcctagtcgtacctaggtttaacacatcgctgacctatgccactttctctctcctataaaacccttgttttgagtaatttacatgcactagtgttattttattcactgtatgaacaatggataaatcactcataacaagtaaaagtgtgtctacataagatgttaaatctatcttaaacacatctagtagaaacaaggagtgagaaagtcatcattactcacaactggattgctccatcctagtcgaagatgagttcgtggtgttgttaaagtccatagacattatactacagatcaactcggt

SEQ ID NO: 3693 - DNA, 1115 bp, Zea mays
  misc_feature (1)..(100): optimal_loci_40008_G1, chr1:238347084..238348198, Cluster 22
aaacacacatgaacatgattcgttcatgtgagtgcactaccgtctacacgataggaacacttacttccaacttcaacatgacctcattgagcacattggctcaacttgctttaggggcatcatactagactagttgcccatttgcattacacaacattctaatagtgatcaagatagtagtgttttcatcaatgtggtagcagcaatcaagatctagtactctctatcgtcgtttgtgtttgtcgttgtttgtatgtctgtcatgatttgtatgtgtctatgttacaaattagatctaaaaccaaaagttgccaacaaacgcatcttggtttgatttgtaccattatgagataaccaactgtaattccatatccactaatgttgcaacacatgagcacgtggtagacttttaaaatgtttgttagcacaacgacatcaaacaaagctaacataatgctccgataatagataggcgtatgcggggagtttgtttattaaaagtaatctgatgaactactgcaaaaacataagtcaaataaatacaaataccaaacttgtaaggattgagcgcaaccaagtatataaatatttggtgtttgcagcctcaaactccatggaaacttcattcagtattagacatgccgacttgaaccttgaacatgatctattgctttagcttcttatagtatacacgttgagcaggattgcaagtgaactattcaaatgccaagatacattcctcttttgccttctagtcaatccttttctggtgttccaaatgctcttgtttaatggcccacttttctttctcaatcttcagttgttgtttacgaaactcatcagtcctttttgccttttgtcgctcatatgccacaattgtctagtaagccgacaacctttgcagagaaagattacccaatttagcaagatgctcatctaaggatctcatagcagttgagctagattgggtcttcttattttattccttgcttgcttattgacctagagatcgattcaatgttgtgctgccaggacatgagtcttcacggtttagctcgatggtgttagacccaattagtgtagcttgaatgctctgaacttgttgaccagaacta

SEQ ID NO: 3694 - DNA, 1272 bp, Zea mays
  misc_feature (1)..(100): optimal_loci_41007_G1, chr1:243213425..243214696, Cluster 22
gacaaatttactcgttggtgctagttcaaaacaccaacacttacaaacttatcttttgtgatgttttagagctttacaatattgttggaagacctaatgaatttgtttatggtgaaagaggatatgggtcagtttatgaggttagtttatctataacactcatggatgtgaatttataggaagcctctgatagtaattttcctatgttgttcaaagcaaaagggtatactcatgttttttaattgtatgctagaaatgtttagtttttatgttcagttcgtctccatttttgggagatgtgaaatacttgtttcgattattttcacttatatcaatgtaagcacactagctacattcactatattccctatggctttctttaacgcacggatgcgagggatctggttccttccatctatggccacgtgcgcggggagaatcatgagtggccgttgctgcaagcgacgatcaatcttaccttgtttccaccccaccatgtgtattcttttgctcaaatggagaatatgtgtcctagacccaagagttctaggactgacaaattctaggcatgtgatcaaccagtcggatacggatggtctactagtggattaatataatatcgtggttatgtaataaatattatgtttcgttattaataaagcaaagtgttttagcataatccacaatatgatatcactatacatgtgattcttgatccgattgcatgtatagtagacttccagttttatcctttaaacctggtgtgacatatggctatgtacacatgaacttattgtgtcacaaacttaaggggttatcatagtttcatagatgattgactctagtgtaagtgtaagattgtaggttatttgtcgaaaagaaaataatggtccataaagaaagttaatggatctttatgataaaaggctattagcagggatctatgtatccaaatgaactcgtgtactagtgtatacatcccacaacctagctattatcgcctctctttctatgattatgggtgttccagccatggtcgtccttcctcttactgcaaacatggtgctagcgtatcggtgtcacgatgtttcatcctcactcatgtacatgccgactactttggagatgttgctgctgcggtgttgattggcaataaacataaggagcaccaccgaatgtgtcatttctactattaggcaagaacatatgattacttttactatatggacatacttttctacggttgtattatgtgtctagtgataataatct

SEQ ID NO: 3695 - DNA, 1048 bp, Zea mays
  misc_feature (1)..(100): optimal_loci_42030_G1, chr1:248316233..248317280, Cluster 22
agcaagatcatcgacactcggtcggtcggtatggatgtaatggaggaggatatggatatagaaagatatgttgaggagtaagggatcggggcgagcaggatcatcatctcatcgatgatggataggaggaacaccattgaagaatacttgccccacactagaaggacgttgcagaggttgctcattgagtaagtccgtgaacatatcaaagttgggactcaacctaggatccatatcaaatcggagattgtaaagctattgaatcgaaacggagagtggaacaccacgaatggaatagaggacttttgaattggagatgaatgtgtgtaaataaacccaagcacaaagcaccccctctatttataggatggattcaagttttttagattttttttaaaaacttttacaatttgagtgaataaaatagtgttgaccaatcagacgacgccacatcaacaactgacaaccgttaattaattgtgtccgtcccaacacatcggtcgataccaatcggttcgaccccacagtatatccaagccgaccagtcgacagccttagctgactagtcaatcctaccgcccgctattgacttcgccttggtcggtaccgaccgtggactgtgctatgcttgttggatctagcctaaaaacaagggtcattgtcgcttatcaaaatattaaataaaatgcttttcaatatacatatatatatgaaaaaattattaattacaatatataagaatatttaaaaatataaatattactattataaatctagttcttttaaaaaaatgacgtacatagatattataatacgtaatatttattcatgatggagagtgtatatatagaagtattctccaacgacgaagagaacatatataggagtatactccaatatggcaatggcgtgcctgtcctgcgagtctgcaagacaacattttgtttctctctgttaattaggtagcctgtcaacgtctgtggttccctatcactagcgatttcaattaggcacaggtcccagatcttgatctgcatctgagtcatgc

SEQ ID NO: 3696 - DNA, 1330 bp, Zea mays
  misc_feature (1)..(100): optimal_loci_445_G1, chr1:2303940..2305269, Cluster 22
tatagtgttgtttcctgcagtggcaatcgtgcaggtcatgcgtgacctcctgctgctactgctagatggctgctgcagactctcctcaattggttcctgctgctgccttagtttaatttactatagttttatggtggtgcagcagttagcattcttcaagatggtggtatcatgcatgttagcaggtgagtttccagcgctagcatcacccctggaaaacacagtattgtttatcttgcaaatgtgtatacgtaggcaagatgtgtgttgtcggatgcagaaagccattgcagctgcatgcatgcatcatccatcaaattcactgagaattttaagggcaaatgtttatgccgtggagaaatgtgctggttggatgctggcgccgtccattattccaatgtcaaaatgcttccattctgtagaggacaaataaaaatgtcgcatcatccttgaaactgtaggtgggtgggtagattgaatttatattaatcataataaataataaatgtatctgttgtcggatggccattggagtagaacgacgtagcaacttttgcatcatcgatccctatagcctcctagattatataagttggattatggtaaaaatgcaggaggataaaatatcaccttttaatcacaaataaactgaaataatctacccaatactagccttttttttaacttatttgtggtactaaaatgatattttacttttctaccataatatatactagcctttttattaccataatctaacttatataatttaagagagaaacaaacacatcctttgaattgtacaatataagggtagttagtaaaatatcaggatatatagcacaaatttactttgcgattcatgtgtcagaaaaggctgtcaactaaatgttgcttttagttcaccttttgccctctaagttattaatggagaagcatgtactcatgagatattttcgcatgtgttctacaccttgtctttagaagaaaataaaataatgttgcagaacataagacttttcttttatacattgtcaaggtaattaacaaagatgcgagagagaaattcatagagttaattagaaagaaaaggaggggcataagatggatgctcgctggatcatatatagtgtttacatggctatacgctagaggttcgggttatgaaagcataacacatcatctttattatggatgaattgctgaaaacacctcttcaacctctctatatatataatttcacaagggatttgagtattcaaactagcccttatacgacgcttcaagaaaaataaactatattctcttagatggtacgatggcaaagacg

SEQ ID NO: 3697 - DNA, 1284 bp, Zea mays
  misc_feature (1)..(100): optimal_loci_4546_G1, chr1:23577948..23579231, Cluster 22
tatgtatcgccatccactcatcgagagaccagcgtacagttgtttgacttgcagctctctccccaccccatcctcaccaattttgatgcaagcaacccgtttcagtattgtattgtaagtaaggttcacaatttcgttttgggtaaaccgaatttcgttttgttaaccaaaatttgactcttgtatttttatactttgaatcggaatctagtttaaaccggtccaaaattcaaaacgaaaaagaccgagtttcggtgactttggagcgataaattaaacgctgattgtaagcctacctatgtcacgttcggtgttagaaatagtattacgcttaaaaaaacatcaaaggagaaaaagcgacttgtgaaagctacattctttttttttctgatacaaactggataaagcgacttttgcccgtgtctttaacccttcgtctccatgccatatggtcactcgctcacttttgcatactgtggagttcttctaggtgctgggctgcatactgcatttcgactttcggtgcaacgcaagcatgtagcgcaaagaaaataacaataattattatattattaagagactgtctagggtctctgcttagtttaatctagaccctacaaaagctgcactatagcatagcaataacaatctcgtgcgtcaaaatctgagtgactatgactagaccattgactagatgatgttatttggattaggcgtttcgtccgccgtactaagggcgaccgtgtatctggccctctcggcccgcccaactaatccaggctaagtctatttctgtcctaaatgctgcaactcatcttgtttatgcagttatattaaacaaggctgcccaaatgacctgttgtttgccacactcaagcaatcgggccaagaagctaaaactaacctaaaatcatttaccttgcggcactagcagtcgagctccaagaaaacacagtcttaggttatttcaaaataggactatctcctacactttatatatatatttatataaaaaaatagtacagtatacagtgcagaatagtaaaaaaatagtacattatatatattcaaactccaaatagtacagtatacagtgcagaatagtaaaaaatagtgttttaggtaaattatggacatgacacagtctaaggtgcctcttggaagaaaagaatgttctagaaaatttagattatctatgtgaggtggatcatgagattctaggtctttgagtgataaggttctaagaatccacgttattgtctctcccgtttggccgagttactg

SEQ ID NO: 3698 - DNA, 1395 bp, Zea mays
  misc_feature (1)..(100): optimal_loci_4717_G1, chr1:24202522..24203916, Cluster 22
tgcgtccagccacaagaaacaagatcgggttaatagctagtagcacctagcaaacctcaccctcacgagctttcgaatggacagagttaacatcgttgatttgagggttcatcgatcagaaaggaaaaataaattgacaagaaacgttgatctggtcatttggcgtctctagatctccctctctctttctccgagtaatgattatcacttatatttagcatcgatgttctttgcatttatctgtttgataattatattttgatatttatactgtattttacgtgttttccaagttataatcattgaatccgtgtagttttgttttgttttataatatactttaggactatatccttctttgttatagcttgaagttggaattgatcggaacgactgatcttattttcgttggctatttcgcgtcgcagctaggccagttataactgaatcgagcgtgggtttgtaactgatgttctagtatatatgtcaattttgcaacttctggtgtcgacgaaccgtttgcatttgtgtggtttggatgttcgcttacaaaccgtgccaggtggtactggtttacactttgcaacggttggtaacatatgtttgcagttgaacctcttacaggttaatcattgtatctctagttcatttacagttacagctacgatttgtccatgcttacaaagccatgcatgcgtgcacggtaggatgagctaacatgtggaagacgagagatggaagaaagtaccgggggtacaatggtcgatgacgtataggtaggggtgataatgagctctaaatttataatatatataaaatttaactctatttctatttatttttaaataaaaaatctttatgggctaaaataaattataaaaaacatttaaatcgtaatccattagcaccttggatacatgtgaagaacccctatactctaaacacatgcgcattctagtcgcactctgtaatatattgacgcatgcatcgatcgatcaatgcacacgatgtatgcatgcgtgactagctagggtgctgcgtggctggagatagccgttgcgacctcgttccaattttctcggcggaacgcgcgcgatccccggatagcaaactgcatcccgaaatccacacgaagcggtcacgaaatgtcgtgcttgtcgtgagcctagacgccatcctttggacgggtggtagagattagattatcaacgcagctgggctgcttctttaatccccaacgccaaaaacgattactatatggaaatgtgaccgaaccaaaggataaaaacaaagggaatgctgtttggtaaaagctgcggtggtcaaggcacgaataggggcactgttccccactctgaccactgtttcaaccacctcgaacatgactatatataa

SEQ ID NO: 3699 - DNA, 1372 bp, Zea mays
  misc_feature (1)..(100): optimal_loci_50587_G1, chr1:293937668..293939039, Cluster 22
tctcccccacttagtcatcggtgaatgtgaatttttatgcattaataacttaattagtaacttagttagtaatgtagttcatagcttagttattacataactagttaagtagttagtgacctcttagttaactagtcagtagtaggtaattactttgatagttagtagttagatagctacccaattaatagcggtcactaaaacgatacttccaatagctatgctgccaacaatgatatattcttaattttaggcagacaaatacaaggttcaagtgaaaaaagatgcacttacattgttcttgttaccacactcaaactcaagcaaacctccacgtgcaaggataactagatctccacaatcacgtacacaaagagagttatcaagtcgttcgttggcaaaaaccaaacacatgattataaatgtaaccgatctgcctaaacaactttgcttatacaccaaaatcaaaattatctacctagggttgcaaatttcacataacataagctaactcaacacatataaaatgaggaagagatgaaggataccttgctttgaaaggtctaaggatcaaatccaagcttccaaggttgaatcaatagattagagaaggctggaagaattggggacagggagagggagaaagatgagaaataaatgaggttcgccccggctagtgaactgatgttgattaaattagagcatgacgtcacgagctatgacattgaggtactgccacgtcagagccacaataacgttcactctatttataacataatacctcggtgctttgacctataacgccaagccatataacctcaacaccattggtcacgacgctcacagccgagtccaaatacggtatcaatcccatcaaggatgtaattgtaaaatttttttataaaagagaggtaaaatacataaaataccgagtccattattaacatgtggcaaagactctaagcagactaagttgtgtttgtgcgtttctgtaaaatgcttctgctgctaaaaggcaaacaccaaccaacaaaatgacagaagcacgagaagctaccttttcacgaagtggctgcttttgtatagtatcattttcagttgttttcaccaatcaacttaagactttttgcagcacatagctcacattacccttttgacatcttatggtgtttttttcacaactcagacttgaacaaaacatatacgctaagccgctaagggcctatttggttcctttggactaaaatttagtcgagtttgtagggactaaaagtatttagaacgcattaagtgactcgtaagaagactaaaatatctcttaacaatcttctgtcattagtgtaacagaaataaatgagtggcaaaaggtgga

SEQ ID NO: 3700 - DNA, 1275 bp, Zea mays
  misc_feature (1)..(100): optimal_loci_51120_G1, chr1:297164664..297165938, Cluster 22
tgtgtggggtgtgttctattcttgtaaatttagtttctttctcctattctctacgatgtattcgaggaaaaaattgccaggaggaaaggtggtgaaattgccaggaggcaaacatgctacatcagaagtggcccctcatggggatgtgaatattgaggaggaacccatatccaaaagagatcatatattgaatgtgtcacatacatgggggtgcttttgtcagctattccaaattttaaataataaaatagatcaatttctacttttattacctgagatcaatttctatttgtttaagtaagtgatatgcgtttactttacatttgtagtcataaaaccttttaatttcgccaggagacaaacatgctacatcccctcatgagaatgtgaatattgaggaggaacccacaaacaaagaagaccatatattaaatgtgtcacatatagaagagtacatttatcagctattctaaattttaaataataaaatagatcaatttctacttttatttcctgagatcaatttctatttgttaagtgagtgatatgcgtttattttgcatttgcggtcatgaaaaccttttgattttttttttctacttttatttcctgagatcaatttctatttgttaagtgagtgatatacgtttactttgcatttgcagtcatgaaaaacttttgatttcgccaggagacaaacatgctacataccctcataagaatatgaatattgaggaggaacccacaaacaaagaagatcatatattgaatgtgtcacatacagaagggtacatttatcaactattccaaattttaaataataaaatagattaatttctacttttatttcctgagatcaacttctatttgttaagttagtgatatgcgtttactttgcatttgcagtcatgaaaaccttttgatttcgccaggagacaaacatggtacatcccttcgtgaggatgtgaatattgaggaggaacccacaatcaaagaagatcatatattgaatgtgtcacatatagacgggtatatttattagctattccaaaatttaaataataaaatagatcaatttctacttttgtttactgagatcaatttctatttgttaagtgagtgatatgtgtttactttgtatttgcagtcataaaaaccttttgatttcgccaggagacaaatatgctacattccctcatgaggatgtgaatattgtggaggaacccacaagtaaataagatcgtatattgaatgtgtcacacacaaaggggtaca

SEQ ID NO: 3701 - DNA, 1328 bp, Zea mays
  misc_feature (1)..(100): optimal_loci_51591_G1, chr1:300043361..300044688, Cluster 22
gttatatgatataccaatataattagaggcattcacctacggtatgctatggtttagcacttaaacataaactttacaaaatagacaaaaaaacgagaatgatataaatggaaaggaatttaacatgtataagctgatacttataaacaaaaggtatacgatatataaatataatcagagacattaatacaattatatttaattgcaattatgaacgatatgaatcatgattatagaaccaaaatgaagaggtgtttagtttcatctttgaatgtttgaatgataattacagatattaaatatagtctaattataaaaaaaacatttatagggacgaagaataaaaaacgagataaacttattaaatctaattaagcctatatttaatactctaatgagtctgaaaggcatatgaacgcaacaccgagaaactccaaactttctaacagtattaagagttaacaataattatacagctgatgagtgactgatgtgtgtggtctactgactgcagctgacgcaacacaatctcaggcacgcacgcactgacagaacattattgtaatagcataataagaagaaaagctttcaagaagaaaaagatgaagaaaagctagcatgtcttttttgacagtaataaataaagaagaagaaaaaaggagagtagttaggcaagtcttgtggcttggaccacctagctatacaggctatggctagttttttgcctgcctggatagcttttggtcaacgttcaagtcttgctagctagctcggggatcagtagacatgcatgcatgttgttttgcttgtttgttgccaattcattttcatttcatccagtccagtttcatcagtttattcttaattgcatacaagttgatttcatgcatcatatccatatagctagctagctaattgtgccacgagctcaaatctaagcaagtgggtggccttttaatttttactaggtggatgggatcaacagcgacgctgcctacagagaacctgaacctctttctgctctcctcgtctcctagctgctgcgcaaatgcatgcatgaacacctgccgccccagcattattatgcgtattttgttcccagtttatcatttcatttccacccaacactcatcctcaaccatccatttctattctccattccttagccaaacgtacaactcctatatatatatatatcaaggatcgaggaagttggatgagagcctaacccaattttctttcaatttcagtcaatatattaacaccgtctaattaacgaaacgattgcaaatcgaatactctctaaaataagttgcacataccaatac

SEQ ID NO: 3702 - DNA, 1300 bp, Zea mays
  misc_feature (1)..(100): optimal_loci_53137_G1, chr2:7304197..7305496, Cluster 22
ccgcgtctggcggtcggtgaatgcaagctggatcactttcatcttgggccggcgaaggcgaagctcgagcaggctgggcggtgcctccgccactgctgctgggcacgatctacatccacgctggctacagcgaggccggcgcgcacaagcggctgggtctctgcacgtcggcgactatatatgtaagcgtcaacaggacgtcgttcatcgcccgatggtgccccggccgccgcctgctcggatccaccgccatcctgacgtaacttttggtggcggagatcaggaactcaggatgcgattttttctgttttttttagccactcgtgtgccgctcccgtgtatacgtcttcaagctggactcaaggcctcaagctgttggtactcatgatctctaagtagtagatggtgtcgtcgtagctagagtaaaccagagcacgagcgctaggcttctgacaagggggcagctctcgccgccgtcttcagagaagggaagagaggaggaaaaaagacatgacgtgggaagcccacatgacataggaacataggaacgatgagacacgatatgacgatacatcggttcttttcgaccgagtgtgacttaagtgagatcaaaaggagaatatgaccttaatagacatattttaaaaatttatgaaccatgttaacacactcacaagttaagagaccggaaatatactatccaaaggggtttaactttcttcccaaaaatatttgttacatttttttctagtttgtacatgtgtaaataactgttgcacatacctggatatgtatattttaagtagtattttataaaaaaaacatttaatttgttcatttaagcacaccctaaacaatctacacgataaataaagagtggccgatcgacgctttacaatttagtgtttggaatggcattggctataatgtagtctttgtacaacgtctagagttcttcattttcattattaatgtatctttttgtttcacttattagtgcgtctctatgtatttgctcgcatataatttgatttgatatattactttttgctcagtttttattacatctataattaggggggtgaaggtgaaaataactaattttcccctgatcctctctaacgaatagcagagatttcctcctccattaatcccctcaattctcttaacaccaaatcagccttaaaaagattcaaatccaattcgagatttaaaaatagtatatagcccgtaaacaaatatattttctttttttttatttgacatagctggcggatagcacaagtgccttaaaataatg

SEQ ID NO: 3703 - DNA, 1272 bp, Zea mays
  misc_feature (1)..(100): optimal_loci_53693_G1, chr2:10375230..10376501, Cluster 22
ggaggtaattatttccagttaagtattaacttatatctaaatagggccattctcacaccgtcacacatgcacacgcacttagagaaaaataagagaataagctagatgatgaagagaggaatactcatcctgtcacaagtaccaatccatcaagagagcatatatggtggcttggtggagcatgcatcacaccatctgcagagaagaataacatccacttacaggtccgatgccattgttctcactcgttcagataagccattcaggctatctatgactgactcgtgggatgtggcgccattttgcatttgcccccgcgctaggccatgatcacgatcaagggacggacctagaacaaaatataactgagagcatacttagtatttaaatttgactgagcaggggatctcatgataaaaatctaagctcgagtaattagaacaaagaaatgcacctgtgacgatccattccttatttcagaaactctcactatgtcatgcctcttttttcaaatgaaaggagggagggcacaagctagcgtcactttctgtaatggataaacatactccggactgcatgcatacctacactagaacctaacctggtggctgctgatgtagtgcagtggctgcaactgcactagccgccgcgctcgccgtctgttcagcagctgccctgctggccctgacgcgaatgttggcatattcagaacacgaacccctgaatgaaagcaagagaaggcaggcagggcttgcgaaaataaatgtctaactcatgttttgagaagttttttttaaatataattaatatttataatatataatatgtatcattagactaaagacatgtttagaagcacaccagtttttttataaaaaaaactcaattctagaaactggttcatgaaaaaaaggtggaggcgtttggaactaagtttctaattaagaaaccaccttctagttatttgatacacaattactagcatatctttcacctgttttaaaaagcggtggcaatagatgtaaattacaggaaaccaacaagggcaagatgtaattaaacaaataaaagttagttttggcaaggggagtagattcttgtttttaaaaagctggtaatctagtttctataaactgagatataaactgatatgtttggaattattctaatttctataaatcaatttttaaaaaatgtgtgcttccaaacaggctccaagtatagagtaattttttttgaagatgctgatataggtattgttctttgaatcaa

SEQ ID NO: 3704 - DNA, 1233 bp, Zea mays
  misc_feature (1)..(100): optimal_loci_54304_G1, chr2:13455075..13456307, Cluster 22
taatttttttttaaaaaaaaagcgttgtagattgctgagaacaaaaaaaataattataagatagaatagcagatagaggacatcattgcagacacactaaggtcttcttttgaacatgggaaattttcttgcttcctgcgttttttttttgaaaacgaactgatttctataaaatccgtatatgagtcctataaaattctttcgttctaaattagacataaatttcttacgaaaacagacgcaattctttgctgatcccttccctttcccttttcttgtcgtgttaatttttgcataacgatgaattgatgatggtccgtgaccctgactccctgttgctttcgaggaaaaataaaactgttgcgtgtctatttgatatgaatgcgtgtcgcattctaaaatttttgcagtaatatagagtacggtgctcgacacatgtgtcggtcggtcagtgcagcgagccggttggctggtgagtgtgccttttgtttaaaaccgctcggcgccttcgcatcggattctggatatgatcgcgatagttttaccatgtcggtgtgtcgtcttgctcctcgtgttttcctggaaactcgtggcgctcaacgaacgagcccagccgggcggtcaatgtctcaatgattagatggaatagtttacagctcgttccgccgacggcgatcaaagcctacgacacggttcctgaaatgacagaaatagcagcatgattttctggtgtacatgagtctaaaatttattacctttgtttgaatttgagattttacatgtgagtagagttgaaaacggtcgaaataatccggtttcattctatcccgatttctatattaacttgtttgaatttgtattgacggacactccaactattttcgtttttccctttttgacaaatgtggaaatgtgacgggacaatataggtgttttttcgaccaattttgcttttctcattttttttaatcaggatataccatttttatccgtacataatgtccagttttaggtaatacaataaacaaatcatagatgattatgtcatatttcaacaaactagtccttaattaattattttcttggtagtcatatgtattataatatgttgcttccatatatctagatgagatatttcagtcgatcataatattattttattttagactctacgggacgatgtttccgtttttatttccgatttctatttccaatttcgacctattattggtg

SEQ ID NO: 3705 - DNA, 1147 bp, Zea mays
  misc_feature (1)..(100): optimal_loci_55541_G1, chr2:20190016..20191162, Cluster 22
tgtggaatatggatgagaagaatttctccaaaacgatgcgggtattgaaagacattccccacacatttttttgccgctgccatatctagttggagtggcaccctgtacacgctcgaaagctcactaaatattaaagcctgtatggaagattttttttctattataatacttatatcacgtggcttatccataatagtatttatattttatgctcaacggcaatgaatccagcgtgtacatattatattatatatataataaatatttttaaaacatttaacatgaaaaggatgttacattaataattttgtagattgtgcgtccttttgtttagatttatggcttcaagatttatctaataaagtcttaagataatctgctatacgaaaaatatgattataaaatcgatagtccaatgttcagtcactcggattttttaacggatgtgactcgtgagatgttgctgaaaactagattgctaggtgtaggctagcgaaaacgatcgaggttgatcaatagctcggtgtatattacgcgactgttcgtataatcatatgtgagagctaggaatttaatttgtacaaatataatttatttaatcgtttgatattatattttaaagtggacaaggataacataattaaaatattgattatgtctcttagaaggtatcaactaaaaagtcatataaactatcaatataatttttatatctatttatattataatttacgatttttaacttacatttcaaattaagacttattatttatgtttttaacttaaccttcaaacttaaattttactgtggaagaatttgacgtaaaaatcgtttctggattgttaaatggtttgattgaatatataaaaattttagatggcatagcctatagtgaaattctagatccaccattgtttatattctctagaaagtacttacaatgtcaataattattaatttttattttctttctttatccctaccacttagggacatctttacgcttgtttttagggacatctttacgcttgtttttccgtgacgatacagaaacgaagtatatgtcctgaaagcggtaccactacctgaagtcctaaagaaatatacccttttaagaggtagaaaataagaaaaaaaataaaataa

SEQ ID NO: 3706 - DNA, 1250 bp, Zea mays
  misc_feature (1)..(100): optimal_loci_56093_G1, chr2:23130749..23131998, Cluster 22
ttcttaaaaatttggtgcttccaaacagacccttactcgttttgaatatttgatgcttatcagtccatggacacatgttttatgcaggataattttgtgcacattatgttgggtttggtaaatctagcgcacgcttctcaacggcttgactgtagcattgcatgctttatggttgttcacattcttatatagatcttagggcatgtccaaccccattaattagaggtattttgaggggtttgtaggggtaaaaaaaatcaagagactacatgactctctatacctattgtctcttaactatatttataatatagagatttagttggaaaaccgatcccaaaactatgggttatgtatgtccttaagccatctcttttattggaactatgaaaaaataatcacaccttcaattatgcatgtattttaattttttgctaataatttaacaaaaaaatatgtatttttagtgtgtgtgcatgctatatatttggactcgtataaaaatatttagatgtatttattgatgatatactttaaaagataggactggtcaaagttttgctttaaagaccgtgcgagaaatttatacgccttagtcaatgtgacagataaagtattttttgtaaaaaagtattgatagtatctatattctatgatagtagacaaatgtttagatcgatccatattaccatctagttcaatgagacgataacctttttgataaaataggtcgactcatgtcccttgatttttttttaaaaaaaattggtcttgattcctcatttccatcctgactttctagctcacggagttgttgatgctaagtattctagttcgagccttctagggttaagcaagtagttaacacttgccaagcgttgctcccgagtttctattataccttttctacacagcatacaattcttgctagctaggccagccgtgagaagaatgctaatataacactaacagcaacagcaatgcctttgtgtcctagtggttgtgtatgccaagttgttgccgtgggactctgggaacagtgcggcttgctgacgaacagcgacggtatgtagggagtatttaagaggcgctaataatctgcgtcaacgatgagcagcaggaatatctgttgttgaatggccaagtcacccggcgaccattctcggccggtgatgcgtggcgatattttgttccctgacaacttggccgtccaaggcacctcgctcctcagtttgtgtttgtcttgcccc

SEQ ID NO: 3707 - DNA, 1355 bp, Zea mays
  misc_feature (1)..(100): optimal_loci_56298_G1, chr2:24384473..24385827, Cluster 22
catagtatataattaaattagaaaagttgtcggattcttgttgacaagccacaacggatgagcagtagtagatgcgcatgcctgcgtgtctctagagcctagatgccattccaaagaaccaccgcatattttgttatttgaaaacacaaggagtatttggtttaaaaaataaggtagtctatcatcttctcgtctcttacttttttatttagtttataaaagattgagatagtctatcatcttctcgactctcacttttttttatttagtttgtaaaaaagaatgaattgatttattaccgtttcattcattataatttaataatagtaataatacgaggaataagtttattccgctaaatttgtagaatagacttatgatgcactatctcatttagaatggattgattctacaaactaaacatcccaaagtactagctaatgatatatatataacgacgtcttttcttttgatttgattggcactctaggtacgtccaaggtggaattccaatcacaaaacaaagagagaggatcagagccagtgtttggtctaaattcgtcgccgcgaggacatatgcatacatggacgatcatcttcgattattacctgtctcacttacttttattagtaagttcaggacaaaaagaaagggggattcgattgagacgtcagttgatatatatgtgtaacccaactaataacaagccttttgccacacatattgccattcttggtttggttgttgtttcttcatcgtcgacgtctcccagcttagctagcgtagtagtacttgtattcgactgactagtgacaggatcgtcatctatcgtctgatgtgtttcgtgtcaaccttctttttcaaaaggaaaaaaaaagaagaaacgtttttagctaccttgcttgagtgtcgttgtaggtcacgtttaacgacatgtatgtatggccagctttctcttagaccgctccccttcaccccacctcatcataaccgccatccactactaggattggcttgcagccactgacttccttatcaaaacctactagattcctatgaactacaatgctaagccaaaatgagccctaattagcttgctagagatttcattcatgtcccgaaaaaaggagccttggaaaaactatagctaatggatattatacctatacgtggtactcaaagcaacatgaaacactcgagtactcgttaggtttctcaaaacccgctcaaacactttttagtagcttctacgtaaacaaggttacgatgaccaaccactcacattagtgtttccatgaagttctctggcagtctttaggagccttgaataaaacctaatgaatattatacctat

SEQ ID NO: 3708 - DNA, 1317 bp, Zea mays
  misc_feature (1)..(100): optimal_loci_56985_G1, chr2:28300377..28301693, Cluster 22
acaataggcctaaatgttggagtagagctccttgttggagatgctctaattcacctcctattattcgttccttttgccccgctagcgggcacaacccgaacatggcaggcacaaccaggggcgaagccaaggggggccggcaggggccatgtctcctctcaaagctaagacacagacaagagaattataaatatatatagtgtaattttgtgtatctaaataaatatattctaaattttgtgcagcgcaattaatctaaggtttaatatagtagttggtaatacataatctatactttgataatacataatctataattttgtgcagcgcaattaatcaaaggcttaatatagtgattggtaatatatgatctatacaataggacaagggttttattctccaatactaatgatgtttcatctatttcatacgcagaatacgaggcaacatatgagggtaaatatcgattcctctgtgattgagatgctgccaccgttgtgatggagtcctcctgcaccgatgtttctatctcacatattcacatctttaacaaatctacgtcaattatagtaaaaatggttaattgagcataattctattaaaaaactgtaatgaggttcttctccgcccatgcttcgacctcggttaatcaaatctttagcagctacagcgacatggctggagatggaaattttagctggccagagtcggatgagagcatgtccctccggattaacaagctcagatatgaatattcttttacaacgaacctaatctactacgaaacaaaagctagataaactgtgtgtacagatcaattttgatgtcagcgatggacatcagggaagattctacccgagcaatttaaaatgtgctttcttaggttgtattttctcagggatctctaaataatcattcgttcagtgctgccgagtgttgtgatcagtatagtatacgcaggaagccagtgtggactttgcagcagcatctgattacactagcacctttcccaaccacagcagcaggaggagaggaggtgatagtaattaagaaatcaacctggcgaagtcgagcctccaggttgcagatcattcattcacataactttttttatcataaataacgtaaaattaatatgatgtgaatgggtgaatgttgcagacaagcgtgtgctcaagtgctaataatcatccagtaccatacagagcaagaaaccgaccgggccatgcagagtgcagagtctgaataccgccgcgggctatatatctcatatctatctatgttcagaaaccagaaccaaagcaccaccagtaatgc

SEQ ID NO: 3709 - DNA, 1047 bp, Zea mays
  misc_feature (1)..(100): optimal_loci_57049_G1, chr2:28706008..28707054, Cluster 22
gtttcatcataaaattcgggagccgacacttgggtgttgtttagttcacaaaaatataacgtaaatgacaatgataatgattcatagtttagtatcaatggtaatacgtttgaatagactgatatcaatttctagtataatatctgattatggttcgagttaaacaaatatgatttaatattatcagttatctattacattgcaaatatatgaaccaacgataccttggtaacgggtgacccatgtcgtatattgtggatttagcacgatttgtgtattcttgtcttctttggtgacggtgatgctctccagtgaaggtttaatcatgtcatcaaggtagcaaaatagttgcacaccttacaacaccgagtggaattgggcctttgttatcgccaaatcccgaccggattggtgcaacaagcacttggtcgacgggttcaatatatctatatcactatataatacatcattttttttaaaattcacccaaccaaatcaccttacacccataacatccactaaatccacaaaataaattacacaaatacttcacatcatcaaaaccaacggccctgctcgttggataaccctcaccacttactctaaattcaatgaaaaatattatttggatcttccctcattcctctccctctcctccctgtccccactgcccctccctcctcactcgcattgtcatcattgccgccgtcaacccctctcctcgcgtcgtcgatatcgccatcgacccctctctccatttcatcaggatcgtggattgtagtgttagcacgagctatatgttagttatctagtagtcaatgggttgtgtgtatgtagataaatattagtcagatagagttagttaggagtgtatatcgctcaaagtacatggattatgagatgtatatttctcatcatcaataatcagaaagacatacgttcccaagcaacacatgtttccttatctcttcggtgcatcgacaaccatttcttgtttttccatgataagcgtgtttccttatctcttcggtgcatctacacccattt

SEQ ID NO: 3710 - DNA, 1024 bp, Zea mays
  misc_feature (1)..(100): optimal_loci_57123_G1, chr2:29117555..29118578, Cluster 22
gaagagaggagcctcgcctttgccttttcgtatggatgttggatgttttgcgtttgatttttccctatttgaatgaaaactgacaaatctttcgcgctattacagatcagtttctttgtcacaaaaacctccaggcctaaaccaagaggacaacgtcggtactgtagtactgtacagtgctccatcctccaggcccgagcaaagaagcggagatgatagagacgagagcctgacatcgttttgtcgtctgccatataggcataccgcataccgcataatcgaacggattcaatcggttggatcaacgtacagcccaccaaaaccattttcagcccatacagcccatctaaattggtccaagtcaaagcttcttcgtcgcaaaatctgttacccattccggcgatgacgaactgacaaccaccgcctacgctgcgcccatccccatccccatccccatacgttcccctgattaaatctatttctgttcgattttgactagaaaataatttaatttcctttaatcaccttcaatccgcttccaactaaacataacttgagcagatcaaaagctcaacggtggccatatgcctcagcatgacacctaggtaacctagttcgaatgccactctgaagaaaaatcggtggcttagaccttactcctcttgtctcccactattttgtactttctattcatttttaaatgcctcccactctttaatttctttctctattttaccttatctcccgctgttccctttatctagcttccatttaaactctagatgcgctatttaacttttatatatcatttttttagagttttaaaaaagtatacagtatttgtagtaccataatacacattggttttagttaattaaacttaaaataatttattttatgactaaaatatgaattaatgaaagagagagattagagctcccccgtgtaaaggggaggagctcctctcccagataatatggtgaccattagggtgacactttggagtgagaggggatgttgtgta

SEQ ID NO: 3711 - DNA, 1328 bp, Zea mays
  misc_feature (1)..(100): optimal_loci_57332_G1, chr2:30340775..30342102, Cluster 22
atttgaaaccggctggcatgttgtttgggtccccatgcccgcaaatttggcgagaatccataagggcggatggctgccaaaggagaaaggcctgtggccggagccgattacctggcaagaaaggctctccacggttcatggctccatgcatctgatatgtgtatcatgctgaaatgataagctggcaacttgttctcttctcattgttgttttctgccgggtgtatcgtcacatccggatgttgttggaagggtagactagcgctagcctctcgcctctccggattcagatctcactgccagttacacgtgttgcaacttccgttcttgaacgtctacgtccaaatgggatgcaagaacctcgtatgctgcagtgccctgtacgtttgcacaatctctatctctcggtctgcatgcgcatggttgcttttcagagatttgtagctgtactgttgagcatttcaatgagtgtctttgacttaacatgttgtctttttttcaaataaaaatttgaaatttagcagttgaaacctttaacagccattccttgatttgaattgaagtgtcatgcgggcgaaagatacaaaggtaacgatgttgggtcactcggacccatcccgtagcctgaggagcttggaccctcttttttacattaaatagaacaaagttaacaaattttataacagctcaaaaatagataattagtccaccataaaaaaattatcacaattgaatcatagaaattacaactatgaatatttacttataggaaagcaaagatctagagatatagaaaaaaaaactctttactaaaacaataagctagctgtgggctgccaggttttggcccacacttgaatgttttctgtagtctcggatggattgttttctagagtgggtattgttgggccaagttttattttggttcatgcattcaatttatctcatttatcaatcttctctactatataaagcatcggtttccacggttccatggttgtatacaaaaataagataaacttatacacaaatgtgttttattgaggcaaagggggtgtttgggatggctacagctgtagtttataatatcaatttaaatagttttaaaatattttagtctaaataataaacgaaatgacttatctaaatgttttataaaggcttatagctctatgattttctgaagaacttaatgacctacaccaaattttctggagctgaagctatcccaaacagggccaaagtctacccatatgaatgtgacatacagaaatcgtaccaatgcatggacatttatcatttatgtttgtgcccatgtttctctttctc

SEQ ID NO: 3712 - DNA, 1052 bp, Zea mays
  misc_feature (1)..(100): optimal_loci_59922_G1, chr2:45963293..45964344, Cluster 22
gtgttgatactgcaagcatgctggacagcttagtttagacctacaaaatccaattagttggttagctttactttctatgctatgaggtttaagaaaaatgtggactaaaacttatagtacaaacctgaaatgtaaggtatgaagtagacgaatgatttgccatgttttcttcccaaccgcatctgcaattagaatgaacgatgtgtagataaaaggattaattgtatacatgttagtaatgtcactctacttttgcaaaattaaatagttagtttatttttataccatagagtagcatgaaaatcaactagtttctaactttttaaaactaaagcgacatatttctaattaacccaaaaaatgggttagactgagccatgaagacgaaatacttcgatccaaccaatcttatccgacaccttggtttttgagctcaatagttaaacttgatgaaccaaatgtttaattaagcagaaaatctccaataataggcgaaactaattagcaaatataggcatcaaatagacaatggattgggataaacaagatctgacaccatgtttttcagctcaacaattaacatgcgaacaagaagtttaattgaacaaagaatatttaataataagaaaaattaattagtgaatgtagctaccaaaatataaaatacactatcgtaaacaaaagtattggattgaatgaccggtaagacgaccagaggtgaataaatgtgagccaatcaaattttacaatcaaacactaaaaataagcactccactcaattaaaataaagtaagcactcaaaccaaaattgaaagttaccttagtgtttaaaaataaacaataattatatttgaatgcatatcttaatacctatttatatgatatatgagcacaatcaaccgtaagaattaaagttcactttaaccgatggcacgtgagagaacctcatttttaaaagacattttcatttgttaaagaaaattaattcatttcacttaaaaaaataaaaatctctcaaactactcggattcgctaccaccactgaaaaaagc

SEQ ID NO: 3713 - DNA, 1254 bp, Zea mays
  misc_feature (1)..(100): optimal_loci_60395_G1, chr2:48586393..48587646, Cluster 22
gaaaattttgattaccccacacaataggaaataacataatatcattcaaccccggtgtaataatgattgaaccctgcaatagcgcataccagctatcaatgtaccatatcgatgagataggatcatataacaaggcagaccaaggttacctgaatgaaaccttctcgtggtggcattgttttccttcacacatggtgtgctctgagacaatggcaacgaagaaaacaactgtcattgatcccctttcgtcagcatgagatatagttctgtttcaaggattatgactgcaactggaatgtttagattgcataaggacgtgaaacacctgtcattatgctccaccttgcaagagtttgcaattgttgaagtgtaattcctttgtccctctctatgggttgttcactcggcctccaaggctataatatatcaggtggaggtttccctgaccaccaccaccccacacacacacaccatattttgcagaagttttgcattctgaatgaaaggcagaaaggtccaccaaaatgatttttagcttaatgatggggaggatcacagttcctcagcacagcatttccacatatgtcggatggaccgggtggtggaaagggtcgcaatagcatgaacattactgagtctcaaaggagaaattgtccaagcaaagaaagcacacttctcgataggcaccggagaacaagcacccaagattttaagagaacgttgccttctgtcaaagaggaagtgtgccacaagagaaagataaaaacagaacatctaaaaacaaaccatatttttagtaataacatcttctaactttgttacatggtactgttgttcaggcagacagtgttaattctaaactctctaaagcattagcagtcaatttaggttacaaattggattgtcataggtgagaacacatggttttgtagccttgtgatttgtgaacaacatatagcacctcctcagatctaagttcaacttccaatgcttagctaaatggtactcatgctgcatcacaatttgttacttactatagttttgtgatatgaccaaatcgttcaaatttgcataacaaatcactgtcaagtgtacagttattaggaacacccattagataacttaagttgtctatactattgactgcaaagatgtaaagctaatttgcaaataccaagtataatgttaccaacagaagttctgaataaatcggtgactgctagtatccattcagctaatacagaaggtgcaaca

SEQ ID NO: 3714 - DNA, 1049 bp, Zea mays
  misc_feature (1)..(100): optimal_loci_61582_G1, chr2:55040325..55041373, Cluster 22
actgttttgcagttcacagaaggtggagtgttccagtagcaaattgaacaccttcccatactcaaaattatgaaaacagaacccatgacaaaacaaacagaaaagtggcataagaaagaaaactatattaaccagaatggcatttttcagaaccattcagttactgttttgcagttcgcacaaagtgtgaatgtttcaatagcaaactgaacaccatccaatagcgatgtggtgccaagcacgaaggtgaaacggctaaccaataataatgtatattcaaagtccctggatttgaagtcaggcttctttttctcggtcaacaaaacattacaattactaatggcttcttggaaaggattcaggtcaattattttttcacaatctgggagaagacactccttgcaacctaatgcaacaataggtgatccaacattagtgaatcagctatcttcgagaaactcggccaacccaagcttcctattaagcttatccaaaaaaaactaagccctaggtatatctgactttcccatgggagttatgtcgaccaatttgagagcaaaagataagcctgtttgatgcatatcatatctagaaatttgcatggtagttatgagttgtgacacaaccaaaaaacagtcctaccaagcatgtgtcgaggcaacaacagggaataggccatgcattattgcattcaaacagggctgaggtggtaaggtttattcttcgatcatcaccttggatgcgccacaatattcctccccctgtcacaaatttaggaaagcaaaataaaataatgttcgccagttaagcaagatgttaacagcaatacgaagcgagctattttgatcatcaatttgtacatggacaaagttgttttaaaatacatacaatatatagtcagaacagaggacagctgtagcattcctgtactctaccaaaatatgccctatatcaatgaatggaggcaatacttaccagcaagttgagaaatcaaaatataaaatatggtcattggatttacctgatccacccgtacactgctcggtgtt

SEQ ID NO: 3715 - DNA, 1009 bp, Zea mays
  misc_feature (1)..(100): optimal_loci_64643_G1, chr2:72677176..72678184, Cluster 22
gtcgttgtccttagtgtgattccttgtgtggttaatgctaggagagattccagaaggttttggtggagaggagaagaaagcccgtgtcggtcgctcctttggtgttcggtcgaatactcgaactaggatccgtcgttgatttttcacgaattcgagtcaaggttggtttggtgagcaattcgctactcctgctagctgacttgtgtgacggattgagtaagtatattggtcgcgatgaatcttctgttagttgcacatgtgcattgtggttatattaaatgtttgttaaaatgactcctcacatgtagtgtgtggttatgctcataaatgtggagtagacacatcgtctttgttgggtgaagcttaggttgtaatgtgaattatgcacagtgggacaagtttagttctttcagcatttgtggatatgtgttgttggggttgcgatgatgatttaattatattgatgaatatgtatgtgattatgttagggttgtgatagaggagtttagtagtttctatatcactagtgatacgttgattttttgggtagtggaatcaatgctctacctattagctcaaaagtgtgattaggttaagtcaatgtttgtgatgtgcttgtgttaacgatcatggagtagacgtagtctatatatgtgattaagtagtttctatgtatgtgaaggacagtgtttgcttaggcaaagagtgctttgggaaacgagtttgtgaggcatggttaagttaataatgcaaagaaatgtttattacttctagtgcttcatcactaataattattagtgttgcttatgatgagatgtcgtttgtttgtatggagtcgatgccctgcctagagtttgcgctaactactcactattcttgcacttgaagcctatggtaaagcattctagtgattattaacctacatgtctcattttggacttcctctatttgttcttctatttgtgctgatttctagttatagtttttgttggcatgcataccttactga

SEQ ID NO: 3716 - DNA, 1269 bp, Zea mays
  misc_feature (1)..(100): optimal_loci_6932_G1, chr1:35815131..35816399, Cluster 22
tttgacttccctagggtcgggtccacatgttggtttcatatgacccccaatgggcccctagcatcagtacgaccctcggtgggcccttgacaccttttatccttgtagtagcctgtcatattattttattgagccctataaaagattaggtcgtccctaacttaacctatagcatattattacaattcaatttcttattaacaatcaaacaacttcactttgaagcacaataaatgttccttataggggatatacaaatttagtgatgtaaatggtaatatccttatatataatattggttaaactttagaaattttgattaattctagagctagaattgcaccttttcaagacggaggtaataacttatttccatgagtatggtcacaatgttgcaatttcttgatattgaaatgctataaagaaaaaaaatgaagcgcatgttgcatgatttacattatgagggtacaaatgtttggtcatagttgggttgacattgccgaaaacaacaacaacaacaacaacaacaacaaaaaaaggcacctgtttagttgacttattgctaaatatgcagcagtttgaacggcatcaaagtggactcttattatttaagagaagctattctattatatttaatatataaacttataatatgatagaaaaataaaatatcacaaataatcatattaaatatgagataatatgtctctttgtcatggtgatcttcaccatcaagttcctgtccttcatgccttcatgcttgagtccttcaagataatatcaagaactgtgctacgacactagataataaaataattacatagaaacatcaagcattacatatatatttggaccataccattcacaatattcttagcaaaaccaagttaggtgaataattggatactactgtgtgatgtgtaaagggattattcaaacaatctatgtgtatgcaaacaaattgatcatatgaatgaaatcactatgaacatctcatcgattgatcagatcaagccaattctcaggcattccacatgcctctattttttccatcaatcatatttacaatcacgtgaggtagaacaataatagtacacttaactcagacttgttgcctttctcaatctaaaaggcacatgcactattgttcttgatagtaaaaccaactagtaggggcaagttatgcgagtgaccgtgatgaaaaatatactgatcttatgctcgatgaagattttagctggtaggggcaaataaggtgtgcgagtatac

SEQ ID NO: 3717 - DNA, 1154 bp, Zea mays
  misc_feature (1)..(100): optimal_loci_72631_G1, chr2:127440516..127441669, Cluster 22
ggccaagtttgaatatttggtcacaggaacattctaatgttgatatattatattgttaatggccatgcggtaacctatggtgctgtccgaaggaagtgcaatgctctatattaaaaccactttgaattcgttctgaatttacgtatggtttggccggacaaagctacgaaaaatgtaccaagctttattatcattaattgttggctccttgttgcaccatccaacactggctttgccctgatcttgcttcatgccaacaattacgtactgcccaagagcaaaattgcaatttgcatatatacatagttttaagcagtatttgaatgccgccttctgccgaattctgttttagttacatagtctatttccttccattaacagaagcaaatatccaactaggccaaaacacaattctcctgtttctattgtgaaaaaacatgacttttttgtttcttacctccttattttctggatcaacctccagctaccacatccagcggaacagcttcagtttaccctgaatggcccagaaaatatgcccttgcttattagaaagaaacttttcccaaaaaagtatggaccaatgttctgattctgcttagcaaattttcatataaaagttcatagtcctattaatctaccgataaaaaatgcttatgatagtatcttacccacagaaacagcaactctttgtttggaccactctttcttgtaaagtccgtcagggggacaaaagttccactaatagaaggttctttgccacaacctgtgataaaagcaaccgattatattggcacaacacaaagagactccaaattatttgctgaaacataaagctatatgatcccaccttccttccctaaaggaaaaaaaaactgagcccaacaaagtcagttcatgtgtctggacatgttatgaggcagttaaatagctaataaaatatagaaatttagctaccatctaaatgccgcatcctccaaccatggtagcatgtgtccgaaaattcattatcgagtatcagcattctacagccattctacaagtacagtcagcccgttcattggataaacaagcagaatagttcatttaggcatcagtatatctatacattgtcacactacatggtcaatggtagtgttgtccatgtaatagct

SEQ ID NO: 3718 - DNA, 1200 bp, Zea mays
  misc_feature (1)..(100): optimal_loci_80300_G1, chr2:173456880..173458079, Cluster 22
ctgagtagcataagcaatgattttttacatgtcagtcaattcagaaattattacctttttctgcagaagggtggaatctgcactctgggcagaaataaataaatcatgttcaaaaaaagatatcaagaatccttgctattacagaacgatagtcattatggttatttttctgacgatgaatatatggtatagctgaaaaagtgtctctggtgtggcttcgcataactaatagaattatgatagtgggtcagtagcagaacagaggggtggagatcataataggaaaaaaaaagtttgaagacaatttcataagtggtccaggggagaaatggaaaaattaaaagtacagcatataaaatctgaaaactaaatacaagcaccaaccacaaaatttagaagactgccatacaagctggcaaaatcaatgagctgatctaccatttgtattgcccctatgtatatgttttacagattattctactaccagggttgacataccatgctgaatgaaaattgaaatagctgagcattctgcatcatcctaatatcagcaaagcttccacatttcctttatgggcatgctatattgctatatgctgcttaaggccgtgtttggttaactagagtttctggtgatcagataaattgtatcggatattgatccaaacgttttgctttctgtgtatcagataatgtgctgctagaaagaatctacattatcaactttacattggtttttcttggatagtgtgcattatccagatttcaaaaatgtgtcggttcccaaacgcggcctaaatactgctaaatgcaagtggtgatgcatattaatcaaactctttaagcacccatttgtattgaaagaattaacttttatgccggtggatggtgcttaatgatgcagcagcattctctctgttcaggtggccatgtttacacatcttgttatacatgccctgataggaggtactatccaataatccaatatgtaagatcaggcacatcacgaattcataaatgcaaatcaaaagaagcaagagaggtagaatatttgaaacatgaatatcacaagccaactagaaaggaagggaaggcaaagaaatagagaacagggtgcatactagcagtaatattgctcatattcctttgtgaaactccattataatttaatcttgtaaatcaataacttggtttaggaag

SEQ ID NO: 3719 - DNA, 1162 bp, Zea mays
  misc_feature (1)..(100): optimal_loci_85595_G1, chr2:203584606..203585767, Cluster 22
tctcaaaaaaattgttagctgcctcatgaatattagagtcattatataaaagttgaatctcatcagtcgaatattcatcgttatatcgtctttattattttagtattgttcttgcgtcacaactttaattcaatatatcaattagctagaaaatggactcatccactaaaataatttataaaggtctaaaattcttattccatgtcgagtacttaaatttgataacattatacgattttttttatcagatagtattgatgaattgatcggcctcccttatattatattcctggctccacccctgtttgaagtacataatacgtaacaaggacatgcatgcgttagcacttcatattaccaagggtcctaaacaatttattggaatgtttcactggccattcgggggcatcaaagaagtgattgaaagaaagaaagaaaaagaacagaccatttttcaactagtggaagtcatgtaattttcagcaattacactagagtgaagttggtgaagtactaccctttgatggtctctaccaaaatagtgaacctggcccctgggttcatcaatttaatgaatctaaaattgcacaaaactagatcgtttgcctaacttatcgtaaagtaaaattgttttagtgaatgtgaaggtgctagagttattccaagtagaccttaagacaataatgcaactacgctataacaagctagtttactcaactcacccaaatttgtttattttatttgaatccacaactgttttaatttgtagcggtagaataataatgtaaactatattcagtgttcgtcaaacctgacatattcaacattaggtaggagtacaaaattcgcttaaaaaagctcagcacatatcctgcggggaacaggaatcatgggcgtgttccgcgtcgatggggacaatagcgcacgctctgtggtacaccactcgacgccacctatttttaacgtgttgtctagaaaaaaaactatcttgactgtcctcctttctcaactttttatataaataagagctccttttcagacgttctaaaccatgttgctctgtccgttttaaaatatttgatctatattatttaaattttatcataaattacatgagccaggcgcaaacgactaaagtcgtctatttgagaccgtctattat

SEQ ID NO: 3720 - DNA, 1400 bp, Zea mays
  misc_feature (1)..(100): optimal_loci_86692_G1, chr2:209120950..209122349, Cluster 22
tctgagcagcccaaatcaatgtctgtcttggcctggtagaataaagtttcttcgagaaacagccccagataagtaatgtagcgggatgacttatggtgggtgttttatgtagcatattgacttaatgagagtaactgtgatgataaattatagaggggaaaataagaaaatacatatggagcttttatggatttttaccatgataatgatgaccattatatagagaaactggtccttctaaatctaaaataaggaagaaaatgcatgtttattagcttactctgtatctttgtggtaactagttatgagtccagttcaaattcgtacattttgtttcattggtaaacactgtttcaagacagcatattcaagacatttgcttctttaccaatagcctgtgtggttcactgttgacttcaaagcaggtactacttacaaatacagtgattgtaataaaatgatatgacttcaaatcgtttgatcgaagtacaggtatcgcacaaacataagataagaggctaagaaccatagattcttagcatatagatgaatccgtgcaaagtaatgtgaaagaatataaaaaggagggtaacaaatcaacatatcaatggaactatacatggaaagaaccagaacccattctttttcagttggaaaaaagtgcgtagcaatagaatctttagtgaaagcataaggtgacacaatgctgaatacttgataagtgagataccatggccatcatatcatgattaaacttaattgcaaataagggcagaacagcacaatgtcaaaatctccactagaggtggacattcacttgtataacgaccaacaactatttttatttaactgtgttaactaggattcaaactcgagacatctaatcaaaatgttatagaattatttatatttacctaccaacggaaaactctaaacagttcataacaagttaacaacaatcaaaactaaaagatatttcaacgatgataaagcaccagttttcatggttcaacggtccatgatcagtaaacttttgaaagcactccttaattttgcttcaatcaaaccatgatcctcccacctctgcgacgcacaagccctcgcaattttaaaaacaccatcaattttatctatatcaacccgcggtcttgcccaaaataaaagtccaaaaataaacacaatgttggagttcaaaccattaccctcccctctcacatgtctaggttctaactactaaaacccacaaccatttgtgttcaacaaagaatagatattgtaaatattgtccgtgttaccacgtgggcaaccgactagttgatataaatgcaatacttagcaaatttgaagctatcttcaacatgttatattataggcagactaaatgttcaagttgctatgct

SEQ ID NO: 3721 - DNA, 1235 bp, Zea mays
  misc_feature (1)..(100): optimal_loci_88072_G1, chr2:217463122..217464356, Cluster 22
cgggccacggcccaggtggcccaggccccaatatccgcccctgccctcggtcatcatgcacatagagaacatatataatctcattagcaataataattgattatatggatatctaatttgtctaatgctctgtttggatattgataatagagggcatagaattgaattgggtttgataccaaatcaatcatggtattgaaataagatgtaacttcaattatattgtttggatatcgctgaaatggagtttgcaatttgtacggtctaattccacacaatacacagaggtgacgctcgatattaggagagggagtttctaattatagtccaattccagaaaattgggtctctgattccaattctcaattctgtgtacaaccaaacaacaaaatttagtaaagatgattccaattcctaattatgtgctccaacatcgacatccaaacggaatataatatccttgtgtggtaaaattgattaatggttactagtatttatttataatatgcataccaaatggaaaaatggatgtatctgaattcgtattttagtgtttttcttcatcagacgcttcgaaatttgtattcaacgatatttgttagaatagtattgtaaagaaaacaagtatcgtaaacctatttagagtggctaactatttaattttattattaccgatgatgcattgacaccatttgttgtggtttagagcctaggacaaaaaaattaggttgctaggggattttacgagctactattgtccaatggctttgctctcatgagcttgcgagaaggtttaaccttatttgaggaagtctcttacgtccagtatagttttgaagtctttgttgctactttgcatgtgttacaaggcgaagcttggagctctcgtacttatgccgttggttgcttctatactagcttggatggatgtttagatgcccttgtgagaggagggagcaaattacatagaaaaattaatggagtgagccttttcatgcctatgagtcatatgtcatcttatatgctttcgagggcatgttgttagctcgtctaacctccaaagtcatgtcactttcaacctaattggaccagagagcagttgggtcttgcagaggggtgtacgaagccttttatgaggagtagctccaaggaaacagtacgagtggttggcatggaagttccttccttcttcttatgtcttgttcatggcccttgaccgccttacgcctgtggcg

SEQ ID NO: 3722 - DNA, 1158 bp, Zea mays
  misc_feature (1)..(100): optimal_loci_897_G1, chr1:4727593..4728750, Cluster 22
gcaggtatgtcaacttacgtaacctcagtatacaccgtttctctaggctgaatgtacgtcgcatgacatcgtaaaccaataggatgttagttctccctatacttagtatcaaaacctcgtttctcctaaacctagacactgaccatgttccgctttaaacaaaaatgcacatgaacaacagacgttgtacatagcaaccacacatgtttgcaatgtgtctggccactactacccggttacagccgatacttcctattgacttttttatttacttatcttctcggaggacaaattaagttaagttttacaatgccaaaacagaaccacatgcgctatactcgatcgaagtctatcatcttgctcacatctttagtagtacacggcagctgtgttgccactaaatccaccgttttcccttgtgccgtcgtcggatcagcaacgtatccacacagcacacaggtagtacatagctaatctgaagagccatctctgcggtgcttgggttgccgggctacagcagagatgtgagtccaaattaactgaacatgcttgctgatcaatatggccgaaaaggttaattcatgtgcgttgtgctatggtgcagtgtcagtccaccatgcatgctgcttttggtgtccaatgctttggtgtcatgaacctttgtaaaatcgcgttttttcactctcttttatatataaataaataatactcactctgccccaaattagtaggttttctaaaaatagttgacgtttcatgtttgcacacaggaatttagaagttaacaaacggtatgtcacgcatgcagaaaataaagagatatagacatgcatcaaaaagaaagaaaaaaggatatattaagagaagagaaatgtgtattagaaattgatttgttcagaaagagagagagagagagagagagagatgcattaaaaaaagaagaaaagatatgttaagagaagagaaatatatatattaggaattgaatttttagatagagttttaatcttatagtgacattaactataatgggaccgacggagggagtatataagctgtatggtcgtctgtacgtcccttacctatatatatactagttaggtgcccgtgcgttgcaacggagatcatataaatccatatgttttgctacgcaacatg

SEQ ID NO: 3723 - DNA, 1323 bp, Zea mays
  misc_feature (1)..(100): optimal_loci_89795_G1, chr2:225533288..225534610, Cluster 22
  modified_base (462)..(462): a, c, g, or t
  misc_feature (462)..(561): n is a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (895)..(895): a, c, g, or t
  misc_feature (895)..(994): n is a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
acacactataatttattagccgggaaacccaataatcctcgtaacgtcgtttccaaccaataattgaaggggcgtttaattattttggccagccaattttcttaaattttaaaaaaattttaaaaaaaataaaaaaaactcccaaaacttatacacccactcattaaaaccctcccggttttatttcccattactttccaaaatcagggtcttaggggaaccccacccccaaacgcccgcatcccctccaagaagaaaaaaaggaaaaccctccggggtttaccccctacctcacccccaaaacaaaaaaacctccggggacccaaaaacagggggggtgaaatttcccccacacctcggggaggggggcccccgggggtcctccccccaaaatataaactctttaaaaaatattttatttaaggggggaatctctcaaaatatttaaaatttttatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggtttttcgggatcatgatggtgagtgtgtatgttaggtcgtcgttaactggatcgctcgaccaactaaggaagaaacagttgcatgtcctatgattagaaccattttgcatgaccctttagggacataaaccactttgcaacgctcactctcctgtttcccgagctgctccatttctttggagctctccccatcctcatccgactatcatgacacccccagggcgcgaattactactacaccaaaattgcacgactctcttcacgttgaaaccatattgttttcggttgaaggcagcttaatgatccacagcgcagtctggtagttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtaacattgctagtatagatatagactataaatctatctcatcattagtttcattataatagttttatatcggtgggacacacaccactataatttatagtcagaaaccgaatagtctcgtacgtcgtttccaaactagtatgaatggcgctatattatttatgtcagtcaaattttcttagatttataaatagttttaaaaaaaattaaaaaaactaccaaaactagtacaacaaactaataaaaactagcacgtttatatctcacatagcttccaaaatctaggttcttaggctgactccaactccaatagcgctcgtatccagtc

SEQ ID NO: 3724 - DNA, 1232 bp, Zea mays
  misc_feature (1)..(100): optimal_loci_90267_G1, chr2:228077788..228079019, Cluster 22
  modified_base (873)..(873): a, c, g, or t
  misc_feature (873)..(972): n is a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
taaacgtatgggtattgtacaagtatgtatgtgcaatcatgcaatcgtggtttgtagttcgtttgatctccatttaagggtggcttcaaattttgcaaagatacccatccacctcttatctaatcattaactattttttctcaaaatccctctcaatcgattaggtttcatcacatattattgctccttattgctaagataagtatatatgttaggcatttgttagaactagagtcttcggcaaagacgatgtggatatctccaacactaaggttgtccacgacatatcgtgtaaaataggatatttgtactgtagatagcactgtttgcagtgtgaggtttgagataggggatgtgataggagagctaatgaagatagctaaacctgttatcccctgactgtgtggattggtcagtgttgccatttgcactccagagaatttataccactatatagtacaccagtttaaactttgcaaaacccactcaacaaatcacctcgcacacataaccttcactaaatccaccaaacaaattgcacccacttagcatgccattaaaaccaaggattagatcgttggataactcactctctcttactcactcaagtccaatgaataatattatttgaattatccctccccttgtgagcccaccaccccgggccccaacctccccctgaccccgcaacccctcctcacttatgtcgctgtcgacccctcttctcttcagggtcagtcttctataccttaaactctgcaagacttaccaaaccaaatcaccccacacccgtaacatctactaaatccaccaaataaattacacccgaacttaacacaccatcaaaaccaacggttcagatcgttggataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggacatcttctggcatttttttagggtggcgaaatttcgaataccgaaatcaaaaaggtagtagagggagccggagatcgagaaggcgaacgacgggcggcaacgggagatcgacttgggctctttgcatgcatgtatgcattcgcatctctgtaatctggtttgttgtttattgccaaaaaaccttaccaacgttctgatgtttgcttgtcaaatttttttttttggtaactttcgcttgctttccaaatctttgtc

SEQ ID NO: 3725 - DNA, 1006 bp, Zea mays
  misc_feature (1)..(100): optimal_loci_90949_G1, chr2:230629051..230630056, Cluster 22
taagacaagtgtaatatttgttcttatcggtttaatatttgatatatggattatatattcactttgacattatatttatttttatgaatattaagtatgattgtgtgtcgtcgcagcgtccgatcattgtactagtatccattgtactagtatccataaaagtgtggttaaactgcttgagtatatgccaaagcgaggacagtctgaatgtccataaaagtgaggaaaatatgcttgaatatccatagaatgtggataatccatgcagtgcgtagataatctacaatcttattaatggtctattacaattctatgcttgaaatttcgaggaacatctactcaccctcatgggtaaagtacattttaggatataacccatgttctaatccgttgcactcactcacatgggtacccccgatgaagagatgatgacaactgataggtgggatgcaataaatatccatcttgtggatgtacaaacacctggagacgtcttttcacttttcacccctcgcggtcgcggcagtacctgaatattgaaaggtcaacgaccctctggattgcacttgtgcttcagcttctggacacttggacagtagtgtcttttttgcacatcagccctccatagacacgtaatagtagcacaaccaccctctagtgggtcgaaacgtatattgagtatgggattttttttttttgtatcgagcgcgtcaagaaaacttggttttatgaacatcacatcataaaacatgctttggcatgatggacactataaaatgtgtatttatgcacgtagtatattatacgtatcaattagaagacccctttgtatgcatagagagatgcgtggtgaaagaactaaaataactttagggcttcttcgggagaagtgtctccttctagtgtaatagaatagttgccactatctccatgtgaacccgtacagaaataggtagactagccatatgaattttctctctcttcccttctggaaatcctgcgttat

SEQ ID NO: 3726 - DNA, 1185 bp, Zea mays
  misc_feature (1)..(100): optimal_loci_91003_G1, chr2:230878308..230879492, Cluster 22
acctacaatacacccccaccatgagtttctatagtgatgagttctgttgtggcacctaataagagttctattacatgattgtggagttttcaatctaatgtaaaattgaaaacctatttgatagttatgaccttttccattttattgcaaattagcacagtatgaaacagaatagacgattatagaaggcacattaatagcagtgctgcagtggaccacaatatcaaagtctagaaggccaaacttgtatccgtaagtgatgaccatatcaaaagtagaccaagcttatatcaacaagttgaataggacaccttttttacttttttaagttagtattgttaggttcatatatgctcgcatgtatttagttgaaatctgatgccaccttggtggctgactgactttatcatatatttatcaatgaagtagatgaaagaaattcttctgaaaaatgtagccatgctatttagatgtatccaaattgcaaattctacctataacctttggtcagaatttaatgagagtttgttcaacgcattctagggtgccatttattttaccctgttttggtgtgtgtttgggggggggggggatgtctaccttgtaaatgcagccaaagctacctttgccaattagattcctgtcagagaagttatttgtagcaccaaccaactgggacaaactgaacttgaatgcatctgttatgacagaagaaagacctttgaggtcctaaaatcaatctaggcattccaaaactctactattttccacaaccataccgatgtagtttctgatcacctttttcctatttaactgaccatacctgcgcaattcacttggagggagcaccttttaacttcactatacacttcagtcctgccacatggtgagtgaattcaattatgctatctaagaattaaaaatgttatccttgtaccttacatgtcagtttaaaaaaggctaaaaattctatattgtgtacaagacttttcaccaaactatctctctaaagtagagaacttcttaacaaaattcaaaaccacatgtagacagacttgattcttgtagtaggacttggtttaaaaaaatctcatcgttgtgccccgtccgctcccgcgttacgtctcgtgtgccaccctccggctaggccgttgcagagtgggcggtgacggcccgcgggccagt

SEQ ID NO: 3727 - DNA, 1159 bp, Zea mays
  misc_feature (1)..(100): optimal_loci_93575_G1, chr3:7207297..7208455, Cluster 22
taaacttttagtaattagtctcggttcaatcattattcggtagtccctttgttagccgcaccttgttaggaatctaataaataaatcgatgagtctaacatagtcataaaggaaacaaatcgccgtagacttataacgtgacacaacaacacgctgagtgcatgttagttagatgattgtagccataacgtatagagtgttagtccttatattatatatgtgtatttttcagtcttacagattaattattaatcatcgaaagttgaggccttttttatttaacattagagttgaaagttaagcacattagccttctcttcactctaaaaagactatctctatgcacttctactcgaatgtggcgcttggaacttttagaattgcttggagatgttgcacaagtgtttgggaatgaaagcacaattattgttgtttgtctaggtcgtctaaagacgtatttatagcccaaaaaaaccccaattagtcgttaggcgagatccaaaaatatgcaccttagtgctcatatttttatggtttccatgtaaaacatcatatgtaataacattgctacagctttatgactcctaaaaaggcgtcactatttgctataacccgtgattttcaacgttaaccaccgttgaagggtatggtataacaacgttttactgtttatctaatgtgcattaaaattataacggaatttccactgtgattggtcttataaaagacacgaacacctagggcgagatcttgtgacgatttattgatctaaggctaggcccaactagattcgttgtcgaccgtgggggaggggttgcattggatggtgtcatcgatactgacacgaaccgttcggtggcaaccatgtttagtgacgtgacataatctaattaatccgcgtatgttgtgtgcgccatgtcgcctttttacaccatttgaagtccaaaagaaatccaaaaaatagaacctgaccaataaatcaaattttatttgtcgattaaccaatgagatgtcagatggtatcgaaggctaagaaccggcgctagattataaatcagctgcctcatcaacttgttgggattctacatgtagcacggcttaagaattcatcgagccatcatatgtttatctttttgataaaaaatagcatatttatctt

SEQ ID NO: 3728 - DNA, 1106 bp, Zea mays
  misc_feature (1)..(100): optimal_loci_94946_G1, chr3:14938630..14939735, Cluster 22
aaataagttagattatataatctagacagataataatctcaaacaaaaaaaccttagtttagtattcacccagaccactttactttttttcttactttatccgttcgaaattgaaaactctggtcgttgtgacttgtatgatgccaagatctagagacaaatccttatatgacataaagtgtacatatcatttacataccattcaaagttatacattcccttcatcatcatgagttttaatctttcttgccccttatatgccactattatgggtttgcactcactttattctagtgcgaaagtggaaaaaagacaaatttacccctagataaagcataagaaagtttttttaatgggtctttcaatccttccatgtcattgaactcatgaacaagtatacatatatcggtgtcctaccttgctacgtgcacaacattcaacagttgaaatatgtaaaattgacggtggaaaacatacaagtgatcaaatgtataaatgaacagaaacaaggaaggcaataatttctagtggcatatataacggtcaaaaattgtctgcaagtagtttgattgtctgaaggaacatggcgccaaactgaagctgacagagatatggatggatggatggatggatgggtgatattaataactcagatttgcctgtaactcctatccatgatctgtccggatcctttggacctttttgacgttctccggcgacggaaattgctgctgccttctggacgtgttagctagactcacttttcttttttggacattcttaacaagaacggaaaccaatggctctcaacctttcatggacacaaaacagtcgtttacctgacatggagggcgacaataataatagagcgaatttcttggagaatcaggtggccatcaagtgggccggtcgagacgtcgtgagtacgtgacgagatacttgcaggccggcccattaggccattaccattttagacatcgttataccatgccgtatgcaatcagaccctaggtgtaatcatttattctagtcctttccatgcccatccaaagatggatcaataatttctaatttggctctcccaccagtacgttccaccagcgtgt

SEQ ID NO: 3729 - DNA, 1120 bp, Zea mays
  misc_feature (1)..(100): optimal_loci_96212_G1, chr3:21853327..21854446, Cluster 22
tttgattatcaatggtgctagtagcgcaagttaccgatgactggaagtagggacattctacccaaatcagtataaatcttgcgctctccgtacacgccctccggagcctggaacgagtacaataaatttacttgtcgaagcgaggtacaaaacaccgacaagtagtaattcacaatccatcacccataaataatgatcattttgatcaaacaaatcgatccacggagcaaagtacaaggtgattaggcaagtctagatttgtcacaagacagaaaacctagtaattcaagaaatatcagctagttttgttgatcaaagtgtccccaattacgaacatagtttagaaaacatatctgagtactaagttcggttgggggcaaggcaggagaatagctgcagctgcaacctgccgtcgatcccaaaatggcctcctgagcgattttttttcttcaaaaactaaagagagtttcagatcaaagagtaaggtaaagacgaagccatctttacagcaacttctatcaaaatgccggtacatagccatgaaaaagcaacaaaaaaaaggcaaggcaatatcagaaaaggaattcttcgttgcctagaaaagacatacatgaacatcattgacggtcacctcatttgtcttcatatatactacatcagaccatgtgccatgtactatctatccaggtatatctaaccataatccatggttttgaaataatcatgtggacggttagtgctcattaattttgtattaaaccacttttccattttcatgatgtcctttttaggtgcttgtgggggtcttgaaaaaactagatgacatatgttctcgattctacaggcaagatggtcatttcgaaaataaatagagactgatcaaatggaagattatttgtcaacataaagaatatagcggattgggggtagccaatctagccattaagaacatttacttagcaaattgctttttagattattcaatgaagatggtacattggtacatggcggaaaattgttcaaaataaatatttaggatccaaatcgcttacgcaagtcgtgggaagaccaagtgactcatattttttgtatgggttcatgaatattaaagcagaattct

SEQ ID NO: 3730 - DNA, 1323 bp, Zea mays
  misc_feature (1)..(100): optimal_loci_99886_G1, chr3:43355890..43357212, Cluster 22
acagaacataaaaaatatatttattattcaagaatcaacaatgtaattgacagtagaaagatcatgccgtttgtaacattaccatatatatcatacgacatgtcatggcaaaatcgtatagagaactacctgctttgaaggaaatcctgccatagagtggggacttactagtacatagttctcaggataaatatgccctttataggggcgggcctagaacaaaatgagagtagggacttacttgtaaagataagcaccaaaatattatagaggggcatctaaacgacgttgagcagaggattttatggtaaaaatttagactctactacttataaatgataaatgaacggaggtctaacccctcacttggacatatgtaggtccgtccctgtccctcagtttactttccgtatgtgtcttcctaggaatttcacaataatagacaaagaaaaaatccccccccccccccccctcccaagctcaacttttcttcccttactctttccttaaacttttttcttgtaacaacaaacaaaagatgctctctctctctctctcctcagcttcagcccatacctgtctttgtggttcccagaaatgttccacgtactacatgcgcttgacaagatcgcagagaatccgatgcagagggcacgcgtgcacgcacggccggacgcacgtatcactgctgtttgttgttgggttgcttgcattggctggcgcccacgctagagacacacacagagagagggtggagtcatatcaatgtaccaacggatgggtcgacgtcgaagaggcagctagctatacctctggctccgagaaggaatcggttgctcacgcatcttttgcttcccgcgaggagaaatttctcttgctgcttgcttgttgcgcgacatgagatgagatgagatgagatgagttggatgcacgcacgtctccatccaaaacagcttctaacagcaggcgtggtgtgcaacagacagctcttgcctcacaaacgcacacatacacacgttctggtttaatttcttaaagaagaaaaaaaacccacgcactacatacgtagcacaaaaaagaactattattattatagttatttttattatgttgttgttgtttacttaatgcagccaataggtgacatatatatgatatatatatgcataattctataagtataagtactgcatgcctagaacacaagacgtttggtcaaaccaaaagaaatctataaacattaatgattatcatattgtttaatttgaaaacatgtaagctggtactaggtcattatctgatgcagtatttgccgttactaac

SEQ ID NO: 3731 - DNA, 3965 bp, Zea mays
  misc_feature (1)..(100): optimal_loci_31710_G1, chr1:194939396..194943360, Cluster 23
gtttgtttcaatttcataatttaccattgcaacagctgctcttcgacgcagaaacatttgtcgtggttggagaaatatgtatatgtgcaaccaacaaagttcagattgattacgacgaagatcggcgctagcttgtttcaagagaaaacaaatgcatctcttgaggcaacatcggagagacaaaaatggcatgtagttttcttacacacaacggaattgctgatgaaggttttagtgattgatggatgatatttgtagtaactagttttattcatcaagggaagtttgttccaatggaaatgtgcacaactactaaaaatatcttatcgtctcagaaggaagaattggtgaatatatttagcctcatttcctagacgcatacatatattccatactaagtcaataaatccatggacaccaaaatgctgcataattagcgaatgcaaggatgcctcgccggttttaagaaattctggtagtagcttgcaagccaacgccaagacgacgaactagtcttaagttgaaaagatcctgatggtaaaactctatcatctttcctttgcctcattgtcttgcatgacaattttttggtttttctgtgttctgatttaattggttgaatgttgtaagacagaaactgggttacttcattatcttaatgaaataaaatcccttcataaaaaaaaagcttgaatgtcttagtgatctagctcgtatttctctcttttgaagcttccttgtccgttgcagtatcgtccaattgcagaaaaaatggtgtggaaatttgatgttttcttgtgccaagatggctcatcaggtgttgtatttgtatatattctctcccttttaaaattaggcaatatcgggtggttagtgacttggttctctcaccatgatgccactatcaacctccatttgttcagaagatattcgcaaaaatatacagccattctaattaagttcgtgttgtggaagatgtaaatctgttgtcctaacctgtctaaatatgaacaaagataactagattgtttgcacgtatagacacagcaccaaattcgaccaaatctggcctcattgcagaagtgtaaaatgttaacaactactacgcacagctcctgctgtatttgtgtaaaactgacaaagaaacttgtgggcggcggattcggtgagctttatctctacgtgttgcactttagatgtttatatataaattctgttgacaaaagattactggagtttctagttccacccagttaaggccgtacgccaaccctttgaagagttgggatcttctacgtggcatgattcatttctgacagggattattattaatggagaagtttccttaagttcgaagcatggctaaacaagcaacacctaactaacctcctgcatagggtaaaacagtccccgaatattgtattaagaagaagacaggtgaagtaaactcgtaaagcggcaccatatatagggcattgtgagaacggtcgcagttaggattgggtcttagacatgtgcttttggcgtgagattcagaagatctaaggattgctacgcagaccgcctaatcatataaattatgaaccaatgcatggattaactaataatatcgatagatgtgtcttttttttctctctattctgtgggatcggatcagttgattcgctcactttcactcacttttcttttgcgccgatgtgtccgcagttaccttccccatcatgaacttggagaccgaaaggtgtggtgcctagttaccccgtactgcaatttaccaatggcgctggggtggaaataaagggcaggcgcacaacacagaaaggaccagcagcagcaccaccaccaccgggcactagctagctagctctctggtcaatggagcatgcagcttagctgggattcagacactgttgctggcttgctgctgctgcaattgcttgttcaaggcgaacacaagagagatccgaagcatggttgagtctctgggcgtagaaaacagtgccggtttccatcggttagacaagaacgcaagagagagatcgtccatacgacgtgcatgaggaccagatggagattcagagacgaccccatcttctttgcataaagaaactagatgaagcttgtgtcgtcgcctataagaaatgaaacatctgcattgtcagcgtagtatcccagctgatggagaggacatacccatgaggcaataaatcaaacgaccttttaatttttacagccaatgcattgcatgctgcattatcaaactggcgaaaagtgcttttttttaagggggggaaggctaccatgggttgcattgaccgagtgccccctctcgtagggcctatgccacattactttcttgaaaggcaaccacaggctgatctggaagtccattccacggtggcatgcatgggcggcgccacacgtcagtcatccgctcgagggcaagcttcggtcgatcgatgacgctgcccggctgcatgccggaggaatagtggagaagggtgcagagcagagggatggtcagatcattccagttgctgcttttcggcacttgcatatgtgatatatggagcaaacagcaccgctggctggatggatcggatcgcatacaccatatatgatcgaagatgagcctagccatgcatgttgcaatatggactactatgtacatctgtcgcacgtactagcttgatattaattcagtgtacatccaattacacacatgcatatgcagtaactggacgtttatttgcacacttgcactatatacacatcgatcagacgtcgctccagagtacattcagcactgggtttttcttttctttgggactgactgctatgctagcaagtcactaactcactatagctagctagctagctttgtcttgtgttttttttccctgtggatggatcgtcctggcagtggaggagattgttggtggggtggtggagctgagatgcagcattatttgaaagagatgcgcgtcaaatgattaagtcagggacgcctttccacatattcgtgattcagttgggcatattgcactgcaggcaggctagctagttgaccagaaaagtgagttgttgttgcattgcattgcatgcatgagatccaagtacgtgttaacctgggtaggatgtttcctaacatgatcacacacttccccatcatcatatcactagtaagctagcccttgctggaatgtacaggacccaacaaaaagaccatgcatgcatgcatgactaaagtccataatgtaacactgacagacagaggatatagatagaacagccgcgccggcctgaagaaacatcagcaggtcatcaaccacttagtggctgcatgctcctactagtctcggcaggccatttctttctagaggacaaaaacgcttgcaagggtactctagcttagacgggcagagatcgagatgggtagctagtgggaggtgtggtaatgctgtgcccatttgctggaggctagctgcttgttggagagctagctaaggcgtgggagaggccagggggggataagagatgatgctcgggcaaggcaacttgggtggtcgggccgagacctgcaaaaggcaagtagtagctgagctgggacgacggcattggaggcctcttttttccgatcccgctttaccacttctttctatcgcatctcatcgatcccccaatcccagccgatcctcgctcatcgtggccccataatgcgtgctgcccgctagcttagctgccattgccattggaagcaccagtccatagcagcgcgttgctgcatccggcggctgcctgttggggaggagacgatgcatgcacgcgtccaatccggttgttcgttctcaataatatcaccccggcccggcccgtatttagagatattcgcccgagcgcagtccagctagcacagcaacgcagtcgcagtgcatgcaatgcaagttggagtctgtcagcgttac

SEQ ID NO: 3732 - DNA, 1416 bp, Zea mays
  misc_feature (1)..(100): optimal_loci_101092_G1, chr3:49548588..49550003, Cluster 23
aggtgcctttttattttacatatttataaattgatattgatgaatatttaatttatatattaatctatgtacatacaaatgtacaagcaagtaatatagtagtatataaaaatagtaatatttgtatattagtatatacaaataaatagtaataagtattattatattaaattcaaagccaagaaacttcattaaatccaaaggtagtagttcattactttattctcgaagtattccttcacctcaatgttgtaccaattgtagataaattagcccttagcatatgcaatgaaaagttacatccaattgaaacatcactcatagccctaacgtcaagtttactagaacatcactcatagacctaagggctagtttatttattggaacatcactcatagcacacaaactagtttactgaaacatcactcattcctaagagctagttagatgcactattcattgccttcctaagggccagttcatgattcacctttacatcggcactaccaataggacaacaatgacaaggaggcaaagtgacatgcaaagaacttgctatgggctccacctcatcactagtgatagtgacaaggaaacaagttggtgtagcgacatcccttagccacaaactaacccttagcacaaggaataaaacaaatatattcaactggaacatcacaattaactctaagggctactttactagaacatcactcatgatacatcacttattgccctaagagctagttagatgtctcttcatattttgtaccttaagggttagttcatgattcaacttctccttcattttatggccatccatattagcatgattcatatgaaaaaatataaaacaaaaaaataaggtttaatgttcagctcaagtataatgatatccttgttaaaataaccctaaacccaaatactttgagtcatgatcctaaactctaaatgatgtggcattatggataacaagaaaaaacttggacaaacatcactttctatatatcaagcttgtcagtgtgtgtaagaaacacaaactctataccaaagatacacaagaataatgctactagttgaatagactagaataatggtataacaaagcttcaatttttgatgtgttcgtcgggggtcatggtatcactgttgcatgtgatggcaagttgtcctcgaaccatgtggcggtgcagtgagagagggctcgacgagctcacaaatgagaaaatcttaggaaaggctgaatatatagaggtaactttagtactagttttaacaaaaaaagtactaaagatcaatttagtacaagttcatacaaagaactagtagtgaagatttcaggaaaaaaacagttagtaccggttctttgtcgtgcgttgtggcccgtgaggttcgaacttacaacgtcccttttac

SEQ ID NO: 3733 - DNA, 1534 bp, Zea mays
  misc_feature (1)..(100): optimal_loci_102571_G1, chr3:58060106..58061639, Cluster 23
agttcttttgagcaatgatgctatgatttttgacgttactaattaataacaatgacaatttgctgagctctgctcaactgttaattgtaacaatcccagaaatttgcgcggaaccttgtgaatgtggcttatccatttcaacttccttttgtaaacatggagccaagaaaccgcaattatgttggttgtaaactgcttgacttacaacaaaggactggtttgtcttcagattcaggcaggcatgtgccagctcccatccgtccgctaaattcctaaataactggtagttagagttttctggttgtataattagcatcatggtaaatttccatcagtttataatttgtggtgctcattgtcaacactgaaaacctttcatttaaactgatcttttatgttgatctttaattactactgcttcggtgcagactgatccaaaatggagtgattttctgtacgatgatgctacaaggaaaattcagtctgattgacattggagcaagccgtggttttccaaaacgctttgtagatgattatctccagtgagatcccgttccaagattacgagcaatgtaatttcagtgacgaccattcagatgtagcatctagtgctggatagtaacgtcgaagagatcttcgtttccgatgtcttgtgtgactgaaatagttccttctcggctgcagctcattaccatgtaaaaacctattgggctattacaagcagcgtaccacgttactttacctcattttctacgtcgttctcgttgatctgcgaactttgtgactacgttcataatccctgagaatttggttggtggactcgcatagtgtgtgcgcagcctgaacactgacagccttattgattacgcactaatatcgttgataagttcattgaaacataatgtggctgtagtttagtggtgagaattccacgttgtggccgtggagacctgggctcgaatcccagcagccacaaaatttttttatttttttttattttgtcttagaaacgcaacgcccttggcccatttatctctttttttttaatgtatgtcttgcagagttactgttttcttagattgctagctagactattttagccactaccttcttacgtaagtatttctgttccagttaactaagtatggatctcaggaggttgcctattctggttttctcgtggcaacattctgcgcttaacaatttggagcgttggtgatttgttcagggcatcttcctatattattgactggatatacttcttttaaagtttccacgttaatctttatggtatgtgatatcaaaatatataaatttagaagttctaaaagaaatatatttgtgaccgtcgatgtagattttacgggttctaaagaaaatgtaattctatgcatcaatttatgttcaactattaacgtcaacaatgtccattggatccatttattttcaaattgccatctctcgtaaaaggataaaaagattgagacatttctttcctaacatgtcaccaagaaaacgcatacgtcatcggtat

SEQ ID NO: 3734 - DNA, 1582 bp, Zea mays
  misc_feature (1)..(100): optimal_loci_106255_G1, chr3:85781962..85783543, Cluster 23
tatggcggccaccggatcctccacctcgaccgagatggcaaaggtgggaagaaagagaggattgggaacgctcagagctgaattcaataaaatcttgggtccggaaggtgtttttcctgttgctcgtgccacgcgtcgacggaagccacagccgcactccgtggaatgcggggaggcgtgcaaatggtgtcaggttttaataactccgatgagttttcccaagccaaaacttgttatctatagacctcccagcaccaccatctaccgtgctcgatctgaactacttatagcacacaagcagtggtacccagcagtaaatactcgcaatatatttgcaatttaggtaagataattattcaagtcgtgtagattttaaactaaccacaattgattctttagtcatctctccgtcccttcatttcttaacacgatagcagtttagatgcacagcaatctttatcaccgtgttaaaatttatccaattgcctctacgtgtttcaatcattcgcattgcactactgtatgcttttaatgtgtatttactataatgtcatgttgtatctatatatgttttggcttccttatttgtcgacaagttttacatatatatataggtaaggttggaaaaaaattgtagaccgcgttcattgatgaagacacattattttccatttgttttatccatgaagctgcaaggagcaacgattacggaagcacattcaccgtgtgtttaattggccaagcaggttttctaactttcaaagggaaaacacatgcatgcatgaacgatggagtacgttaccagtttaccaccaataactctcaagacttcccgatgcctcacatgtctttgctgggtacatctagccaagctagattatttaggcacctgcagccaccatgtagtcttaagcatttttgttaagttatacacagttaaaaccttaaactatataggaaacgatttgtactggctcagcaggatttgttttactatatgatataaattttattcaactgctttcttagacctgacacatggaaattttcagaatttgcaattatatattgtatttaattgtgcttacaaagattagaacacaatatctttagctttgcattctactgagttggatgtgctgatcagtccaactaaaatattaagctcatggagaaaattaggcaattcacttatatattcttctagaattgctataaagtgaagcctttagattgaccttacaagtaagtcaggcgccattgctgtgtgcatatggctcctacacctaccatacataattgttagctagaccaaaacatagagtgcatatgatataatgaggtactgtagtttctttctttccttctaattaataattaaggcgggatggagctttgtataagtataactgagttatatacatgatatagtctggaaatcttaaactatataggaaattatttatacttcaaaaatccaccccctcgtgtgaagtctttctttgacctgacacattgaaatttcagattttgtatttatatgttgtatttaattgtgtttgcaaagattagaagacgatat

SEQ ID NO: 3735 - DNA, 1526 bp, Zea mays
  misc_feature (1)..(100): optimal_loci_107909_G1, chr3:96026188..96027713, Cluster 23
cacgacgtgatatgttaacaataattaaccgacaaataattagtttgcaacaattattctgggcatgtttggaatcttggctcatagatgcctttttctcttgtcatgatctagcaccaattagaaaggtcaaatgactagtgagcaaacaatttgtcaatcctcccgctaacaataagccaacttattagatagcctgtttagagtccaaggtgctaaaattagctagcaaactgtttcctagatggatctaaacacacctttactttagctattcagctatttaaggcttacttcaggcttttaatatttcaacatgcaataggagcaaatattgaactattgattgcgtacgtgtctgatctaggaccactcgtgtggagtatgtatgttaacatgcatggtgctttatatactagatactagattactcctagtagtatattaattcatataattcatgcatgatatcggtcggtactagattactcccagtagtatttccctcatcctccatctttggcagattttgcttcacatttcctcgctaggatttgtttccctggtagttttcggcactaaagttaattagaatttcttgtaaccgatctaccttcttcattcagcattctaaacaacttcagccactttctatgttgtcacagtaagttgcttaatcaccgattgtgcatcaaagaggcgggaaaacttcgatgtgtggccattaagaacttctcggaactgtgaaataaatatacagtagattgcgagacgaacagctaatctattgccaactattccattcaggtgcacttcattacttagaacaatgtgcttactgtctccttcagctgcactgcactacgtttcgcacaaaaggaaaaaaaaaacttgaatggtgccacatgccatcgttaaatccaaaagaaaagccgggtccactccaagacgctacaattaagggttctaggcttgtgctgcaactctttcagtattgaagtccctacaccatgcaattgacttgagttgtcaatcacatttggtccttgggattccaagcgagcctcccgaggatcagtgtcaagattccagtggctcttaagaccaagattagaaaaactgcttcaaagttcttgtttcgatacctaagaagcctgcgacttcattgaacactgggtaggattcgataggccaaggatccgatcatgctcgagagtccaagacacagcatcttagattttcctgatcctctcgctgaatgtagctggttgacctcctcctgtctatagacaatattcacatattttaggggttatgtgaacattgtaggggagtaatttgaactttttccattctaaaaacacgtattaaacatatgttgttttattgttagcaccatatagctaattgatagtacggttatatcatttatatggttgatcgtgtttgtctattttaagtgtctgagaaaaggattaagacgaaccacactcatgtcgctgagctgacactataagaaaccctaa

SEQ ID NO: 3736 - DNA, 1518 bp, Zea mays
  misc_feature (1)..(100): optimal_loci_112438_G1, chr3:127229126..127230643, Cluster 23
tgacaaccacatgaacatttatgcgcgcacacacacatctccataccatgtttacctgcagcccaaaggtggtcctgttcttgctgctcaattggagcaaggataccgccaagctcgagaggttgtacgagccaataatgacattcatatttcttggatatattatgagaaaatttagtggtcaaaagcatacttttgaagacttaaaaattcataattcgcctacgtttgttcttcatcatggctttgtgataacatggaaggcatactgctatcttatgcccttgtgccttttacatgtacctcaacgagattacttttatcaaataattctcaaatgtgtatcttgaagatatttgtccaaccctgttttctctgtcttaatgcaggtgttgttagtagcagtttataacgttatgtttttagatatttgtccaaccgctatgtttttagatccaaagaaacagaacaacactgtctacaaatgttacattgtgttttcaatattgtactattgtaatatgagcatgtatttttacataataatatcaatgttgcaagacgtcctctgtttttaattgtcaatcttctctagctttgaactgacaacttttttgagcatttgatcttgaacactttgctttattgacttggttttgcagctatctggttccaaaatacgagcatgtatcacttcagcatgtttcatgcctcccatcacttggagcccattatagcaactgaggacgaggtaagcgcaccctctgataagatcaagtatctttaaaaacttatagacaacctgctggataaattgcaatgctaatctcacctgttgttccattcaatatttttcatttttgtaagagaggcataagctttgaagtagacagaactgattatgtgtgtggagtcgtaggattgaagtagtatgaacaaacaataatcaagatattattaactagtgacattccttttcataattatccatgacatatattcaaatgcaatgattaaaccaaacacatagaaagagactgaacataacgatgcttatcagattggaattgcaggaaaaccttcatctgatgtagcaagcacaccacaaacagaagtgcaataaaagcataactcagacacataaccacaaacagaagtgcaataaaagcataacccaggcacatatatatgtgcactaaaatagcagcgtctccttcttcacgataaacatgtaactctaggtgcttgattaagaggcatcactgttatttccacgttattaatctaccctaaaaatgttataaatgattacatatgaggatgggcaggactcaggagagtatcctaaaaaaattataaaattttggcggctgaatgcggtgaaagggaatacaaaatacagtggggcaatgtgggccgtgtaatagaaatatgagttgttattgctggccttagtcgtgtatcaagaaacactataagtgaagttaggctcgaggacagaggcacgcaagacaacaa

SEQ ID NO: 3737 - DNA, 1477 bp, Zea mays
  misc_feature (1)..(100): optimal_loci_113314_G1, chr3:132024180..132025656, Cluster 23
aaattagttcgttagaaactaaaacccctataagtagcctgtttttcttctcttttaatttaattttcttttatgccactataaaactaatataggtatctgttgcagctggtccacgtaaccttatcatactttattgctctggtgcggctttcattgcctggggccgagcgccatgagacagagagataagatttttgtcttgtcgttgtgccacgtcgttgagaaccacaagaataatgtggcaccgtggctgagttagggtgagcttcggcttccggatcgtgctactagattttttttctttttttgtgttgttcgatccagacatccaccagtatccaatgctacacctgcactaccgatcgtccactgcctttggaaccggcaatgaatccatgtcaggagcggtgggagagagagagcaaagttagtatagatctaaattgaatttgtgcctatccatatctagttatttgtgcgctttatctcaccgtaatcattattttagttactccttaaaatttgtactccagtactcagattagattattctccgtagaaattttgtaggcatcttttcaacgctaccatataatcaaaaatactatgaaactatgaatgcctctcaatattttacttcactatttataaactagcgtactaattaaatgttgtaacttaatgatcaatagaagttagtaaaatatataaagatgaaacaaatcactctcaatgaatgcttcacacgttttctaatacctgggaaataagttgatatagttttctccccatgaaattaataccatcccataaaattcaatcatcttaaatgctatatcatatcatcaaataatctgatgtgacacacttttaaatatatacgaaactaccatagaaccaccattaataacaaccttagacactataattaatgttgtgctataaccaatgcagtagctaggattttagtgatggatggtctcgtttaaccttttttaactatataaatgcaacatatagacatgtaaataaaaaataccgaatacaatatggtcagataaaaaggtattacaatcatctaacatcttagaaataaaaattataaaaatcatctagcatcttaaaaataaaaattataattttttacctaatataatatggttttatatactgcacacgtacatatgactctataagaattgatcgatccgatattgttgatgagatttacgatacctacgcgacaagggcgaccttgtcctgtctaagccacttgacgcgggtgacaagcgtgcaatgtgttttactgagcctggaacacgtacgcaccgtattggtgctcaatctgcttggagtgccatggtgcatgcttgttctagaacctagtgtggctgcatgcccaagctcctagcttcacatgatgttgtgatttgttgtagacgcgtcaaataaataaaacaaatttactggttaa

SEQ ID NO: 3738 - DNA, 1595 bp, Zea mays
  misc_feature (1)..(100): optimal_loci_113813_G1, chr3:134909127..134910721, Cluster 23
tttaaaatgctatgtagtttatttaagtattcaaaagacacaacaaattaatattcactttatccttaaatttaaaaatctttaatatggtaatacctcttgctaaaatcactttgataaaatacgctatttcaccagataatacatattgcaactagatcaaacattctactctcaaattttccatattttcagaacttatccgtcttccagagtccagacaaaatgccaattgcagaaacttttgctagcacatctgtgcacacaaataaatccatttggagccataatgatctggtgccaataacggaatcctgtctcctgcactctattcttttttttcaatcattcagcagcctggatttcataaaacctatgcacgtaacagcatgccagatttcacaccgaaggaataacaatatactcactccatacaaatttataatttgtttgaattttttaccaaatttgatcagttcatcttattcaaaaaaaattggaaagtgaaaaattcaaagttattcttaaatcatataataatgatattatagtaaaaattaataataataataatgtatttttaaaataagacgagctggtcaaacttagagttaaaagtcaaatgaatcataaattggaacggagagtataattatctgagcgcatgtttgcttaagttgttgcttttgcacaaattactgtgagttgtgagctataaaaaatatgttatacattacgggttgtgggaaaattgagagtagtttgattcaacaagtatgacttctttgaaaagctacgtcagcttcacatataatcccaccccacgtatcaatcacctaatacacttttctttgttttttctatgtttcttctgattcgctgatgaggccatgaatgccactcaatgcctctctatgtcatgctcttgttgcctagtcctcaatgactagaggtggacgacgacatcacccgtggcggcccatgtgactaaagtttgtggtatcattgaatatctaatgaagattgttgcaggctccgatcatcattatgaggggccattatgtccattctccatgggagattcaagaagagcaactatagtgaaattgtggcttgttcgagtgcctcgcaagggtgatacttatggcgtccttattgtgggattgacatataatgaaaattagagcatgaatcatctagcctggactcgccacaataacaacatatgttgtcggcaagtaactgaacctcagggatatatattcagtcatctcttgccctatatggtttgcagtccatacctattcttaggactgcatatacttattgtatcatatttttctatttagccttgtgtcgattattgttgagttttatctctttctagtaagtagctcgctacaatcaatactatctttttaccaagctgctagattgattagaagctagcatagagttatttagaactagaacaagcatacacttccatgccaataaacttaatcttagtgttaatattgagttttgtataacaatttttataggccattcacctaccaatagccatctagatcctagcaaaagccatcttgagt

SEQ ID NO: 3739 - DNA, 1791 bp, Zea mays
  misc_feature (1)..(100): optimal_loci_118862_G1, chr3:166394837..166396627, Cluster 23
aaatctagtcaagatggggtgaagtcaccttgattgggttcctgctgtcgtcccgaccactatgctagagcttgtgaaagtcggcttggtcaggtttggaggacgacatggccaagattgcttggattacaaaccaatttatttcattgatttttgacatgggaatcttacagagaatatgttttatagttgttttctatagagataagaccacacccttctacatataagagcatcagggtggatcgaggtatttaacatccaattgagcaaaaaaaaacaattgattatctctctttaaattgtatgttagtgttggtcgattgatctaattatcaagtatggcactctaggcttgccaaccgatctagagcaacctgacgacattctttccctcatgaggtccctccgaggtgagagctttgataattatttctttagtttgcttgaaaactagccattcttttcatgtaagcacgattggttattctttgatggtttgctcgtaaatctctctgttcttcaccatgcaaatgtgatatcttcactgcattctttggttcttggtgaccagagtgatctagctctagctggtctgtgatcccattcagtgtcaacatactttttgtgacttggttggaaaagaattgcttcagttctactttatagctgaatctctttgccctagctatactcttcgtttatccatcattcttctacttgccattaccattatatctaacctaaaagtctatcctatctagttatcaccctctcttgttcttattattgtgcaacatgttattatataagtctatcaagacaattaagaactagaatcatggaataccaaggtatgacaccataaaaccactacatttgtctggaggtacaacatgcaaatacatcatgattgtagtaattattttgcaaatcatatgaaatatcatgttgatgttactagctataaaaacaatagatctattgcatcaactaattattatgtttataatggtcttcatcttaaacatcataatgctaggtatcatgttcacaagccaatgtcaactatgaattctttgggggtttagtgctgctagcaacatacaacatgtatatatttatttattggccgtaagttcacaacatatggttccaccataaggtatattgagataattggctataattatgctaattatttataaaattactctaatttttcagcgccatatgcaagtgttcatgctcataatttggcttattatgttatgtctaagtcgagacaaactaatgaaaattcagcaatatgtgctaattgtaatactcatgattcggcttcatatgttgctcctaactcaagccaaatcaatgaaaggtgagttaacgtcgttaatattcatgattcagcttcatatgccactagtaactatagtcgaatcactaagaattcggctagatattctcaagcataacttgctaaacttagaaatataattatagactctctaaaaacatttgctagagatagaaaagaagctatgcaataattagcaagaggccaatcacacatgagtcatgagcataaacataagaaaacaaactttgctagctggcgaagttgacaaagaaagaatttgttcgaatatagacaagtgttccaatattaaagccggacaataaaatatccttttttaaccaatcacatctcaagaaacaagtttaaccgcataaaaatatgaaaacacaagaaggtggctagatttgttttagagctaaaagtgttgtata

SEQ ID NO: 3740 - DNA, 1525 bp, Zea mays
  misc_feature (1)..(100): optimal_loci_120230_G1, chr3:175151703..175153227, Cluster 23
gagaatccaaccaaacgtctatattattttcacatctgatagaatcaacaatttaggtgttgaactaataagcaagaatcgaataatcgcgagaatcttggcgtttcctagaatctaagcgaggtggggagaagcgtaaccaaacaggacctgaggaacgccgctcatagcatcacaggaaattttcctctatatactaaaacctaatgggccaaacagagagcctagttgctaaggacctggcccatgtcagacactgcaagttgggccagcctactaatcgtccatatggcctagttgatcgattaatcgaatactaattgtgattaagcaatcaatcagaaaagtatttgagctaattgtaacgatagtcctaatcgaggtcaactatccgataaggtcgcttaattgcctgatcagataacattgacataatgtgaactttccatgttcagtttactacaaatggttaattgtaaaatctattgagatacaaaataatcaacaaatttaatctgttcattagatttaaaagggcacatctcaagtgccatgccctagttccttctattcattttcttttacctgcataagtgctcttcttaaaaagaatgtcctaacaaacactatcacttcaggtatatggtctctgactgtatttgcaatatatgcaggatatgtttctcaagagaatcgggcagaaacacccaatttacacattttccagagtgctgtctataaaatgtttgcattcaatatttaatcaggagatgatctgtgccatcctcgaatctcttttgtcccgcggaaatgaattaattgattatgttgagtctgcttgtgatctattactggtaagcatagccacacttataatatatatttttcatggaaattatggctgtggttgcttgggaaatttggaaacagagaaatgcttctatcttcaggaacttgaccccctctgtctcctcttggcggaattgctttaatcacacgttgaagcttcaaatgcttagatttagccccgttcttaattttagaatctcttcatggctgaattctctttatgtctctttgtttttgccttgtttgctcctaatttatttgtaaaacttgtttcttctctgcttcaataaaatcttgctgtaggggtttctcctgcagcctttcaccgtaaaaaaacaacaataataatatataaaatataagttgggggcagatccagcacactctgatcatcatccatcaaattgagaggtcttgtttcaaaatttggcttcctcatcctagacatgcttgcattttaataatgtatcccttatatttgcatcaatagttgtgaatcaccgaagtcccctaataatggtaaaatgtttgacaactatatgttgaaagaaacattgcaccaagatattaaattggttgccttgagctctagggtcgatgggctgtattacaagaggaatcctgcctggttacaagttacaacatcctaatcgactttgttagagtatattaggca

SEQ ID NO: 3741 - DNA, 1854 bp, Zea mays
  misc_feature (1)..(100): optimal_loci_121240_G1, chr3:180585304..180587157, Cluster 23
ttaaggagatacaattttagttactttttagtatttgttctagctatcaatcatactaaagaggttatgtggctgcacaggagccacgctctaggacactttactatcggttctagccactcacagatactagagaggctatattgtctatatatatttgtttacatcacttatattatattaatgcatatttaaattcttatatttaatggaattacatgtatcgatagtaatatataatttccattgcgattgattatatatttagatcattatttattaatagtgatatatatatatatacataggattattatatattacatatttttatttaactaacatataggattatcactaaaagattcttccatcttagtgaaaatcttcgtctttggatgcaacctagttatataagaactcaataagttttttttttaaattgcgtgatcacatccagcggaagttctttcttcatttcattaactgactttttatcttgctcgtatatatgatagatatcctcgaaattgatttctacgccattgaagtagtcgatatttgatgagaacaccaatacatatcctctcaacattagatttcttcatgtaccactcatgtaatctacacatttatattggaagttgtttgaccaacttcgacctaattagagccttgccatgctcatacttctaaaatgtatagaagtagttgtgtatatacttgctagccccaacacttattttttaggcttgtagacttctaaaatgcttccatattaatgtcatgtttagatggcatgttacgaaatggttgtggctattttctaagctacattacatctttcttagcctgtttctgataagattttttaatacagcaatcatagtctgataaaatatctttctttggtttcttgctcatcttcacaatgaaccttctcactattagatctattgattctttctttggatgacttattttcctaaagtgatccttcacctgggtgccataacttgatccaaattcttgttagttaagtcataagtttgttttatggtgccaacttaactgaagagtttcttggtgttctatggcttttacttttaactaacttagcgtgtgtttgtcttttaagagctatttggtgtttagtgttcttatgaggaggggtggggctcatgtgaggagagtctaacgatggtaggaccttgtcacatatcagtgcattgtgatctccaaaaattatgacatatcacattttctatagaataagtttgtacaatgcctacgaaacttctctatccccatcaccccctatgatcttgagttcctagtctttgtacccttcatagatctaatcaatgctcactatagagtagatgtatagaatcttcttgttgtagtatgacatgccttgttgaggaggtgaagccatacaaaaagccaccttagttgtcaagtttcttactgatatatatatagctcaaatgatattcaatattgaatttagtccataggatattgttgctctacatatagtttgatgaaagcacaactactttatcattgagaggggataactatgttagaatgaggcaatatcacttgttaagttaagttggcaattgtttgtgccacttgatgttgaacatcaacgggaacacatgctttggtttaagctagctaacaataaaagttacacaccctttcctcctctttgaccttgtttctatactagctcttatatgtgttagtttttgcaagaaatccatgcttccaaggaaaattgtcataccctcttatccgaccagggtgcttggcattctatggggcaatagtgacctcatcatt

SEQ ID NO: 3742 - DNA, 1821 bp, Zea mays
  misc_feature (1)..(100): optimal_loci_122000_G1, chr3:184455382..184457202, Cluster 23
catcatcacctcattcctttcaaagagtacgtactatggacatccacatgttgcggatgatgacgagtacgtactatggaccttctctccatcgtatgtgttggactgaaaaaatatctgaacacagtaaagtacgaagttttgataagtgatacgtaattccaaggccaccttctcaacagtgccgtcaaaatcgcctctttttaaaaaaaaaatcaagtgccaagctaaaatgacagtagcaacagcggctggtctcgtccattcgacgagcctttttgagctcgcaatcggaggtgcacatagctccggatggtttgtctttcaaagagaaaagtggctccggatttgttaaagacgatgcacatctacctggccagataaactatgcacatcgtgacaaggttgctgatctcttgtcactggctttattgctttgcgggctttactgcacagtgcacacgtttatttttggaagataggaaatgacttcgtgcatggatgcttttgttctgatacttccttcatccccgtcccaaagtatatatatagttctagatttattctaaatcagaatatattttaagttccactaattctataaaataatatattaatatgaaccaaacactataaatatacacgtcaaggaatacattttcataatacatgtacttgaaatgatgagtggcgtgagctggtgatgatatttttacaaactcagttaaatttaaaattaattgattctgaacaaacttaaaattaatattgctttcgttattgaggtggtacttgagttggggtttagatgataaggtgagcatgccgcgtatgcagacatttattcattttcacttgtgtactggcgctgtcaccggactgtgacaggccgaaatacgtactagtagatatatagagagtagactagtctagagataagggtgcacttggctctccctggaaaagcatcctgctcctcgctgcacatactgcctgtaacatgtttatttgtagctaaccctgtctttctgttttttatttttaattttcaacttcactttgtagataataaatcctacagtataaaatagtgtttgtttgtccatagaactgagctagtggccttagactaaataaaactttctcctttactgctcactagtagtagaatttaaggatggattagactaacttttgggtggatccgcagtgtcaggagctgatatggtgatgtgtgcatgcgcactacgcaaaggggaaaaaaactcgacgaaacgaaactgttatggcggcccgccgcactagtgcactacaatgtttttactaacgtgcttcagcatgccatccatattgcacaggtgaaaaagccttcattagtactcttctctctcctacctacactaccaaatgtaaagaatgtgccgcttagatcttggaagtttaaatgatataggtgcgtgcctaaattttttaactgatgaaccatatgtcttgttaatggcttgttgggttgagagtggccggattgaagtgattggagaggattaaattcattactaataaaaaaataaatagaagatggtttattcttcaattctatctgatccatatgcaatcgaacaagatctaagatggcataccagcatgttatactttttctacacttattaaacgcaccaatagatcttttcttctccttggttccccttcttttgtggtggtcgtagcccgtagatagtgtagcgtgagataagcgataaacaagggtccacttgtgtaagaagatggacgaagaagggttaacataaaaagacatgttat

SEQ ID NO: 3743 - DNA, 1896 bp, Zea mays
  misc_feature (1)..(100): optimal_loci_130540_G1, chr3:227928910..227930805, Cluster 23
ttgtatcttcttatctggggtgaggcttctaatgttcggtttatgcctgaatgcttgtgctacatattccaccatgtaagtatctctcatttaagaaacaacattttgagcttccttctgatttactcagataaacttttgggctttaattatttctctagaatggcttatctgttgcctttccatagaaaaaagaacattgttgacatattctgtttaaacatgatagttttcaagatgtttgtgttggactagcatagtgcagttgctggttggactggtatggtgtagctgctgttttgctgatgcaccatgttagttgtgaggagggagtctggtcttgggctgctgtaagctgcagctgactggtgccttcacctgttatatagctgatgaaagggaggacagataacaaccctagtgctttttacaacctaagaaaaagatttgacttgattcaaacttgcagcctaaggtagagaccttgacctcttgacttgacttaataacagaagactaacatcagcgaggactactctaacaatttgaaatctccaaagtctgactcactcatttgctccaacaaatatatggccagtttcttgatgtttagttcttacaggatgagcttcaatgtttcatcaaaatctatcactttttataaggcattaatatgtgatttgatcatcagaggcgacataatccactgaagaaaaacttgtgttaaatgataggttgagatccttaatacttattagtactcttccagaccctaatagctcaacacaaatcacattggtccttatgctatgtatgaatatcaattgtaaaatgttgaatttgttaatagacaatcatacggttcagaacaatatggatatatgagcctcagttgaatccatcccattggtactgaatatgagttactacaccaaaccacaattcctaacactagagatggaaaaaagatggattaaagctcttgtaactatgggaaacttggcattcactcaagatccagttgtaagcatgattcgctgaatatccattgtaagaaataaatttatcaatagccaatcatgaactatactacctattcaacgaggctgtcattgtgcaacataaagttgaattgtaatatgtgtgtagttgcagatttgttgagtttcttgtatatatatactaatataaaactttgacagccatgcaattttaatttatgtgacagatggcaaaacagttgcatgacatggttgatgaaaacaattttcaaccaccacaagcacctgtggaagagggatcatttctgaaaaatgtcattgaacctatctttaaggttctgcaaaaagtgagtgcataaagttcaaagagcaatccacattaatattctagatgtattgtgcttaaaaagttattattcttcattcatcctgaaggaagcacaaaaaagtagagggggtacagcaggccactcggcttggagaaattatgatgacctgaatgaactattttggtaacttctctgccaaactattgcaaaactaggctattagtgtgtatgtgtttttccacaatgacatttttgtttgtcctcttggattgtaatactcactctataccaaaaaagaatgtaaatctcgtttgccgagtagtcaaagattcttaattttgaccaaatatatatgttaattgtactagttacttgcccatacattgctacggtttatatatatatcttacaggtagatttggattaaatatggtatttattcaaacatgattatatttttattttcaaatacttagtatatatatttatattatcgccacaacccctttttttttgcaaatttcctcgctggctgctaccctcgcgcgcaggcgtttaaaatgagc

SEQ ID NO: 3744 - DNA, 1507 bp, Zea mays
  misc_feature (1)..(100): optimal_loci_131623_G1, chr4:2036867..2038373, Cluster 23
tgcaactgaatggatgagctagcacaccaacaggaccaagggggatgcatgcatgcatgtgcgtgcttcgtatcaataatagtgctggccgattaatcgctcgtaaaggtcgttgttgccgtggtcgccgtcgcagcagattggaactccatccgatccactacaggaaacttgctggtatcagttgttggttgtttggaattaatgctgcctgcgcgctactacttgtgtgtggtcggccgtctcccgttttttgggagggagagatcgaggggggttgtcttgaggattattattggttcatgatctactcatctccgtcaaacctttttcctggtcaagcttttttccacatgggaggatccagccagggtatctgttgctagaactgggttagatacgatgatgatgtgacgaacagggacgcatgcagcttagcatctatatcatcacgtggcccaaaccagtctagttagctgctgcttctcagcatcttattacatagtagtagtagtagctattagctatagagttcgtgcttgaatattctgcagagatctgtatatattagtcatcggatttcagttctatgtgactaaagatctatgatatctgtagtcacggatttgagttctatgatatcgctacctacgacgaccagatcgacgtgcaaatgagtattaaaaagaaagaaaattgcatgcagccggccgtctttgaaaataattaattggaatggggaaaaaatgaaggatgggagtcaagaaaaaccgatgaaattcggaggaactcgtggtccttttgttgctcacatgggcgtgttgataatcatataatctccttcggatccctctctgtctatgtacaggctgctgtgctatgaatttttgttccaacaggtccgtacatctaaagcactgttgaagaattgatctatagtttcagttgacaaacttctagctagctagttcttaattagtcaggactgcgtgcaaaagtcctcgtcctctagcgccaagagtggaggaggaagggatggtggcggcggcgtccgagccacctcacgaaagacgacgcagggtttgaaattgtgcaatcatagtttgttactcatcatataaaatagatttatacatgttgcaagatagatacgtcgagatcggactcaactaccaattcgaatagatcataaaactattgtaaagatttggaacgtgttttaacaactatctcaattaaacagaatctaactatctggtatatagaaaccgtagcagcatcggtcacgggcatctaactatttaccgtatatatatatttcaccgttgatggatcgaccggtacgcgtcatggtctctatagcctactactgctacaaaataccgttaaatactgaaataaatccagaaaacaatagcaagtgttaatactaaagttaacgaggaccatatatatagagagcaggttgtatgcacattagtaaaaagcttattgtaaataacacgtg

SEQ ID NO: 3745 - DNA, 2042 bp, Zea mays
  misc_feature (1)..(100): optimal_loci_134039_G1, chr4:12211068..12213109, Cluster 23
aatctttgattctgaagttagagatagtagtcgtcaccatgcccttattaatgtttcaagccatctacatgcaaagattgtatttgtgttggttatgccactaaactgccatttatttcatccttcatagtgtaggatcttagcaccaccttttgcaaaattaatataaagaaactgaataaagaaaagcttcatgccaagactaccacaaaaatatagtgatctaacccaagaagcctaaaagctctatgaatgatcctgatttaaatggtctacaaggggaggtggagaaggaagactattttagaggcatctgtgtttcctatactatctaacttttgtgttcctcccaccttttagtcatgaatactagactatggtaggttcttagttggaatattctcggaataaactcaaataataactaaaattcggttaaggaacgtatcatggaaaattgttgtgatatttcttgtttgcaagaaactaagcatgattcctttaataatagtttcatatgtcattttcaccttattttgattgttttgagtttgtcccttgtatgggtgctttggttggttctataactctctagagaagtggctcctttcatggtacatttatcttttagaattatttttcaattttagtttaattccactccttatattgtttgaaatttggtttccaacgaatgtctatgccccatgcactatggtggacataattttttaaatctttggtttaaaatatagacgacatatatagttgattgatttgtcgttagagattttaacatttataggaatccagaggataggaacaaacccaatgtttatgtggcaaaaatgtttgtatttaatgaggcaatgcatttttgatgcatgattagtttatctttaaaacatggaccaacaagcaataattcctctttttgcaaagattggattaattttttacgtcattttgctcgataacttttatagtactataaagcaccagttttttggttccaccgtcgtctcgttttgcaaaaaaccttctacttctatcgatatccaactcacggttaccgctaggagccaaatgtgttcgccaaggtcttctgcacctacacccagcactacctcctcgatgtaggcctcctctgctggcaggtcagcaagatcgccgcccacatcgacctagaatttgaataatgtatatggaagttgcatcaaaagaatattttttaataccagggaatttcatttagtagaacaacaatgcatatgtatgtatacttctatttcttttgaaatgtgaactgacttctttgatttctttgtatgcctgaattagagatagaagtattcttgagtcttagcgctttggtttcttgtatgtctcgattagaaatagaagtattatccagtataagcacttcaactctcatcgtagtattctaccactagagctcgtgtcctttaatgttatgtgttgttcgtttccatataatcattacgtagtagtattttatcgaataatttgtgtgatgtcacaatgcatgtgcattgtactagttttatatgaatgcttgtgcttctcaactaactatggagacatcttatcatatccgctacctagttcaatcaatataactataccaaagtttcacatgttttgctttgaaatatatttgttgatcatgaagtgttcctcaatcaagcaaaataaggttggtgcacacatacttaacactcagatgcaatgaagaatcttacaacaaaattcaagcatctttgaaagattttaaaatccctagatgttcttgttcaaatctaaaagatattattgctagagtaaaccttatcttggtttttctatgttttctagcaaaattttgagaccctctcattgaatggaacattagctcaatcctagaagcaaatttgatcttgcaattaatctagttccataaatgtgaattcaatgtcattcttttttatttggttccacacttcctagcatgatctctcatcttgtggttgctatagaaaagg

SEQ ID NO: 3746 - DNA, 1721 bp, Zea mays
  misc_feature (1)..(100): optimal_loci_136247_G1, chr4:23362606..23364326, Cluster 23
gggagggggcgaggcttgtggcagcgacgagccgacggcgcaagtgaggggcggtggggtcagggggaggagaaagatgtgacatgtgagcgatgaaagaggaaggataatctaaataatattgagtaagagataggaggtttatccagcgatctgaattttcgattttgatggtgtgctatgtgggtgcaattcgtttgatggatttaagaaaggttatgagtgtcgggtaatttggttgtgtgagttttgtaaagtttaaactgattaatcatatagtggtatagatatgttttgttttccaagaggcctttggctttaattaaccaggaaagaaacggatcaagaggaaattgatgtgtgccggatatcctttattcatccttttccaccatatcttaactcgccaccaatatttgtctagatttattagcatgtcaatagtgatgtcacaagaatatgatctcttcattatagaccctagaacggttttctaaatataagaaaaaattgagactatatgatgcaatctgagcctctagatcataaatacagttaagagacaataagtataaaaagtcgtgaaaagatgaactcttcgcaaagagtttgtctcttaatttttttcacttaacacactagagacccctaaaaagacactttaattattatggttgtacataccttaagatatgttgtattaatatcaatgaagtgtttagttttcaccatcgtcatacgtcaagtctattttttttctcacccctccccacttttgtaaaaataaggtaaagttatatggttcaaacattgattatgtttatattatatactcactcatattataatacaaagtatatctatgtgatatataaaaatcgtagcaatgcacatacatctaattagtttcattattaagcgtttaatagaaaaaaaatgagttcgttagcactacaatttaggccctaccacagatgtttttcgattaaggcctgttgtgaagatgtataggcccaattaggtggcccattctccgcactgttcagccattgacatctccgtttacggacttgcagtttgcagggcatttggtacctgatactaattgctaacaaaacctgacattatataacaacgaaaattgcaacaaaaaaatgtatctacaacaaaaatccatgcacatctcgattcttcaaagcctaacaccagtaggtcttcaacagatattattaaaattgaattcctctactttaaatgagttttgatcaaaagaaatgaaaccgcactttgtacaatagtaccgagacacggtacaccaatcatcaaatcatatttgatggtgacagcgagggctcaataaaaagctagtgtgatagactcccataaaaaataaatagagggattaaattttatgctttttatttatctaagtatctagatcatataatccacataataatctatgctttttatttgtctcttaacttatttaagatttaacttatttaagatggattatataattcagagagtaaataaatatataggaccttaatagtgagtaggaagtaaaatccgatacttatggatacaaatttgttatgtacagtaagtttttctctatttaaaattcgactatagataatattggttgtgttggataagatataaatagatatcaacattgcatatatatttgacttgagctatgtgactttaga

SEQ ID NO: 3747 - DNA, 1816 bp, Zea mays
  misc_feature (1)..(100): optimal_loci_136760_G1, chr4:26002973..26004788, Cluster 23
atatatgtcaacaaaggtggacaactaccttgtgttcttttggttcagaaagagcaatctgctctaaactttgttacaattctagacggtaatgtgcattcctaagcatgtatccaatcatgaggacactgtacataagctgagacggattttcatagacctatgttgataaaagacaatcaagcatgtaataaaccaacaaccaaaagatgcaaatgtcatgtcaaatgtaaatttgccattgggaagacataggaacgggaggttctcaatatcaataccactgagacaattacagtgaaaaattatggtggtaaagtgctcatcacattagtcacggattggtgcatggcatcgataagctttgagaaaaaaaaatatggagagccgctagggatattttaaaagttacaaccgatatatacacctaataaaaatatgaaaaatgcaattgtgttggagctcttttgtatgaagagctccatgaactctagctggagatttttttttgcatattttaggataatatctctctcctgttcttgggttgttaggacaggaaacatcacattagcatgactgcttgtttgtaccacataaacaagcgaggaatttgcaatagatgtaaaaggggtggttttatgaaaataaatgagtcaaatatgcatataattcggaataagcaagaaaccaataatcttcgacagatatgttatccacaaaccgatatgtgcacatctaactccaccacgattatttccccacatgcctcaaaagagatggcgtgcatgagcgtactttgcaatgaaccctagtagtttttcaacttccccatctgatggcttttcaccatatgagcatacaaaatatacaattcttaaaaacggtgatttttcacaatatatccatgtcgtacaagtgaacatctttttttatttaaataatccaatagcacaacatcaccatgcaatattctcaaattgctttgtaatttattacctaccgagctaaggtatgtctggacgaaccttctctgctcctcaaaatctaaaatagtgcaaagcaataagatcgagcagcaattgtaacctacaaagcaagacatctatcaactcacaagtgaaactaaccaggatattttgtaaaattcagcacacatgatgtcgttgtatgataatcgacagtcttctcacagaagtgattagcaatgttaaatgcaacggggtccaaactcacatattcatattattgtaggatgtaagacttcgacaaattatcattcagtttcaggaataacatgggtctaatgtgtagtagaacaagaaccctcctcactggtgtaatcagttgcccttattgcaatttggtagcattgctcagcaaaccagtattttttgcatttctataacttttttactaacatatcaccactcctaaaatttcataataatacacaggaaattcataattatgcatatttttacgtagaattattcaaataatagtatccaacacgtacatgattcaaaatgagaataaaacttacaatcaagttgacttgtcttgtggtcttcgtatatcataatattcccatactgtagattattgtggcaaaatccaaatgattattcgacctccgagagcctcttcttcagaattgcattctcatcatctagcttattcaactgaaattgtttagtctcttccccaaaacacctgccacgagccacctcaagccattgactgcatataaacccaagcaatcaaattcgaaccagaactcaaaacacgtttctcaccaaaatcatagaagtaa

SEQ ID NO: 3748 - DNA, 2934 bp, Zea mays
  misc_feature (1)..(100): optimal_loci_137845_G1, chr4:31829161..31832094, Cluster 23
gaaaaagatggggatgtacaggaacatgttccccatcaacatggacattgtgtttagaaatgatgctctatgttatagatggtctgtgtctatctagaagctcaccttgcaagtggtacatcaatcctgatgttcctaaagcaaagacccctcatggctaggtaatactctcctttagcagtcagataagtgcaactgctagttatctttgctttgttctaaaaagaggcttttccaaactctgtacaaactagtgcaaggagtgtgcataagacaaacaagtggaacaaggtactaacttcaagttagcatataacttctattgctaaagaacaaaaggtctcttataccaagtatctccatccctttgagaacaagattggctacaaagtttccacatcgactatatgttgggatattcacagtggttaatatttgtatgtcatgatagtatatcatgcactctaatgtgaaacatttatgtctgaaactccgatctattgttatccatgaaaacatactcatttgaacaatttgttatgaagttaagctacatttacataacattgccttgcctcacttgttctgtagaaaataaagttcctggttactttcactataaagaaaattggcagcaagtggtggtacgacccatgcagaaaatgcacccacacatctttaactcatggagactcctacaagtgcattgattgtaattgtgctaccattggcatgcccacccaaaggttaggtggcatattctccctttacttgtctccatcctatcttacatgctatctcagctggctatgtggctctcaattgtggatgatgtagagctacctatataacctacacattaactaaaattttccactttatatactcataaacctactatgttgatcgtgctaattcattctcgtcctatgtttcaggtataagttgcttctcaatacggggacgagatgggtgacacagatttcatcctctttggttgcatggctcggcacattgttaaaaggccatgcaatatgctcaaagctaatactctaaccaatttcattccacatttagtcacaaagctccttgaatggcatttatatggaacattagcttcttggagaacacaactagaagtgtttgcttataggtcagtgcagttgtaggagagagatttattagaaatgctcattccaatgtcaactcgtggtcacaacaattatcactcatgctctcacaaggtgcaatcaacaacctgcaaaacacttctaaggaagatgccaccttggttttgcctccaacagccctcacacatcaaggtgttggagccaattatgaggataaggtatgtctcccactcgtgttagaaactcacaagttcataaattttgttcgatgtttgtgtgacctcccactcccgtacgttgcctctcccctcgctcttaagtctcttgcaggtgggcccgtgttgtgagtttcttccccaccgtttcagctttcactctcccctgctcgatgccgtggtcgcgtctacgtgtgtccgccgctgcactgcacgcgtctcgctgctcgtctgcccaccttcgccaaggagcagtccgcccgtcctctcgcctcctgcgtgtggagaacacgtcaccgccatgacccttcctctccagtatcatagccatctgttaatttcccacctccactacctagcagtttcccatcttcattgatgctgcgtcgattcctctctcctccccaagccggacccccgctcccttctcttcctgacctcctccttctgctactgcggagaacagccgtgctgccactcatcgtcgacgccggcgtccgcccctcgtctgagattctgtggccgcgtcgtcgctggtgccctgcgctgcttgtcctaccgttgtcgcaccatgccctgatcccaacgcctttgctcgccatcgccgtaacctcgccttcgtgcctagcaaccgagacctcacaggctcgcagctggagatccacgtcagaagccaccgccggtgcctgcttccctgcaccgtcgaagtcacgtctagttcgtcgaagacctcgccaatgttctcctctgcgtccaggtccttgtgtgcctgctcatcgacgtctcccttcgctccgtcgtctgttcgtcactgttcgttgccattcgacgacgcccgacaccgaagtctgcctcggtgtcccttccctgcgcgtcgaagtcaaggtacaagaaaacattaaaattaccagtagcctaacagctatgtttaataacctatacactccgcgatgaattttcttatcatgaatacatatttatgatccaaataaaatagaatgtattttattagcccataataatgtgctagataatttataattgtattagcaacaatttgtatattttcgtagattaagttgagtcatgattgttagaattgatctatggtaattttataaataagaaaggaaagaaagattacatatttttaccaaaaaaagagaaaaactataaatttattagttacccctcctagtctatctttacttatgtagatctatgttatagtttattaaaaaatgtatattttggaacccaaataaattagaaataattttattagtgtcataattatatgataagcattttaattagtgttgccaatagttaacatattttttttgatttactgttgttatacatgaaatattaaaatggccttttcaatacatatcatgttttcataatttaacaatgttcattataattgtttaagtatagtcttcttaaataggaatttaaaaagaaaatgtagaaaaaatgttttttcaataactttaaaagttaattatatatctttttccataaaagttgatttagattatactcaagtattttatattaaatatgtgtatgctagataggaa

SEQ ID NO: 3749 - DNA, 1889 bp, Zea mays
  misc_feature (1)..(100): optimal_loci_138689_G1, chr4:37283499..37285387, Cluster 23
aagatggaataacacgcagggaatatgacagtaataggagctggagtaagctggcatgttgcttcttgttgccaatactaggaacatgaacacatagttcagttagactagacccaatgcataataaatttggacagcatgcggatcatcttgaaacaacaaaattcagattctaaatgttgcaagaacagcaggcttgccaaacatgccagcaatgcttgcacgtgtacaatcatgcatgaactgtgaagtcaactgttccttccgtctattttactccggatgcaaagattactcatcgatctcacaatctcaataagagattggtgaaatacacatactcgtgcagatgagtttgctgctgcttccggcttagacatcacatgtggatcataagctgcactgcatttagagatgcctctcaagctggtcaaaccaacaacaacaacaacaacaaaaaggtattccagcttgtcatgaagatgtttggtttcgttgcaggagcacgacacggcattgtcaatttgtttctacaaggtcagcaatgtcactccttcaacttgtatcagtatacatagaggcaaaaccatagccaagaacacgccattgaagcagcttatctcaaattctcagtacagtttccacttcaaccatgtcttgttttgccggctcagatctgctagccaaaaaaacatgtattttaaaagaaaagaaaaaacacgagctgacctgcattgaatttgagggaaaatcttaaaaacatattttaaagaagaaaaaatattgtcaagaatgggatttgaacccatgccctttcggaccagtacctgaaactggcgccttagaccaactcggccatcttgacatttggtgatttgttatagttttgtatttatatacactacaatatcatgaacatggtttatatacaactatatttaatatgttcagtgcatttttcgagttatacatctatatatgtgcacacgctattctaactcatatgagtgcatatattttttgggttagactctgcaatgtagttatacagctacgtaacttgtatgagcacgagtcatggttcagattgtgaatggaacaaacaaatttgcattatattctctaattcatcacatattgttattcataataaaattagtaaaaccaaagaaatggagggacaaacaaaatggggagggagaatgtgatgcaccaaaacttaaccatggatatttactccttggaatatcatgtatagtagcaaatatgctcgtgaatcaaaataatgcttatatattgttgcatgaccacttaaatgatttgtggatctatgatgtatttaataattataccattgtagcataaccatctaatttaacctaatcacaagtacgtatatcagttatttgacactaaatatagagaagtcgaccaagttaaactcggtaatttatcgagtacaccaaaaaagaagaacccaataattcatgttttcatcaggaccataaaaaatggataaaacttataacatttttttaaagtgtttcatatgtcacattgtaataaaatcagggtattttatagagcaagattcagaaaaacaataaaagatgatcattttacaaaagcagtggaaactttagtagtttttgaacaataaagtaggggaagagatgtaacaaataaaattccatgatcacaataacaaagaaagtcttgttgagcctatcaggaggtatccacacacaacaatggttaacatccacctgctacctccatcagagggaaacaaactctaagtatactgtatactcaataagacttacgtgactaggtgaaagtagtctcctaactcgatctcaaggatattcagattgctctttggtccc

SEQ ID NO: 3750 - DNA, 1439 bp, Zea mays
  misc_feature (1)..(100): optimal_loci_144125_G1, chr4:71039102..71040540, Cluster 23
tgtaagatgtgcatgggctaagacacaaaagtaaaaaagcccgcataaataaaaatgtgacgcaatacataattttcatagtgggtttagctgttattgtgaaacttaaactaatttcatggtgtcctgtagtagcttatgataatgtatttcccctgaggttttattacgaccctcatgaaataaaactatttcatcagagtttgtttgtaactccaatgaaaatttaccaccctcatgaaatcttgaatttctggtagtgagtttaaatgagtggctaatgtgggcacttatttttcaattaagaaatgtggaagaagacacgtgatcatacatttgctgactcgcaacacatacatatttacatttaggaggccacatcccacatatcactactacatgaatggaataacattaacgaagattttttgcagcttcatacataatcgatgttgcattagagaagaatatatattctatctcttctgggctccgtccagacttgaatctatatttgacatccaccgaacccaagtgagggattatagactgaggaatacaattagaaatacgggagtatgggatgtatgtagggggagagaggacaaaagaaatttgtttttctttacttcctccgtcccaatatttataaatcgtttgacttttttaccaaattttattgtcttgtcttattcattttatacaaaagaaatgaaaaattcaaagacataattaaaatatattatatactaaacaatattacaagaaaaattaatattaattataaattttttgaataagacgagtcaatgaaatttaggttaaaagtcaaacgaattataaatttgaacgaaggattattggatatggacaactttacagattttctccggttcttaaactactattcggctctctaaaaatagatgagtacggcatatatactatgaaaaacaaagtcatcaatcatctatctacaaatctcttcgctactggttacctctatttatttagtttttttggttagtctatagagcaatcatgcactgcatctattctcatctgtgcttcttgctcgtgtgccatccgttgcctgagcacctattctcgagcccacttttcactttggccccaacagaaaagggaaaattccttgacctttagggtgtccatagtatatggtaaaattaaaatgttgttgagcacacgttgatcttgtcgtgcaacatcatggacccatgaaagatcatactcttttttataggatggatctagtgctggtggctcttactattcgccacatcagctaccaaccatactactcaccgcaccgttgatcgtcgtcagcccttatttatcacagcgctccagtgtagagccttcaccatcaacctatagacactcagtctaattttgctctaatatgtgacctctatttt

SEQ ID NO: 3751 - DNA, 2340 bp, Zea mays
  misc_feature (1)..(100): optimal_loci_155133_G1, chr4:147660744..147663083, Cluster 23
aactaagagactgcatgatataatcatacacttctaatttataaatatagttaagagataatatgcatagagagtcgtattgagatgacctcttcacgaagagcatgtctcttataatttttttaagaaaacatatattaaatgagatcgtacatacccttaaatatatgtcacttaaggggtctctagtgaggtaagtgaaaaaaaaaacagaagaccatctcttacgaagagtttgtctcttacataatatttcaagcatataagactctagtctgtacaacccagttaatggctaatgcccgtcccttgaggtgtatttagtggtaatacattgataatttagagacacattgttgtatagacgtagtcccttagctgttttttctgcatggaaaatcgatcaacgaactctagatacatgccctaaggtattcacatacacactctaagtcagaagttaaaacaaggacttagcttcatctggattattatgtgactgtgaatcttagtttctgtactgaagtatctgtattctatgaaatttctcaatcacatgaagagcctatgagccaacaaattttgcctagtttttctaaagtttgttgtgcaagtttagaggaggttcctactgtttcagtgattaaactgttattagaataggcaaggtcaccggagacaagtgaaggttctgatgctaatccatagttgttgacaatgcattaaatgatgctacaaatgaagttgcggaagaggacaatggtagtatgtcttttgcatcatccttggaagaagcaaaggagtaataaaactcacatgcaaatagaataaaaatttccattagagcagacacatctcgcctgtctgcagtaacaagagaaatgcagaaggtgcagtctgtgtgcaataggaaggtacatcaggagggcaatgaagtgaccagttttcgctccaccgtctgcaagacagaaatttaaagacatgaaaaaattctcgaattattttagagattcgaaagcagaagaagacccatatttcttctgcaagatcaagctagaagaaacccacaaggttgagaatctattctgggttgactcgggtgcagctgcaacccatacttacacagagaaacactgggtaactggttttcgtgaagagtactggtagcagaaggtgctacgtgtaaggagacatcatcacttcttcggatttaccagatgaaagtaaatgagatattgcagaagaagacgacgccgacttcaatcagagcacaaattgtaaagcatatcagcctgacgaggacggggcaaagacttcccacattcttcattctttaatcctcttattagaagccctttccatgataaaacgcctttacactcagaaagaaaccgatattactgttttaaagtatgtgtttcgacgcccagacagcttgggacctttcaacaaatatcattacgtgggatatataagcaacttgacgagatggccgagttggtctaaggcgccagattaaggttctggtccgaaagggcgtgggttcaaatcccactctcgtcaatatttttgtattgtttttttcaacctctgcaggaactttcgtctacagaaaagtactcgtcggtttacagaaaaaataggaataattatatttgacatgggcaaagcaaaagggcgcaggagtaacatatacggagtatattactagttgaatcaccggccattgactggaagcagtagtcactcattccatctgctgtgcgttcaacaacaacatgatgttgaacttctgtccgtttcaaaagattactgtagtgagcttttgttcaccataaacgttctgcgcatgacccctactctaggtggtttgtagagtaatatatagttcagagaaggtattttattaaaggattcagaaccttctcatgcatgttggccgttctagtatccacctgattgcacagtcagaccggtgggaaacgacgatttttggcgtacaagcagttgcaggcaaataacttcaaaatattttttttgtattcactctatacagcccgcgtcccaagtacaggaactaaacatatactcaacaaagtcaacacacgcgatgatttaggataagactatacagttaaccaatcagacggtatgtgaatagttgttgtttatttggtaatcctagctcccctataatgctctggataccagaaaagtaacttaggagcccactagtctggtttggtccatcagagaccacggatgcaaacatgtaaaaagggtgctgtcgtgctggctcctcttgcctcctatttatgttgcttttctctcctccccata

SEQ ID NO: 3752 - DNA, 1431 bp, Zea mays
  misc_feature (1)..(100): optimal_loci_15828_G1, chr1:87903237..87904667, Cluster 23
aatagagattagataaatagaaattaaatattgtaaccaaaaactagtactcacaataacaacattataatattacaacacaattacacaaggaatcgtacacttaattttgaagtgactatcctaacacaaattctacatatgattaatttaccataatctcgaatttgtgtgagtatagtggtatggtgagttgtaatatatatcatgtcaagggttggcacctttcttatatagatatgagctatggatgaatgccacctatacatattatagaaagatctaaacaaatatttaaatctaaataaattctaatttatcatgacaacaaatatctaggcttcataacttgtcatggttgttgtagaaaattctagaagctcgtattattttatgcatatcgcatggttagccatagttgttatagatgattagctataattgttatagaaagttttaaaatattatagaaccttatattactttatgtatatcgcatgattagacatggttgttatatatggttagacatggatgctatgtttatgatatgagagcaaaagatgatagttatggtgacgaggtgcttcataattatattcgttatcatggtggtgaggatatagattttgactatgtggagcgtgatgaggattatgagccaacaataccagaaaggtacaacaaataacaaatatgtagtggcatcggatggatgcacctcactctgtagtttaccaactatggatatattatgtgatgaattagcaacaagcgtttctataggttggaacaagaatattttatggcagcaatgtattgagactcgaatatttatgtaatgactctttaatatttaatgaacattggtatttatatcgatgaattggtgtatttcatcatttttatgtaccataaagtatggatatgctattaaaaatatctctaaaaatattggtgtaatatcatttttaataatattgattgatgtgaaaaatggaagaaacaaaacatgtggtgaatactttgatcaagggtaaaaatgactttttcaaccaaatcactaaaatcgtgaaactaaagttggtatgcaagccaaacacatgaaaaaactcatgaacttcaccgtgaagctaagctgtgataaagtttctgaagctgaactgcatttcataagacaactctcccaaataggacctaaggtgtcgtttggttcacaaaatgtaacgtaaatggtaatggtaatgattcacactcgaataccggcgttaacaaatttgaataagacgatatccatttgtagtgtggtatcgattacggttggacttaaacaaacatgatttaacgttaccggttactcgttacgttaccaatatataaaccaaacgaaacctaaaaggtactctgtacgggtcaatggaaaccagtcta

SEQ ID NO: 3753 - DNA, 2053 bp, Zea mays
  misc_feature (1)..(100): optimal_loci_162354_G1, chr4:189181793..189183845, Cluster 23
tcatgcattgttttacttgtatagatggccaaataaaccatctgatctgaacccgcataagcctgaccaagacaggacccaatagttgtcaggcgagcaacacacgagtgtgactaactaacacattgggttgtgttgcacctactcatggctacacatgtgcctcggttataaccttggtcataaccccataaaccttgagccttactaggttggcccattgacacacgagcccgttgtgcttgaagcattgcaaatctattatgccactaaggttgtgttcggttcagctttctgaaccagactcgttgccaaaaatttggaacttcaaacaaatgggtacaacaacataatagattcctgaaaatcgacatatttctctagttcaattcagaatcaccttttaccccagatttttagattcctattatctatgctataagctaccattctcttataaaatatataattgatagttgtttcaaattttcagtttttccacaatcgtcccttcacagcagttttctcatagctcacagctagaatccgattttttaggaatctacagttgaaccaaatagacccgaagttacccctaaatagaaggaggctaccaccctacccctgcatagatcaggggtgaagtcactgcctcacccctgcacaaatcaggaaggatgatgcatcaccctatccatgcggtcggatctaagggaaggaggcccacaataccacctacacatggatctgagggaacatgtcaccatggatcttggtgggcattaatgagaggacaaaccgagaggaattaatagacattagtgagagaaggaacattaccaattagaggacatatttcgtttcgagaggagatgtgacattaaattgactagggagtatgatgtaggagaggagctcgggaggtgatttttctagggataggatctgggaggtcatcgattgggattaggattatgagaggagagggaataaaaataaggtgtccgagtgagagttcgatggggtggtgttggtatatactatataagctagggtttaaagtagtgggccatgttgcgtcaggctggcacgtgtgccaaggggatggcctaggcattgtgcaagcgtcggctaggccaacataagcatgacgattatggcaaaacatcaggctatgggtcatgttgatggctaggactcgagccttatggtcatctatagttagttgtaatagtaagcagaccctatttattattgcatagtcatgtacatttcattttctcatcttcatgaatgctagtgaatatctagttggttgtgacaataattaattttatatatagatggaaaaagggacaaaaaggaaaaccattgcaaaattggatgccagtgcacatatagcgtgaatagacatggtttaggaagagatcactagctactagctagaatagggcataaggtcacacacaaatcatgttaaattttgaagaataaactggcagggatcctactatcgtggacaacatagaaataggtggtaccgatgctcacaaagctgaatctagagcagggaagactttgaagatccatgacccaaggttagcggtgaccctgaaatttggacaatttttagggattattttggaagcaccctggtttttaagaatccagtttctagaaattggtttctaaaaaaaagaggtgagggtgtttgaaacccggtttctaagaaaaacaatttctaattttttgatacacaatgtctagcctatccttcctctataaattgggtgagggtggaaataaatgtaaatgtcatgaaataaataagggcatgatgtaattaaacagacaaactagttttagctgggagaggtcaccttctggattttaagaaactagggatctagattctataaactagagcataaaccattatgtttggaatcactctagtttccataaactagtttcttaaaaatgggcccttaagagttgtggaatgaaaaggttaaggtataaacaaatacatgttttcttttttagttgacga

SEQ ID NO: 3754 - DNA, 2250 bp, Zea mays
  misc_feature (1)..(100): optimal_loci_163651_G1, chr4:195183197..195185446, Cluster 23
ggtagccaatttggtttctcatggcttgctccagtgccagatgtcgaagtgacattaccagctcatgtctccactgttgtcaagggcaccccagtaagtgtcaagctgtcgatcacatctccactatcaaaattaccatgctttcttttgagcagtaattaggagtaatttatcattgctattttggcagagctatcttgatcaggaatacttcctaactcacaaatttactgacaagagtgatgtttacagtctgggtgtcatgttccttgaaatgttaactggtatgaaaccaattgagcatggtacaacacatagtgagagaggtatgcacttcttcagccatggatatattacacttttaaaggacaacctgttctcacaaaaaagtaaaacaatgacagctgaaaccacttgaaaatccataagcttagactgtgttattatcgacttgtgcttggtgtcagtaaaaaacaagcacatatgtaatgaagatctgcatcttcctattcctctaggtaaactgaacctgtcagtcacaagcataaacataaattagcccgctatcatcattgacttgctagggaagggacatgaggaaataatgaactatatggtactaccctcaagttaactacctcatcaagatctctaatattgggcctatagtcttgcactggttgatggtttcatttttttataatataacatctcaaaggtgcatgtcaatattattacatgttatgtcacaccttcttgtgtagcttgctatgttttcttttttggtctgcagatgttgtacatgaaatacggtggaaataaactattaaatctgctaggcacatggtatagatctagccatttctggcaatcatttttagttggtggtattttgtactacataacaacacctcgacttgtgggtgcatatactatgtggaaactatggtagccacaatttttttgtgattaaaattatggctttgattccaatgtgttgcctctagctttgccttacactatccttctttcttacagcctggctaatcttcacagagtctcgtttcaagcatttacatgtgttgtctgtctgcttggtgcttatgcatatctctcggtagtttgactaagactttgtgtatcttcgaaaagattttggaatggctttatcaatgtatgggtaaagttgtgtgcaacattcttactttctcctctttccttcatatctttactgttcacatcgtaattaattcattgcaggagaaacacagagctgtcatgcttgcctagcctgactcaatatatcggaatgaatccatcagccatgcttttaagacaactcgttttggtggtttttgtgtcggtgcattggtaattttgggagattgcattggcgacattgaacacctaacagttccagtcttgaaaaaaaatcgcttatttgtcacgcagcttcagagatttgaccagcacgtgtgcttttgctgtgccagttccatcgttgtaccatattgactcactgaagcaatgccaggcgcatcggcctcacggccgagtgctgaactggttctcgcttcaaccttgctctagaggaagacgatggaggtgagttgtgcgtgttgtagaaaaatacccaagaagctttaattaatcattatcatgctgagaaagaactgtaattatggcgaggtattctctgctgatattggggattgattgattatatctctggtgtcgttggtactgttgtaagtccctgcaaataaaatcgtctcatccatgtacaacaacaaaggctaaaaatagcatacatgtaactatataaatataattttccagcctaagatatcattgttgtcaaaatctactctacagtttttctaatgatctcatcttatgcttctaggctatcaaaactgaaaagtattgaatttgttcacgagaatcatgtacattccgatcacccttgtcggacccgtcataacataaccatgcaatggttcttgtacggtaagtaagtaagtctaggctttcctattagctcaagtgtatttctgatttataaaataaataagtatggcttgaaaatcatacaagtagattttagttttacaatgtcgaactattccatggatcaatcttagtgtcacactaacactatatcattataaaatggccagcttatctcgtcaagaaataaatgctgtatactagtgcaggtatctaaagcctaatggatcctagcaaact

SEQ ID NO: 3755 - DNA, 1543 bp, Zea mays
  misc_feature (1)..(100): optimal_loci_165433_G1, chr4:204699389..204700931, Cluster 23
caccagagagagcaaccgtgattttgcaactaatcctaacaattgctgaaaaaatgctatagactacgtcagccaaaagcattttcatgctcaattgtttacgtttgttaaacagaagtggcatcattgctggattgacggttgacgccagggcgttggttcatatggcacagcaaattataaatgataaggacggcagtggggaccacctcaaactcgccgtgacatcatttgactcattccgttcgacaatgacagacgcatctttcttgggtacagtatctgactgttgtggtaccagtcgaataaaggtgtcgtttggttcccaaaatgtaacgtaaatgataacggtaacagtttgtattcgattacaagtggtaacaagtttaaataggctggtatcaatttatagtgtgatattcgattacgattggacttaaacaaacataatttaatgttatttgttaccgattacattacaaatatgtgaaccaaacagcacttagtgcttttagttgttaatatctgactgctattttaaatagctgagtgttatttgactcgtacacaatgtgcatctttatttttagaaaatccattcaatgttattgaaacttatacggatcattttaatgtcatctaaaattatactattagtttatattttctatcccttcaatgccattgtccgttacctgtcaccattaagtagtgcatgggtccagatgtcaccgttaatatggcattgatcactcttaacagtttgagcttgataatatgcttaggttttttttattttcaccgttacatcaacagctactcttgtcggctccatagcaacgaccaaactatccacgtagtccaaaaaaattcagaccgtctgatcgtcaatcaacggttgacggctcctctcgctctcctgctcccttcatctctcgatacttccgtttgattcgatgcttggccggtggacacctctcctcgctccttctgcctcgtctttcttcgttctcactccctccgtgtcgtcgttctctcagtcactttgtttttccgtcgctttctttttctctatgccatccttttcccagcacttttgccttatgtccctttcgtcgttggcttcgcatgtcgcctcctgtattgtcgccttcatcacccgctccaactgttgctatgaatgaggtttgtttcccttttccatcaacatttttccttgtcgcagatccagtttctttcgctccagattcgttttttgagttacgcatcattttctacagtcgcagttccttcttgacgtgcttccacatcttcctccctgatacaaattacagacctctcgtacaaatagtgtgttggtttttcattataactatttgccctttgcttttttagtgtggttgtgtcttgtatgtgatcttggatgctgtacgatttgattttactttgggcaactcgatcgctatcagttgttaacctatagctaagtgttacggtagcaacacgacttgatatcatgacgactccttctgtttaaactagg

SEQ ID NO: 3756 - DNA, 1619 bp, Zea mays
  misc_feature (1)..(100): optimal_loci_167826_G1, chr4:217583010..217584628, Cluster 23
tcctcacgacggctgcccacaagatgcttgtgcataggcgttgctatcatggtgtctctattaggagcagagatttctttcgttatctgtcatgcttgttcttctgggattgtgaacatagtatactattgagcctttttattgtatacttgtgtatatatgatacgaaacacaagtgtgtgcacttgcttttatagtacggtgtaaaggtcttcagcctgagattcttcctgttgttgagaaatccagcagaggtaatgtttatttttctgggcctgggcctcatgtagcgcgctggcctaacagttgtggagaacagaggttaatcgatataaaaatatccttgcatctctccactttgctaggaacctgggaggggtgtttggttatgattaagtgtgagataaaaagatccttgcatctgtccactaaacttttacatagaaatgatttgttgctcaataaaatgatacttgaacctaggaggggtgtttggttatgattaaatagaaatgatttgttgcctgtaacccgcaccaactaagcttttacattgcttttcctcgactgaactacctcgcttgtagtttcttagttacattattcaacaatccttgtgcatttttctcttgcgcatcttgatgtaagtatgtaacccatataaacaagactcctatataaaatagcaactcaatgtgcacactctagcagagtcaactaaagtcccatgtctgacataacctatctaatacttgcaaccattatctgaaatttatcccttatgcatattgatgtctcagttttacaccaggagattccacatcgataggaacaaccaactttctgttttttacatcttaactccacaacataatggactccaatccaacttataactgacatcacacaaataatgcacatgggagctcgagtacagttgtaacccatataaacaaggctcatgtataaaacaacaactcagtgtgcagactctgttagtgtagcaataatactgttagaaaatatggcttcagtgacacttctgcatttttagcatgttctttagattctaaggtataagatttctttgccatatacattcactttgttgttcctacaatgcactggatatgcaagggtgcgccaaccagatgcattctgactaacggttaatgtatctggaatatttttttaagagatctgcaatattaccagtcctgcaattttgttcctactgtatttcggagaaattatgcttcttttaggagatctcttaaaaattattatagatataggagatgacataggtagattatccactcataggtagattatccactctagcttgtgtattagatcttgtataattaattattaactgaattcaatgatatgtaacattgaatgtgcagaatgggaatgtcctgaggaccaaattcttggtataattattaaagtacatggacaatgaatctaaagatttgtcgtagtgttagcaagattttgttacgtttattaatgggtattcactttattatcttttatatttgttaactcattagcgccaccgctgccaatccctcccttcctcggaaccgtagcgttagcacgggtattag

SEQ ID NO: 3757 - DNA, 1422 bp, Zea mays
  misc_feature (1)..(100): optimal_loci_171997_G1, chr4:238800690..238802111, Cluster 23
atcaattctgttataaaccgagtttgtacccttcgcattggtgacagtatagcagccttcaccgcatcaccgccacccgctgtggcggatggctgcgacgacacaacatcgagattcaccacattttagctctcagtcatccattttatcatgccacttgttacccatgttttcgagtgcttgggcccactattctcagtccccaacacctatgtaattaagtggtttcatggttattaggagggatcaatgtcggggtcatcctttgtcccaacagtaggaactatatcccacatactaagttcacaactttcacaaattccttcacaacccaaagtacaataccttatgccatctttagtacaaaatcaaaagaaacagttattgtttcatatgcaaagcatcttaatagtagtggtgcatttgtgaagaggatagaaacccttctcctcggtagcattataattttttgcctaaagaaacgattgacaactatgactttagtaatgatgcatttgaagtgactctctctctctctcatgcgggacctaccacataaatatagcttcaatgcatatctaaattgaattacttcgtaggtatccataagacattttgttaatcgaagcaccaatttacaacattgaaattgggtataaattgaggaataacacatgcaagtacactttcatcctttgtgttcctcagttccttcgtcgttgaaattgagcagtatcggagtaagcagacttgttcaaagcatcactgtcattggttgggagcattatcatagcctataggaggacgaaatgaagacaaacactacataagggaggggcaacatacgggggaggaaacaaaagagggcatcgtatgcagcatcatatgaaggagcactatattatccccacatgaaggagcactatgcggatattcatacaagcttcaatggtaggggaatgagcgtcggtgtaggattttcattagtaggaggaagagcatatatgaaaggtcgatagtgatacatagaataaaaaagatgggtatggaaacataatttttggagttaggtaaagaggacaggcagaaatatcctctcgacgatgatgtatgagagaaagaccataaaagaccccctctacgctagcatatgtatcgaaaaattatggagattggtcgttaatcaagttagtgaaggtttgaaactttggacttcacttttgatccatattcaaatagagggtagaatgctacaatatgaaagaagacaagcgaaatggagggtgaggatacgaatgagtccaaaccccctctatttcagggtcgttattttgtggaatattttttgcgttttaactttaaaagttcataacggtgaaccaaccagaacacgacgacatatggtaaattggtactgaacta

SEQ ID NO: 3758 - DNA, 2028 bp, Zea mays
  misc_feature (1)..(100): optimal_loci_179884_G1, chr5:40941718..40943745, Cluster 23
ttaaagttttgtgtatgtacgggctcattgtattggatgtaaatgctatggagcattatacacttcatttaaaacaaggttacccgtggtgtatatttcgatgaaattttatataaaaattcttctaatgattttggaaaataactaaaaatgaaattaaaacaaaaattaaatatatttatttatatattccaccttagaagaatgctattctagttttagaagaataatatttctagtttaggacgataacattctaggttcaggacaataataatatccaagaaaaaaatattttagttaaaaggaataatattttaggttaaaacaaagtaatccagttgagagaaaaatattgaagtaaaatggaataatattttagattgaaagataatgtttcaaattcaaaagaataataatctaagttactaatcatgagacagatatatgtctcctcatatttctactattgaagccctagggcctaggttcctttgcagcaccatcattacccctcctcaccacgcgatgacattcttaggccattttcaatggtagtttcattctcattaaacgatgtgccatgccaacaatttggatgatgtgtcaagtatttaatgaagaaagagattaaatgggcttcatggagatgaaaccatgtatacacagttatctagacatatctcttgcatgttacctatgaaaccgtgtcgaatgaaactcttcactatgagagactgtttcaaccaagattttctttctttcttgattatgtggcatcttggtctacactgttatgtggacatattgtctgttcaaccatgattacatttctttcttgattaagtggcatcttggaaacataaatatgaaacctacaactatgaatagccttaagatcacgaacccttcttcatcgagtctagtcatagttattacggtttaggtcctctatgggctatataggcatctaagccgatgttcacttcttttggggggttgttatggctggagggtcatcttgtttcttctttacatctttgtgtcatcgtctcattagatttcgatcttgctatgtccacaaagtcatccaaccatctagtttcaacatggctattactagtggtgctagattgggtccattggatagctttgatgatgagacattcaatgctctttcaatgtgtcagatgcgtcaaatggaaagatcccatggtgttgaatcatgcaatgtttccaaggcttagggcctatcattgtggatgatttgagtcgctaagtttcaacatgccaaacctaggcaactgtcaaggacatgtattggagttgaataatgttattagggagctcgagtctactataatatacctttcttattgtttagagacttagacataaacattgatgcaacttctctttagatataatagaattccttttcattcaaaaaaatataagttacgagaataataacttagtgaacaacaaggcatcaaataatcttccatttgatgcaatattatctttattggatcgttagatccaccatactattcatatagagatccacaaatctattaataatattcccaaccatttttctaatgctactttctaaatcttttatatctactatatgaagaagtgtgttcatttatcctaacaattttcttttgccttcattgcgacacatctttacttgtgcgtctcgatgaccacaaaaagttgaatcttccaccactctttgtgttgacggtcactaaacaccattgcttaccatcaatattgcaccaaagtgaaggtacatcaacattaaaagacttaagtatgttttcaattaacttagttccacttgtacttggaagtaaactgaatgcaaaaaatcaactcaaaattcatcaaattcaatcttgagatgcaagtggacgtggaagggggactagggaccacctagtgaggtcatttgatctaaccaatggtcgctaaacctagactcataacctgccacaccactgtctgatcaaaact

SEQ ID NO: 3759 - DNA, 1845 bp, Zea mays
  misc_feature (1)..(100): optimal_loci_1812_G1, chr1:9221764..9223608, Cluster 23
  modified_base (347)..(347): a, c, g, or t
  misc_feature (347)..(446): n is a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
ctactacctggccgcggatcacaggcggagcccaggcctaactcctgagcttctttctcatcgattaatttatctgcaggtgtggacggtgagatgatatttgttgtagtgcgtagctcctcgacggccgctagctgctgccgagtcctggcctcatgctgctgctgccgagtcctggcctcatgctgctgctgcttcatgcatgtttctccagctgcttctcatcatatgcatgactacgctagtaaattcaggccatagatcctctcgcttcaatagttaaattggtcttccgatccagatttcgctccccgttcgaggtgatctacctacctgctgtatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatggtttcttaagtttaagcttgattcttatgcttccttccgccaaatacaaattacattctagtaggtaaccaagcatagatgtgtgttccttctattgctcctacataaccatacatgataaccaacagttcatattacacaaatgcatgtagctatgcaacaacaaaacatagggacactcactatggttttttcatatgtaaccttaaagtagtaatatcatatgtggttgtttcatattttaagtggtgtctcatcagatgtagccttaaccatgtcatctctaagttccccaatggcgcacaatacctcactgaaataatggctaacattcaccatagaccttctccaagtttgattaattactctagaaacattgctatgcatgctatcttaagcgatccactattcttaatcaagttgcaaagaccaaaaagggaggctctcctcatacagaccatgtttacacactaaacatcattgcagttataaatgtaattttttgcctttcttcattcatagcactcaagggccataagaaatccccagccttggtgactagcataacctaataccagtcaacatgaaagcatacaaatcactaacaagaacaacagcttgagaaattaacttattcctctctaccaaaaccatctaagcaaatgaaaataaccatccatcatatgttgatcaaagggaggggctactgtgcttagaatcaaataagaacagaagtataatcacgagcatgggctacaatgctcaaaatcaaattacaacacaagtataatcataggcatgggctactgtgctcaagactaaagttttaacaacacaagtcacaagcatgggttgctaagctcagaatatgtacaagaatcacatgcatcatagacattgcatgcattcacatattcaagggcactagaaaagatcatcgacttgctgagaacacttgatacaaccaaccatgcaactgagagtctgagaccttctacacaagcaagcaactcatcaccactcctgaagaagaaccgtgtaagagggaatccatggtgggttagggtttacttatgagggggagatgtagaggaatgacatgcgtctagggaagggaggaggcagtattgatatataccaaggtattggtgggaagaggaaagataaccatactcttggtgggagcaccattaaagctaggcgggagaactctcactctctcgccattgctcacatggagccaagcactagagatgtggtcagtttgcctcgcatccgtggagctagggtggggagtggtctttgcatccatcgggacatgctagggagccaagccagaaaaccaatcaagtgtgggttgcaccccatgggccttgctcaagattgggccaggg

SEQ ID NO: 3760 - DNA, 1472 bp, Zea mays
  misc_feature (1)..(100): optimal_loci_184092_G1, chr5:70184107..70185578, Cluster 23
taacacaagttaatgaatcaatcaactttgtattcccaatttagtatggaaagccaaattagcctttagatgcatctcatatgtaaatcgttttgtttcctgtcatttggttataagtgattagcaaataatttgaacctttaaactacttgtccaaatatgttaagcgtgtggtacatgtagtaacacatacatgcgtggaaagaacaatcagtcgtttggactctattgcaatcatgtctttctcctccatgtgtatgtgtaaaacagatttgaatgattattcatgtcaaagcgatgaacattacatctctctttgagtctgcatagggatagttcatttgccacacatgtctaataagctagatgtttttctttcattgggtgaaccatccatatgtcattagatactattactctctatctatatttatatacgagtttagttcagatgaagcaaagttaaaatctagatatgatcataacgaggaccaagtgcatatatctttgttaactgttttaaattgatatattggaggagaacaacatggtctactaatatatgggtttagtttagatgaagcaaagtgaaaatatagatataatcaataataaggaataagtgtctatgtctttgttaactatttcaaattgatatattggagaagaacaacatgtactaagaagatgatggagctacaccaataatcgagagatgtgtttggattttagcatggttgagggtggacaatttcaaatgttgcatctcctccagaggttgttgctgacacactatcattcttcacctgctgtagggttgacgcttttgagtggtattctcaccccattattgagacagtttgatcattgttgttggatcttcgtgctaccgttacctcctcaaataagtcagttggtcctacatggaagaagctagtgtcatacttctcattatcacgatttgtcactgtgctaagatggacgtgtccagagtctgggagggatttgccatcaattgtaacgatgacaagattgaagattttttgaaagagctccaaccagtggctactaaaattacgtcttatattgacattcatttataattatctttttatgtaattgcttgagaatgctaaacaatttgtttgtttttgtaatacgcaactctttttagcttccgtatgtgataacagtttttagtgctcgagttgggtactatctctgaattaagtctgttttgcatgaggctaatgaaccttgtagacatctaagtttcctaaacttgtaggtagtatatatcctaatattgaagactcgatgttccatggccctcatggggactcttgagtgaggtggtcgagcctcatggactcaacactatggtgttttgggaaggacttatattatacatcgagtctcatggactcagttttcacatgaatgaccaagtctcatggactcaaccatatatt

SEQ ID NO: 3761 - DNA, 3326 bp, Zea mays
  misc_feature (1)..(100): optimal_loci_195112_G1, chr5:146413445..146416770, Cluster 23
tgatttgatagaaacaatgcaaggattatacacaatgtcatgtgtgtactgcaccatgtcatattttaatgaaaacaaaatatgcccatataataccttggccgtatagtcaccagagccactaatcaaatattgattactgtcgtcacctgtgaaagcaattcaacccttgtatttttcacttgtcaacaataagactatttggagaattgttcataaagctaccgggttaagtctgcctaaatccatctctcatttggttggccattgattgaaggacatttgggaagaatgatagaaaattgatatttatacaagctaagctacctttaaaggaacatgttggctatgttttaggctttattgcaacttgggcaaaagggaactatccactccacaagcaaagcattaaatgttgttgcgttgcatatttctgccaagcaatagatttagctattgattagtattttagttgtcatctcatttgatttgtgttaaaatcaagctataaggttgagatttttataaaaagtggttgtgtgcacttgcagagaccgaaacttattctcttttttcattaaaaatcatcacctctgaagaaatccaggcagctcacatctctcttatggtgacacagagtatactccgctgtgggggaagaatggctccaaagctgcaaaaaaagtatagcttagggattcgcaagtattgtgaaaagtatagtgttaaagacatgtaaaaaagggagagaatcttaaacctttattttgcgatcacttgaagctgtagcaaaattatcagtgccattcgggctaaatgccacttgacgtatggaaccatagcgtcccagctcaaatgtttgtatgcactcccaccctttgtcccaatcccaaagtttcatttcgcggccataagccgaaagcacatatggtagggttggatgaacgaccaacactccatcagagtaaccatggaatatgtttgataccgctacaaacatgagaaaatagctcattatataaaatgttgtcaattaattaataggttaggttaagtaggtgccaaaaaaattctaagactacttgattccaaattaatagaaggaataaatacctttgaatcttgttatcagtttcattcctgtttcatactcgtacaccaagatgaaaccatcatgtgtcccaaccaaaacccaatgcttccttgtaatgattttgacagaataaacatcatctttggtgctcatcaaatataacgtttcctgatagtaaaatacattaatttcgttatttataatccaatgcaaggaaaacatgacgttatttataaaccattattgtttagcattagcaactgacatgcctgggtgtcaatatcccttataaaaaaatctccattttgatgaaacgtcattatcctgtgtgacaaggatattatttacctataggatcttcgcatgcaaatgatttaactgaacaaaggatcttcacaagcagatgactcaccatgaatctgctgggttaacatctagtaaagatattacatcattatctgtcgtagggtgccacaaaccccttatctgtgttaacgtttgggttacgtcttgtccagtcgatcggttctgcaaattttgacacattatattgaatactttataattcacttttaattaaaccttttcacaaccacaaaaaaattggttatcccaacaggactagctattactgctagtcctacattgtaagggtataaaatcattgaagattaaaaaaccagtagtaattccgattccatctcacctctgacgttgtctcgccttgctgagacaaaacaggttctagcaccacctcatgcaccacattcctggtctctttagcatccttaaaaaattgatcgcattctgattggtctgtgaacctatagatgtatttatccccatatatactgctctgcaagatcagattggacttttgtttatctgtcggcattttaatatcaagagtatatatggatctcgacatcacaatgtcgtggtttagtggtgtcgcttcaaagggctgctcttctgtcgtactgctaagcataaaagcaatgtgtttatcagttttgtttgttaggtgcagtaagcaagggattaagttgtcgtcttgaaaggataagtgggccttcagcgggtggatgtgatgaatctcacttgactcttgggtaatcaactgcatgaaaataaacattgtcatggttaataaccttcttgcttccctgtgaacagaccttgatcatgaaattaagagactaatgatcatttcctgcagttaagtagtctgatataagaatcaagaatgattgaacacaaccacattctagaaaaataacgctataaagtatgtcgatttcagtatagaatcatcttttgcaacaaaccttggaataaatccatgtatacaatggaactaccatcgggacaattttttgtcatgaaacttcaaattgaaatgtttttttaccattataatatatatattgaaccaccacaaataagatggtcttatagcttcttccaaaggaggatttttattattttttaaataaaaacctagattgatggtgctaccatccacaagtacttcaaaaatctgatgactgatgctcatgcacaacaacattcaaactcatttttaagggacatttaaacatattttcgacagccatgtatcgccgaaaataagccatttgcgagttttgacagcaacagtgatggtcgtgtttgtgctaggcataattaaggagccaatttgaactagggtaactgaatagacaagtttggcaataactaattactagacacaattctaaaaaataaaattatttcaatttctatgtgattgtaccttgttcgccctcaagctccaaggacccgatattgtattctatatgtccattagctttataccaagtattatttcagttcggcaactgtaaggccgtaacaaagaaataactaagcctaaaaaacttgacctgcaagagtaagaatgcttccacgatattattttaaaaagaagacctccttatgtaggttgagaaaactctgaactcctgcaccacctacacactgtatcacatgtgagaacgaccgcgaccggagctaggccttagacctacactttgacgtgggagagacgaggggattttttaaccatagcctaaaattcgctccacaggaagtcgaacgcagatcttgaggagtgctatttagaccacttacccaactcacgcaacatgtggaaaaggaccctaatgcttgtggacccactagatgactagag

SEQ ID NO: 3762 - DNA, 2281 bp, Zea mays
  misc_feature (1)..(100): optimal_loci_196240_G1, chr5:152200392..152202672, Cluster 23
acactaaacggttcaaaggaagcagtcttccccataagagaccgttcgggaaaaaaattaaatactactttaattagcaagaagccgccatggaggtggatgtatcgatcaaataatgatattgccaatttacaatgcaaagctacgtcctcatcactctaatcaatatgcactaacacgtagttactaatcgtgccatcataattgctaattgtaatttgctaggacaacatcgccacaaaaaagaaaaacgagcatgataccgatgctagtccaatcatttttagaaacttttatttgttaggtcaaccttccacaattggttttctgtagactgatacatataatagggcttaagtaagtgacaataattggacaagagtagcagttggtgtgcggtcagtcagccatccttaaccatgagagcttatacaaccctattaattaaagagtctctcgaagggtttatagagagatagtaagaaaattaagagaggagatttttcacgtatttctatacatattatttttaattactgtacaattagcgttgaagtcttttagttgtctcttctacttgaaaaatcgatccaatgtctcaggatttatatgtcctaagagtatgttcaacaatttttgataaattatttggtaaataagtgagttttttatgtgactaaaaaagttagaagcatatttgttgacttcttaaacagtttgcaaaagaatagaaggtagtattttttattacaaatccaaactattagcaacttttatgaatctttttctcaattgtatatttgaatcaggaacaaaaaacaggatagagttcatgatacaactctgtgaggagtatttaaaaaacaggatagagttccagccaccgttgaccgtaggttgactttaactttaaatttatttttttagaaggattcactttaattttaaatttgtattttgtggcaaggatcaatcatactggtttaccactgaactctcgagtgtcatacaactattgcactataccatcaaatacgattggtgtccatcgcaacacatggatattgtagcagttattatttacaaatttgactttaaatgcttcatgtgttttaaattacttttattttaattgtattctaagtcaaacttatagaaacatttataacgttaaacaagattcataagataataatatataaagtaaattatttttcttttgatgattgtagatgttaacatattacctactatgttctatctataaaaaaaattcaagtctagctttgaatctgtataaaagtctgtccagatttaaagctaaaattgttaggattgcatacgtaatgcaagctagggtgtattttaattagaattttatagaaatatagtaataacattgtttatgctgcgaccaagcaaaacgagttgtgttgtgaatgcctttttttagcggtgaactgtgatggtcaacagacactttgctattatggattaaaaaaacagatgtttccatatagtggtttctgtaaagtattatatatgctactgctgtactaaattgttgtttacaaagttgacattaaaaatactccgctatctctgttaggagtattttattaattagattcctgtagaaatatatatattaattaaattgtttatctgcgaccaagcaaaacgagtcgtcgtgagtgtgtgtgtgtttttttagcggtgaacagtgatggtcaacggtgttgcatcagatttcctactagaagcttcatcagacatcagttgagagtcacatgcacgcacaacgagcctgtacccgcaggatcccgtgagatgcgtgcgctgtcttctttccctggccttcccgcccgtgccgtgcatctcgcgcctctatcgggacacttgccggcctttattcccagcctcacgttatatctgtgctgtgctacgccgtgatatcaagactgaaagacacgaagccgttactttctctgaccctgttcgaaacagttggtattctcaggaaagtaatccgtacgagtttcacatgagcacacatccgacttgagcgaatcacaagtatttttggaacaaaaggaagtgctattaactattaaccatttttttccacctatatggagcttggcgatgataacatgcaaccaagcgagtatatatttcgatttcataattgggacagggtactaatatttcatcatagatgtcgtttggtttataaaatattagtattagtttttagtgtggtatctgattacggttggac

SEQ ID NO: 3763 - DNA, 1627 bp, Zea mays
  misc_feature (1)..(100): optimal_loci_196800_G1, chr5:155103563..155105189, Cluster 23
ttggcatggccatacagtaaaagatataatgacccattgtaaatggtcgattcacatggatgcacctatagcatacattagcaacataaaaaatattagaaagatagagttttttagtaatatatgtatgtacacaatcataatcggctatgaaatggaccccatcacatacactataaccatgtaaatgtatgcaacgatgattgcctatgaaaaactattgaatggtttttaattatattcaacaagaaatagtttatgatggattgtttagtataggaagttgatctatttgcactatgcaatttctaaattgtaagttgttgtagttttttagatatatagtttttctatgcacttaaatatatcatatccaaatatacaataaaagttatgtatctagaaaattaataacaatttattttttgcaatagatgtggaacctagtttttgctttgcgtctttgttttttttgggaaaacaacatgttttcaccttctatcgtgctttttttgaaaaatatttgagaaatctaggatacaaagaagacaaaaaatgtgagcaaaattatgcatggcttctagccattcactaataagtgttcaaagttttgcttagctctaagcataacttgagcaaatcccttgcgaaagacgtcttaacagtgatcaaccaaaggatatacatggaagaagatggaatcatttcttactgtccaaattactagcacatagtaatgatcacctcaataaaaaagaagttgcaattggtttttgaacaaaaccaaaaatgttaagggataattagagagaaggatgagtagaccaagaatatcccaataagttattgcaaaccggcaagccaaggagagatgaactagagattcttccactacaagaacacaaagaacacaatataatcatccaaggtcatagtctttctccttaagagatccttggtacttagttagtctttgtaaaataagacaaaagaatacttcattttgttctagcaacaagatttccataacatggtataaacatggtgtactttctaccaaccaattagatgcacatacgcctgcttcaaagagaacatggtgcagttccaaatataggtttagtaaccaaaaccatcttgtaaatgcatcctgttaataatagctaaaatgtcattttattgtcgaaaatcttctagtaaaaaaggtaggtaaatgtagagcaagtgcttgacaagcctattgaaccatgaaaaaatatctttcataaaggagaataactctagtagagaggtacttggggagtaaccattccatgatgtacccaactagaggaaacagaagaagccattattaatagtcacagtcactaaacccttgaaggaatccataagtttagaacatctcaacaccaaaaggaatacttacgtgttgaagtcagagggaaattatttgcatacctaggtgcaggtatcctaggcactacaaccaaactatgtatgcacggagagggcaggctatgagccccacctttgaggtgggttaggtcgacaaggcccctctgaaaagacaagaataatacgtggccgaaatccctgccacgtgtcatcgcaagggccccccttgcca

SEQ ID NO: 3764 - DNA, 2931 bp, Zea mays
  misc_feature (1)..(100): optimal_loci_200789_G1, chr5:178062129..178065059, Cluster 23
gtctcatctctcaagtctcaatagagtttgaggacacaattagtaagactgtcagattagccttttgtgttgataattgtgccaatgaatttaatctaaatgactctaacaaactctcaatatctctcttaaaattaatttgtcaactccgcaaatttgctaatatataaacgaaacacttttcaaaaacttcattaaaactggactcacgatgtatggagaaacctgccactgtcaacttagaaaaagatattcatacaataaagttaattacctattttctttgtagaaagttatcacaactagggttaaaaatggatagaaaaaatcttgttctaactcgtactgttttccacatttgatttgtctgttttcggaaaaatccagaaaccgaatggaaatgacagacggtctatctcgatcgtatttgtggggtcctgtttttagctgggttgaacccgtatatccggtgtttgataaacccgaaatcaacctaatatgcattagtgcattagctaaggccttatattcttacatgataaattatagtagaagagatcattttagacaccggttctccttaatgacaagtggtatatattactagcaagcaaacaacaataaagtgtttttctctgtatatatttgttttattatcgccctaccagtcagtcatcggtaggcaccaatatcatgtgtctatattaagacactgtttgatacaacttcatgtccataatttttggtagagttggtggaacaggttattagatgctccataaaaccgtagagctagagttgtaagccacatttatataagttattttgtttttatttagattaaaaatatttttaaaactatttaaattgacattataaactataactcctacactagaattggaaacttggaacctagagtcattctaaacactccctaaattacgagtttacgcctaatattttcatttctgtttatttttatacattcgtttatctcgctcatatttccattttcgactatttctgattcaatcatgtttacggtgataaaaggcggaaacggaaatagcagagggtttttggtttcattcctaatcacaaccctggttagtactagtacagtagtaataatcgattaaccagaaaaaacctgaaagtgtaacttgatctggaattcctggatccgtgcgcacactctaggcgttgtgcgtgtttggtcccgtcaatcagtcagtctttacgacgcattcgcattcgcgctcacctccagaaccgagatccaccaccgcgcaccttcacgactcggccggcgctccgtcactcatgatggccggccgcccgcgcccgcagacggagctgcactcgccgtccgcctccacgcggcggcgtgagcggtggctggttgtactcggcgtcgcactccacgccgtgtacatgctcagcatcttcgacatatacttcaagtcccccatcgtgcacggcatggatcccgtgccgcctcgcctctcggcgccccccgccaagcgcctcgtcctcctcgtcggtgtgtccccttgatcctctgatcccgtctcagtaagcttcggctcgatgttgggtgtgtaaatttggctggggttttttggtgggtgcagcggacgggctcagggcggacaagttcttcgagcccgacgaacgggggaggtacagagcgccgttcctgcgcggtgtgatcgaggagaagggccggtggggagtcagccacgcgcgcccgcccaccgagtccaggcccggccatgtctccctcatcgctggcttctacgaggaccctagtgctgtcaccaaaggtgcgctgccccggtgctagctctagtgtacgtgtaccacatcaggctgttcgttattcaacttgatgcaatgttttcacaagccattcagtttactttaattttcaagtatcatgcacgtttagtgtgtcattgcattgctttgacattttcggtagttgttgctactgaactaataatagttggtactcttaaccttatggttgttaaccaaaaaaacatgtactgaatgtagtgcttagtaccaatattttgtaactgagagaaatgcgcataactgacatcctgcacttggttaatattgcttagttgaattaaagtgttatatgttatgccctaatagtgaaacagtgagtattgtatttggcaggatggaaggccaatccagttgagtttgattctgtattcaatcagagtcggcacactatctcatttggaagtccagatattgttcctatattctgcagtaacctacctcacagtacctgggacacttatccccatgaatatgaagactttgcaacaggtcagattgattggtattacatgtagcttcctgaagcttaaggcattactatgttattgtacgttcgtaactgccatgcaagtactgtcgaattcatgaaatcacattgtgctttcctcgctgcattagatgactttgtgatttctcatactgcacatcgtttctttggaaccacgttgtgcttttctcactgcattaaatgactttgtgatttctcatactgcacatcctttcttcctgaaatattgatactaatctaaaagttcatcttgcagaaggattatgtatataaattatctttgaaattatttcttactcttggtctgagtttttttactgcaaatcacaactactataatgaattctacagatgtctaggttaatttgtaagtaataaatctgtttttttgcacaaactgtataaatgcctgttcctctttaaatacatgaagggcctgtttggttggaggcctggcaggcaaatgcaacacatcctggtctaatcggacgcctgggatgcatgcctgatccagtcagccttttccaatttccaaccaaacaggcccaaaggctgtg

SEQ ID NO: 3765 - DNA, 1646 bp, Zea mays
  misc_feature (1)..(100): optimal_loci_201858_G1, chr5:184689518..184691163, Cluster 23
gaagtaaccctaaacggaacaagcaagggaagcttagatctatcctggacttgacttgtttcttaggttgttgtttcctttccgaaaactgtgagctaaaaaagaacaacaatcaacgggccgagtaagtgaatattcatctttaattgattaaggattaccctttctctttaatgtttgtaagattttttatataccatttcaaatgattgaatttaaacatattagaagttgttaaaataactaggttaaatcaaatgaatatcgaaaggtatatggtaactgaaactatgttgtaaaagaaaaagaacatgtacttacaatcacaatgaattcatatatgtcaaattggaaattgacacttttgactcactgttatgaccatgttactatatacaatgaagacaaattatcgcttatgtatggaccaagtatgaagaaaatatgaatgtggttaatatatttctaaatcaaatatggcatcgtctaatctactcagaacaattggttagcacaatatccttgtctcgtcgtcttgttcgttcactatttctctttgattaggactatacttggttgatttggatcttcagttgcaaatatactggaaagccaaatgaagtttcaaagtggaggcatgccttcaactgaccatctgttgatctgcatgtggcgaagtgcattggaaaacatatttccaatctcacaacatgaaaattgaaatcaaaatgagtgcagtctaattgccttctaaagtgtggcaaatatattgagtgtttccacttatttcattgatgtattcaactagcaaggcaaaggtaatttggcgagaggttctttggtcaaggtaatttctgttcatttattttcaatatacttgtaaattcaagatttagttaactggaatgttggcttgtctttcagccttattaaaaaaacaaaatccttcagtcttattacttgccaagtttacaatgggatctggaggagaatgtatgttccttttttggtgttatatacttacgagaaagacctgttaaggatatggtctaattgaaagagtctatttcttgttataggagtgttgaaacaggagtgcgcttatgccatatctttgcctgcaaaactactacattttttctctggttgtgaatgcaatgaaatttgaactttgcatcaacttcatgagataatgatccagtggacgtgccaatgacaaggtcatagaagaagctatgttgaggaagctgagtgattgaaggatttcattttccgtactatcatgtttcaactttcactggccagtcatcaaagaagtctgatgtgtttggatttagggttctgttagtcaagttggtcactggtcagaaggcgttgtattttggaagagtagcaaatcagaaaggtagagtgctcgactgggtaagcatgcatcttgtgtttacttatccaatttcagattttctttaaaacttatagatgaacatcgcctatgtttcctttattatattttataccttgttttgctttgcccttcaattcagtctcttgatagttctttgagaattgcaagcttctgtcattgccatgaccatgtttccaggttaagaaacttcatcaagaaaagcaactaggcatgatggtgg

SEQ ID NO: 3766 - DNA, 2760 bp, Zea mays
  misc_feature (1)..(100): optimal_loci_203331_G1, chr5:192877032..192879791, Cluster 23
aatgatgcataacaatttctaaatatcagagtggatgcattccattccataacaacatacctcaactcgctgcaaattgcgtgctaacgcaaaactggaaacaagaagtgcaacatatttgtatgaaagagcagaaaaatctcttcctgaaacagactttgagtcagcagactgcagacactccatccatgcagcacccatagcttcagatatgttccacctttgggctctctcaatatcaccagcagacctcctctgtcctgaagtagccatcgctacagcactaagaccccttcttgaaccaatcttagcactacgctcaaggtcacgagcagcagccaaggctgcagcttttgcagctgctttgtcctttggtgctgatgtgggcaagcttggtgtagtatctataggcatctgaaaacttgagaaagtgtgcaatttagctgccctacgttctagcaatgaggtgtcacgcctgcgcaacttattggttggcggtgctattgtttctgtcccagaggcaccagcagcaatcatggccaatgccattgcaactggtggagaggcaaaagcagcagcccaggcaggtgatatcattgcaacaccaacctgagatcagaagacatgaaacaaaagcatcaccatgaacagatggtcttttgataaaagtgatgagatctttatctattagcaatacaaactttacataaaaaccattgtttttattaaaagtagcatgtaatagtatcatcacttaaatgtttatgaggacttacttaagcaagcatcccgtgaattttttcagaaataaaatacaaatagcaacactgcgagaactgataagtgataagtctgtaaaacacagtttcaagtagatgaaaatacaagataaacaagttgcccagattcagagtttcctttgcaaaaggaaaatcatatgccgcctagggggactggtgccctcattctaaaataccatgttgcaatgtttcaaaaatcagaaattcagtttgtagccgcaacaattcaataagttcatctttgatgctgagattaaaaaacagaaatgtcactgtcagcacatgatgaacaatcccaggttgactgactgtctattttgttttttggcatctaggatgaattttgaactgaattgttgcagttgtacttaactttctgtatactacataaatgatttttgaaacattgcaacatggtattttagctaatgggggcgccagcctccctgggcaccaaacctgcgccctttgcaaaattagctttttttaaagctcagagtttcctttgcaaatttattttttcagaaaattatatgatataaacgattccctgaaacaatttgttagaacttctaatatgagctactgcatagtaccaacagtcactgatataatatgagcacaagcaccaggcaccctcagttcagttgtcacccttcatgaaatataaagtataacttttacctcaacaggtgaagtgtctgctgtcgaagcccagtcatcaataagtagtggattttgcacatctggacatgtaagctcatgtataccagccaaaacagaacgatatcttttcaggacagctacaaatggcggcatgatcaatccaacatacttttttctcactggttttctgtcactgcttacagcatgccataactgttatgatacataaatttcatgagcaatatgtgctaaagaaaacttgttcatctagctgctagaaataagcagtatcaacaaacagacagtagcagaatagaattccatgaatttaaaatgtctaacacagaaaccttacttagacattctaaaatgcaagctatgctttgatatccagcagtgcacgttatgattatcatagatcattgagacgctgaataagtatagacaaacattcttccttaaaatctaaagaagctatagtgacacagagttgaggtagcattaaacatcaatttcaggtatacaacatatgtttttagagtttgaaacagtccatggtacatgctttgtttttttctcgaacacgcgggagacatgctttgtgtatcaggacaatttgattcattcaaaagagaacagacaagaataaaaaagtacaagagagattacaagtgaaattgatgttccttatatcctatgtttcatataagacgaaaataatcctaagcttaagggaaaaaaagatgaacatacagcttttatgcagatcacattgaagcattaaaacacttttatggattcctccaaagcagaaaagtaacttaacagcatactccctcaataccggaatggcaaacgtacttctattagggaaaagtcaaacaaaataaatttcaaccattaatttgtgttactatatgttgacatttgctaaagaaccaatatcatctcagaggcactttgaatagaaatctattaaacaagtttcatggcctaaacttgtccataatttgaataattgatcaaagtttgtaaattttgaattttcaggacagagggagtatgattcatggcacttttaagaaaaattatggttagaaaaaaaatgtgacatcatgtgctgacttcaataaaccactcaagttggaatgagagcactgaaaactgaaacctcatcagatggaggcctattattctatgacaataataaataaacttacctctgaataaagaatagaagaagcaaccagaactcgttgtctcttagattcagaaactggcatattaagaacag

SEQ ID NO: 3767 - DNA, 1512 bp, Zea mays
  misc_feature (1)..(100): optimal_loci_203337_G1, chr5:192885472..192886983, Cluster 23
agtgttgtgtgacacaaagaaagatatctaatttataatgcaataaagaaacaaagttttacaagcatgttacatgtaataaagtcaagtaattaacgtcaataaaacattaaattcacaaaaaacatggatacaaatattaagacagaatacagtcttaatgcatcaatagatatacctgaataacacgagcttggaatgaccttgatgcatatggaagagaacgaagtaggactaccaaaagaggaatgtgtttaaaatggtatccagaatcttgtaaatttttcaggttatcttttgaagaaacattgatctgcattcaagaacacaaacataaatttagggagtctggaggaaaagcagttgcacttagaattcatagcaagaatcagagctaaataaactttgataacttttatatggaagtcatgctttttttaaaaaaaagttttaggatgttttacttcttcaagtactttcaatataaggaaaaaaggcaatcatacagaccaactactatagtgctcgtacatatcctttacacataactacataaggcacctgaaaaacacccataccactgaagaaattaacgccgtgtagacatttctggtcataagcctcctcggggctgcttggaaagctttctgcaatgcaaagagcagtagagatactctgtcttcaaacatggtatttccttctccattagaggtagtcagaaaaccacttggtaacttcggtctcacagtaggcgaggtagaagtcaggtggcctgaagcaactaaagcgcccaaaacacggactatcccaacaagaactccatcaccattatcaatattttgcacattgtcagagatatttggaacatccatgccacccaaattctttaagaactgaccctttaataggctccatttgctagtagatccaagtccaactccagtttcatgagagttgggttcataatgctgcactgattgaatctgatgatcctggcagtttgtttcaccactggcatttttaaattttgaatccttattggtaagcttagaagattcattccacgaagcagaatcatgtgacacattacagctatggagaatattgctatcaccagatttagcttccctctgcaaaagaacgagtaatgcttctactactccacgagaaatgaacgactgagcaaacgtattggctctagaagtgttcgggtgcacaatcaatctgtagatgagaagcaataccctagcaacctgccaatgtagaacattactaaaactataagaaccatatcttactttacttatacttaaagaatgtatacaatgtgattaagagcatgggctcagcgcacaactcaaaaactaaatcgttaagagagtaaaccctagactaatgacatgataactccaagaatctaaactctcagttaattgatatttgtaataatttggaaacaccggaaaatatgtgttttaaaagcgcttctttctgcatacaaatattcaacct

SEQ ID NO: 3768 - DNA, 2695 bp, Zea mays
  misc_feature (1)..(100): optimal_loci_203827_G1, chr5:195551641..195554335, Cluster 23
cccataacaggtgtgtattcatgctacttgccctgtaaccttatgattcaaggattttctgcacgcgttcatctttaaaatcaccaacacttcagttcatattaatgtagagatcatactgtgtaccgaagtttttactgaagtgtataatattaatgagctataagtggtatactttctatcttagttgatttagttctattgttttgatttgcatctcaatatcatgccatggaatacaactacactacattgttgtttccctatcaggctatacagtggtatactctttgattatgacatatattgtgatttattcaccgtggaaaacattctgattatacaagctgattatgacctatcatgtgatttattcaccttattttatgaactaaggtagttcaatctgaatacacacccttttgaatacattctgattatacaagctgattatgacctatcatgtgatttattcaccttattttatgaactaaggtagttcaatctgaatacacacccttttgaatccattctgattatacaagctgattatgacctatcatgtgatttattcaccttattttatgaactaagttagttcaatctgaatacacatgaaaactcatatataattatgattatagcatcgacacacccttttgaagatgttggtcagcatatatattttgagatgcaaatacagtattcaataccattgccttaagggtacacacattttacattttttggatatactatcaggcgaaaaagtggtatactctctatcttagttgatttaattctattgttttgatttgcatctcaatatcaaacagttcaatctgaatacacatgaacacacatatagtacattatatgattataacattggcaaatggtttggatgtcaggtcacttttgcgcatgttaggtttcaaaaattgctctgtgcaaaaggatatttcagcaaacaatcggccccttctatacctttcaaacatacttgtaaaacagttcaacctgaatacacatgaacacacatatattacagtatatgattatagcattggcaagttgtttggatgtcaggtcacttttgcgcatgttagctttcaaacatattttagagcttgaaagattataacccatcattaaaaattgctcagtgcaaaaggatatttcagcaaacaatcggacccttctatacctttcaaacataccttttatgcatgatcttctaaatcatttgttctgtataatccttacattttacactggatgattatagcaatcatcttctataaaccttttcgttctgcaaaaccatttgtatgtaaatattgtgggcatgcatatgatcttgtgagaatgtaattaaatggcacacaaagcttactactcaatgggattgatggctacatttctttagaaaaataaaagttctgaacaccagtgcacgttttgtcctctttctgcaggtaggaacaatttgacggcgacacatcactatctggatattgtgtacttgctgaaatatccagttcaacattcaggctatcttggatatacttgcaacccttaataggtttgatttgctctctttatgctaagccttcactttcattttgactttttatgctttaggctcctctctttttgatttgcatctcaatatcaaacagttcaatctgaatacacatgaacacacatatagtacaatatatgattatagcattggcaaatggtttggatgtcaggtcacttttgcgcatgttagctttcaaaaattgctcagtgcaaaaggatatttcaacaaacaatcggccccttctatacctttcaaacatacttgtaaaacagttcaatctgaatacacatgaacacacatatattacagtatatgattatagcattggcaagttgtttggatgtcaggtcacttttgcgcatgttagctttcaaacattttagagcctgaatgattataacccatcattaaaaattgctcagtgcaaaaggatatttcagcaaaaaattggccccttctatacctttcaaacataccttttatgcatgatcttctaaatcatttgttatgtataatccttacattttacactggatgattatagcaatcttctataaaccttttcgttctgcaaaatcatttgtacgcaaatattgtgggcatgcatatgatcttgtgagaatgtaattaaatggcacacaaagcttactgctcaatgggattgatggctacatttccttagaaaaataaaagttctgaacaccagtgcacgttttgtcctctttctgcaggtaggaacaatttgatggcgacacatcactatctggatattgtgtacttgctgaaatatccagttcaacattcaggctatcttggatatacttgcaacccttaacaggtttgatttgctctctttatgctaagccttcactttcattttgactttttatgctttaggctcctctctttttgaatctactgaagtttagatgtcctctttctataataacttttttgtcttcccatcagtgagtttagtaagagatatggtaaaattcgtaattaaaatatgacatgggttaattccattgtgtgtattgggggtatattttggggtataaaattctatatgcatgattcctgtatatataggttgatgctaaactt

SEQ ID NO: 3769 - DNA, 1517 bp, Zea mays
  misc_feature (1)..(100): optimal_loci_204027_G1, chr5:196672044..196673560, Cluster 23
gaatctacaaaaaaaacgtattgatgtttattcgcttaaacaaacatcattagataaatcacattatatatttttgttagtaacatatttaaagatacaaataataatatgtttaacattttatttaaaactagaaatatctgattcctcgtggtacaagaacggaagccgtaactgcaccacgcgcagtaataaacatatttaaaatcggacgacgcagacgcccctggtagctgtgcaggccgggacgggaagcatctgcagggccgccatgcatgcatgagctcatcattcttgcagcgcgcgggctggcagctcagcctcatctcacagaagtaatgcatgcatgctgcgcatgcttgtatgacctgcactgccagtcaggaggactgtctccaactttacaacactaaaatactgtattttattcttttaatggtattcctgcatgtatgaaccatgtcggcgcgttctctttcctcttggtgcctacatgtcgcccttgtattactctctctcttttaaagtgccgcaatgccgctatgctagttgtattaaacttttataggttctattatatttttaaggttcaatataattgtgggccacataaattagtccataaattttttatattattgtcaaagcttaatagtgaagagctaagtagctaactactaagctttatcatttagtccattttttagtttgacaaaatttgtagtgcataatataaaagattctccctccaaaaaagttttactacaaaatatgttataattattctaataatatttattatgtattgtaaatattaatacttttatataaacttaatcaaacttatttttaaactcggcaagatttgcattctttcttagaggagagactgataatttgaatatgttgggttttgaatttaggttttattacaattatagtagtcgtagatgcgcataatcctaattactttgtttccttttgcaaaaatgatttaatgacataccaccaccatatggattatttcatggtggtaacctaactttttgggcactcctaacccataaacttggatagtttatatgttcatttattatagcgccagctatgtgaaatgatgatatgtcattaaaatttaaaaacgtagatagatagagaaagagagagatagagagagagagagaatggtttcttaggctattcatattcacaatgcatactatcatagtcatttaatatgtgccacctagggtaggttgcttatgtgacatgtgagttaaaggtgcgagagaatagagcggtatcatcctggagataccgctatggcacaagatcataggcattaaaacctgaacaatctatgtggcccacaattcatacgctcatacacatctagcatttaattgtctcactaggacaataaaacaacaatacatcgagaccattatatcttctatagtaacatataatgtggcaactttagacttcgtgacaagaaacaatgggttaggaataac

SEQ ID NO: 3770 - DNA, 1948 bp, Zea mays
  misc_feature (1)..(100): optimal_loci_205706_G1, chr5:206265670..206267617, Cluster 23
gcatatgagcctaagtgacacatgtgagagcaagccaaaatgtttaaaaaacactttaaaaatgctaactatgttctaatatgtttgagatgactcgagatagtgctcccgatgttgattttcttaaggcactgaacgtatctgattgtgcacatgatatgtgcatcggatatgaagtcgactcatacacgttgcacacttttgtgtcgagcacattgaagtctagtgtgcatagtatatgcctcaccacatgacccattagacaaagaacccaacaagcatgtcaaacacaaactttatctcaattatacatcacaggtgtttggtatgccattggataccacactggacaaacacttagagagcatgtaatatgtacactttggctccaaacgcactaggcatgtccaatgtcttgtgtgataagagcaccacctatcttatagatgtaacatatatagttgttgaaatcacaatagttgggaaggcaccatacacgttcgatgcaggaaacaatggtggactggacaagtccagtgcccctaatttctatccactaagggataacatttggatttctagttggagcttttatttaatatttgctaaggatcaagctactaataatgtttaggggaattattgcctaaaaaattaatgttaggagaattgcataaaataaactagagctagagcaagtatatattctcatgttttctttgttaacaatcaattttggtctagaaatatttatggatttatcaaatatttttatattgctatttacctcactctagccatctaggtcctatcacgtggtagtgatagtgtctgtgccgactacgcgtctgtccatgcccagtccaccttcagtagccttccccccctccctctctccctagtccctaggcacgtccatacttatgaggaagaaagaacaagaggtagacacttggtttcattctaatagtaaattagccaattaaaatcaaattgctatcgtgtggatctgaatctactatgtaagccaaacgattctatggtagatctcagatttactagtggagctgctcactgaatcccaaatctatgtttagttcgtttaaggtaaaactgatgtaaacagactctaatataagaaaatgactaattgttcactcaattcctttcaacgcacgtggagaatagatacatcaaactagggctacatgacgagaatttttgcatttcgatgtaggagtacatggtcatggacaggtttcactcccctacttgactctgactccaaagcatacagattctgcagatctgatttggtccaaaaaacaatattattaggagcgagtggcggtccagtctgtcagaccaacagggagcagcggccgccagcaggtaaaccttccccattccctgctcaacagctcaaggcggcagcggcgccccttggctggccctcgcatcttttattggctttttggacaatggcgacgcagagagccagagacgctaaagactgtgaataatggaatctgtgccaaattttctgagatgtgtctcgcaatctcgatcactcccttgagagagagagatgtgtttgactgtttgtagggctagggcctgagctcctcgtgtcgttctgtggtggtactgtgtttgttgtccgtttgattgtagggatgaagcgaacatttattctcctgtttagtttgatggatgaaggtggatgagatgagaatactagactaattgcatttatattattttaaaataataacaaattacttactaacattaggtttgtcatgataattactaattacaaataaaatatgttaattagcatataaaacatgcattaattaacatagtagtgcctataaatttagccttgacgtcatacttactgactagaatgtaacttaagaataatctttaatcatttattcat

SEQ ID NO: 3771 - DNA, 1410 bp, Zea mays
  misc_feature (1)..(100): optimal_loci_206774_G1, chr5:211746870..211748279, Cluster 23
atagagataagctcatggatacatacttgctagagtcctctgacatagcgagcccgtacgcaagaggccggcagcgacggcgaggctgaccagcgataatgcgagaggaaggcgagagatcgagcaagacgactagatgaggccacgggagaaagacggcagagccggcccaagcacgaggacgaggtccaagcggagctggcccaaatgcgaggagaaatagagtgatgaagagggctttgtatgggctggattggaaggtttggccaggttgggacaaaccgagccgaataggtcttggagctgaattttggctacatttcgttttttagaggtagattagaataggtctcgtcctataagtttatttaaaaataaggtaaagcaatatataagtaattatatatcgtagttgggttatataattaggagttaggaagtagagtgctacagataggatcataggatgattggccacgcaggtgttaagccagctagtgttaagtaaccctaaaatgttcttgatctctagaaatgggccttttcattttcgaatttaaataagtgatatgcaaagtgtggttagttagtcatttataatttcaagttaatctaaaaattataggttgatcaggtatcattatactctgtcacaactgtattgctttgttaatatctctggatcgatcagaagtccgattgccatgattttacttgggttagttgcgtgattttatctggtttagatttataaaattttataccgaatgtagttatggattctggataatctcatttctactaagaaagtagagctatgacaattttgaaaaacatgagttaatttgattttatatttagaaggaggtgttataattattttatagatttaaaatcatcctcactctctggttatctatcactgtgtctttcaatcctacaagtagtatcaaagtgagttttgtttttaaattgatcataaccagttattagaataaacaacaatggatagatattccacaagatttgtgtgttttcgatattgttgattttagttctcgaaagaaagtatagagacacatattcaagcacaagtattgaaaaaggattaattgtatacatgctactcattttttacaaaattagatggttagaactggtttccaattttttaaaaaatttgagtggcatgtttccaattgacccaaaacattgactgctactaagtgtttcagtaattaactgctactactatatgtccttagtgactcaaaacattgactgtatgaggacccaaaactatattttgagtggcatgttttcaactgaccccaaaaaaatgaaacgaatattgttttggaaccgtgggagtattttatagccttaagattgggtaagggaggagccgcg

SEQ ID NO: 3772 - DNA, 2421 bp, Zea mays
  misc_feature (1)..(100): optimal_loci_208014_G1, chr6:338407..340827, Cluster 23
acacacgagcacctaattataatcctataatgtaggagtttctttgtgcgccacaacatttttgcagaaacccctttcagttttccttcgatcaacctatagtccactttcttcttttattttctttctgtcacatataaaaatatataatgtccccctttagttttatggcacgccaacaattggcagtatatttcttaagacatgtaaaattgttgttgtgtagtgaagaaatggccttattcttgtgttaaaactgatcatgagagggttcgtgggagaatcttagtataatctgattgtttatgcagtgctctcttcttcggtaccactgatcgagatatttaggaaaggagactattttcagtttagcgtggggggctctctgtcactggaggcgtctttcttgcgctgtctttaataattctacaaagattaaaaatccaaactatctgaaaaccgataacatcgtcaggtatgatctatgatggttattttttgtctaattttgtgtgtttatgtacaatagtctatgtttgcacatttgttattttaaacttgcttttaccatattttatacagtataatgagaaatgtatccattcttactagctttctcgaagttcatgttattggttactgtttgtagaggaagagctgcttgcgtactggtggagagaggatccttggttgaaagtgatgtttccgcatatctttataaggttgaggaagagcaggtcaatggttattgccattagctttgctcaatgcgctcatagcagctctcaataacagcaagcaaaattagttggatctacatctttcatatttggtcgttcatctgtttgttcttcctacattcctaatcatgccatttcatttactattatgtttcatggcaaaactatgcattttagagctcagttctctgaattaataatctttctacattaagtaaaaagcgttattagtttgaactacgatgaggttttggtgtcatgttcaatgtgtgtgcatgccttagttttagaatagtaatacagaattggcccaacaaaattcatttaaaattcaccatccttcatgtcgatttatttatttatttataacatcatatttattagcttatacaaccactgtttcagtcatcaattttgataggacatgaattttgggagatgggatttgaaagtgatgaagatatattattttcgtttagtaaagttattggcaagtgatatggaatttaggttctcgatttattaacaagtgattaatctgaacactggaggtttgagaagctcgacaaatgttcacacttatccttacttaaagaatccaaatattagtttttatcttctgtgcatgcttatgatattctttactcagtatgtagcagaggtttcatggctatgatagctgacgatgtaattctttttttactttgtttaagggtcaatttgggttattttcttcaaaatgctctgaagaattatttttctcatagatagattggtggattcaaagtaaattaataatatggaaacaagaatccctgaacattgtttcattatttgattgtgtttagaacggcatagttgcattcactaatttgattgtcaaatcactcagacaaggctattgctttcttggtgaatattgtgatgtggacatgtggctgtttgatgagggtttcaactgcttatatcagtagaacatgtggcctcaactctggtagattcagtgtgttggtattcatttttgtttgcagtagtggcactgaactgttaaataattgcatgttggatgacatttcttctaagtaaattacaaggagctcaagatcttgtaaaaggtacggcccttgtttcttccctaattgagtgaattgctcgcctcattgctgtcacgactcataatagaaaaaattgctttgaattattttttttcttcactaacaaaaaaacgctaatccctaaggcttactggcctattgaccctaaactctaatatcattacaattgtgtgtttcttactagaatagtatggttttgaagaatgttttgtgctgatatctattttttgggatagaaaacaaaataacgcacttaaaagtttataatcaaacaaatgcatacactggtataattattctcttccaaattatgattcataatggttaattaagtgaccttagctcctgctcccagtctcaccattactttttgtctgcatgaattagtagtatctctagatacactaattcgatttgagacagttccttgcgacttcgtgacagaagcagtgagcatctttcttttgatacatttgttgaatttctttattagtgtactgatgatattttaatacaatttgataaaatgcagatttgaggacagattaattatcattcaattctta

SEQ ID NO: 3773 - DNA, 2104 bp, Zea mays
  misc_feature (1)..(100): optimal_loci_208514_G1, chr6:3852429..3854532, Cluster 23
gtatatactctagccgatccatccatggacgacctctcatgtatggcttctttatgccatgcttctgcgcttaatttagttgtacgtacccaacctactatatatcagttgtccatctatgatctgtctagcgctatacatgcagagatagtagtatatttcagtttttccttgctcattttaccggcatgcatgcagtacaaatgagaacccctatatatcacttgcagaaactgaaccggcagagagagaaatgacagtgatgaggtttttctatttatccaatccggcaataattaatagtaatgatcattcttctcctaaactaaaccaactgtgatatcctcaagatcactgctggtttaggactaaaactggacagtatatattgattcgaacaacactgttggcttaagttacaaccggcagatatacctaacaacacttgctgatacatgcatatgctctttttaggccctttgtttccctcctagattatataagttggattatagtgaaaaagaaagatgataaaataacactttgggatcactaataagctaaaataagctagccaacgctagcttattatttcagtttactaccaacaatatccatatatatatatatgttacaacatgtgtatgtcggcacacaagattatattactaacagtaatggctatggctacctttatccatacaatgtagggctcaactgctaggttcccagcgatcgatctcaagtaaattaagattacgtactatgacatcatattcgattagtcaaaacactaacacacatataccgaacatttcatacgcatttatggtttgtcaacgaaatttcttgatttcatctaaagaatctataacagtccagtaaaacctacgccacaattgcatataatttgtctcatgcttgttttgtggcatatcgtaaccgagtggcgagtgttcttgccgtatggagaccgtttgacgaattcagttgaaaggcgcatcatgtggaagaaggaacacgaatttatcatcaattaatgcttcgatctagctagtgatctgtatatgcatgcaacttgttcgatcaacagttttattttattggaaagaatcaactatccttttggatcctacaacaattttagctagactgaaaactaaccgacttcttgtgcttaagaaagtatagtgtaaatatttgttacttgaaaatgaacgcatacatgtacccttcatgatttgtaacaaattaaaggacagttccatgttgaatacataaaaagtatgaaaggtacaactacgaccctactgtcagggcattgttgttgagatcaaacaagttacacactacattcattgacttcagctttgatgcattaatagtatctagccttaaaatttaggcaattataattagataatagtctgcaacagaaaaaacctatttgccttatgtttttatttaatcgtacatgaaataacatatgtgctaacacatgtgcttgtattttttttgctactattactcgttttagtggttgccaacatgcccattgacagtgtataactcacaagacacatgttgtgatctctatcaacctcaagatcttctagcctagtttctcaaatgtgtctgtatatatatgtgtgcatttgtatgtgtttgtgatctctgtttacagtaggaaggggaagcttgttgttgaagagatgtttacaatacgttctttcaagaagcttcaaattatgttgggacttgggaaatgcgtaaggaagtgtcacgtcgtctttgatttagatccacgttttgcttaaaataaacaagattataatatataaatatatatacctcctatcactaaccaggacaaatcatagaattgtcaatttcaaatactaaacgaataattcatatatcaataagaacatttggtatccataacatatccaaatctgaacatccgatccaaagttagatttctgatctgtatatgaaataatgtaccaatatttaacgaattgtacaccatttgtattcgacagcgaatcctgcatgtattcatattcgtcatatccgtttgtatcatatctaggaaatgagg

SEQ ID NO: 3774 - DNA, 1683 bp, Zea mays
  misc_feature (1)..(100): optimal_loci_208578_G1, chr6:4293499..4295181, Cluster 23
cttattctgatgatcagcttgattcgttatttactacaatcttattgcaatgattatctcactcgtattttagcgtaaagccagactctttcgaaggaacataaatgcctttgatatttcttttttaccaactttaaagaaaatattattgtcgataaaagtgattatacaatcatcaaaacacaagctcctatcttatttttaaatttaggttttactaaaatcacggtagaaaatactcatttaaaagtagtactagcgggatatgcattttccgagagaaaagagagatacaatatccaatacgggacctaggatatagagtggatggagttaggttcaacatgacaccatcaaatacttcaagacatcagactgtgtgttttatcttttctcttccttgttttctccctttgactccagtcgagtacattggattggaaaaggctataaaaacatttcccccttttgttcccgccctctaaatttaattgaatagattggattagaaaatctggaaagaaaatatcatggtccatgtatacatattattaccgtattggacgactagactaactagctttgtcatgtagacaatgagtctagactaacaagattggattggaaaaagctataaaaacattccccccccctttgttgtctccctctaaattcaattgaatagattggattaaaatggaaaaaaaccatggtctatgtatcagtgttatcctaaacgttaaacggtaaacagtcggtcatcctgtacttagcgtttaattggactacacaggtgtttagtttaaacagactaaaaaacaaattatgtgagattaaacggcctaaacggttagctactgagtagcatttaaacggtctaaacggttgtttaggataacagttctattatacacatattactgtattggacgtctagactaactagctttgccgtgtatgactttaattaggtttattataaaaagtaaattcgtaatcaatatagccataataatctagtgtaataaatattagtggtatctttatataagtctcgtcaaatttgaagttgtttacaagtgagagagttgttttttacgacttattatactacctccgtctcaaaataagtgttattccggtttgattctctcaggaatcaagtgtgtactttcaagttgataaaatatattaagagaataatatttttgatatattttaccgcaactagatgcatcattaaatttatttttatgataaactttcttggaaatataaatgtcgttcatattttggacaaacctagtcatttaaagaaaaaattgaccagcacaagtaccattattttgttacggaggaggaattaagtacaattttacatagagcgacaacattctcgaccgcagaaaagaaaagaaaagcaaagaggaaattcagtaaattttgtattcatgtatgattaatttgtttagcagtacggttaattgtccctgcagagcggttaccgactagctagtagtagtaccaatagtacgtgcgtacgtacgtacgcactcctatatatatacagagcggagtggaatctggtgacgaggtcaatcatcagctgctggcgatcgagtcgagtcagcactgcgaacctgcgatacaccgacggccacctcgatcactgcggttacttga

SEQ ID NO: 3775 - DNA, 1489 bp, Zea mays
  misc_feature (1)..(100): optimal_loci_209963_G1, chr6:13986311..13987799, Cluster 23
ctaatttcgtttctgagatagatccgtagtgtttgaagtcgccagggtatcagtcgagatctaattttgtttctgatatagatgcgtagtgtttctaggtagatctggcgtagatctggatggatgaagtgatttcaatttctattaccggtaagcacaactaaacatactctatattttggaatatccttttgcaggcatagaagtagtatatgccaagaagcctgttaatatagaacctagccttttgtgttccaatacaaatacaagttttacttcttacatgttggtctaaaaatacaattgtttgttttaggttctactttctacaagaaaaggcatgagatggttgaaacaacaggggctaatcaagttgaaattgtgtttgggcgggtggaggttgaatgtggacagagtggatgaatgattcagcgtagtaaaatattatgctttttctctcttaaaaatactatatcttgaacttcagacttgcaatatggttctttgtgaaatcagccccgtacaaagaataaaaaacacaaactcgaacaatatggagaaagaatcagtgagaacgactatatacatgccgaccaattgggtcttaagctctagcaatggattggacatcgcttgcaactgagggtgttataccaacttgatgcactaggataaactgttatattcacatgtggttaattgctcatactccttttatgatgcactgactcaactctctgtttcacttagcttggggaaaatttgatctaggtgcaactccttcaagtgcttttaagagtattcatgtatacattttgtctatctatatccgtgccccatatgtatagtatctttgcttacaatctgaccaaaacgttccatgttgattaacagaattgcttctgacttgtgaaaatggcgaatgaactacgctctatttatatggtccagaaggttcatattcaatctgtgttgttgagcagaatatcttcctattcgttttgtagtgcaatttgatttgtcttgtcgcggcagccaggtacgtctcctctcgccccgagcgtctttttctttgatgttgcagtctcaccagcataagcatctaagttaaaggagtacttatatgttgaagcaaaatatatcttcccctcattccaacccttaaatactcgcccagcatccccttcaatattaaactgaagcaaaatgtacacaatataaggcaatgtaatggcataaaaatctattggggatgggtcaattatcaaaagatttattggagcttttcagatttcctttgtagtgcttgtcagcataaagcggtagcatcccaagaatccaacaactccaaacatgttttccgagctgttggaggctaacattaccgttccacaatatctaaactgatgacaaattgagatatcattagttagcatcactagtacacattctaacaatgtaggaacatataaatagagtgagtttaatt

SEQ ID NO: 3776 - DNA, 1848 bp, Zea mays
  misc_feature (1)..(100): optimal_loci_209993_G1, chr6:14100718..14102565, Cluster 23
gtttctgccggaacagggatgaaacgtattattctccctccatttgtttgacttttttgaatacatagtatttgtcatgcatctagatatacactatatctacatatataagaaaagcaatgtacttagaaaaaaatagaatatcttttaatttggaataggggagtagacctttacagctcaaagacccaggtcctataccagtcaagaagaggtaatgcaaactctactaatttcgaaaacgatgcaaattttattaggttcaacttgatttggttagagccctataattaaatgtactatctaattattacaaatttataagtatataaacaacataatataaaatcaatagaaacacaatgtaatatatgacagacgtgtcatgttaaaccgcgtcttgtgaaagggaattggggagtattaaaaaggctaggtgattataaatctaatacaccctcgtcctcgtggttacctaagctcagctacttcaatcttttactactatattttatatttaatatactatgtataaaatatagcaaatttatgaaactactccctatgatcttgaataagtcaatatttagagttgtcttgagttatctttaaaaaaaaaattaactgaatttttagggaactaacaacaaatttcttttgtaccaaattagcatcattacatacaccatttgataaatctttggtgtgataaatatttatgctcttttaaggtaaatctacccagctgtgccatttctaaacattagaactcaatgtgcgagttaatttagaacagttgaccataactgcaaaacataacttattttgaggcctcaaagagtattcaataatattcgatatataagtgaaccgtagcgatcgaacctgccagaaaatcatgatgatgagccttgcagccatcaccaaaaccagaatcagccgcaacaaccctctcatctccatgcacctcttttgaagttgccaaatcgatcgagttagccaaccttttatttgctcctcttccctagcaaacttcgctggatattctcctcggtagcatctggcacatcactagtttaatgttgtctttgtgtgtataggtcttggagtttttgttttatatttgattgataatttgttagggagaaaaggaattatggtagtataacagctatatgactctttcggtgacatagttttcatcacctgtttcgtctcttgtaagaggctgtaagtttcgtgttctctgttgtttaattaatcggagtaacttttatgggttgcagcactagctgccagattaggacgacgtacagggagttttgattgggttctggcgttgttacgcatgctcagtgttttgcccaagtgcccgtggcatcgatcgtgttgacacaaaaagaaaatcgcgacgtagcatgtttttcattgaacatgacaaaaattttgttacaatagtgcctaatcaccgcaatcccatgattaccgagatcaacagaaacccagattattacacacggttgtgtgattttcatgcatattgttgtgtttcgcaacctaaattattccaccacagcaacctaattaaattccatgaggagccgattccaatcgccgcctcctcaatcctggctgccaaccgctgtgctgaagacgccaatccattgaaatttttattaagttttagatattttttttttataaaatatgatattcctagttcgattaacctcaaggaatttttaacttaggaggtgtttggttctgtggactaaagtttagccctggtcacatcaagcgtttgactttcaaataggaatatgaaatatagacccaaccaactgtact

SEQ ID NO: 3777 - DNA, 1719 bp, Zea mays
  misc_feature (1)..(100): optimal_loci_212590_G1, chr6:30091250..30092968, Cluster 23
caactaaggcagtgtacaaccccatttattagatggtcttttaaggtgtctttagggggttaattgaaaaaatacaagagatgggctcttcatgaagagctcgtctctacacgattctccatacgcattgtctcttaacttcattatggtttagaggcttagggttgtatcatacagtttctttgttgtctcttgtacttagaaaactgttctaccatttcagtgttgtagatgccctaaatgtttagtcgtgtaataatgcatgttgtatatttaatgtttggcttatctcttcctctcacaaattgtgttggaatctgtgaattgcttgctttcagctggctattagtgagcagtgcccggttttctctctctccatttctctctgttctacatcaccataaatctgatgtgacatgtcttataaactgcaatattatattattatacttgctcttatgagatcaaaagcttagttgtacaatactggtctacaatctaagtgtgctgggacggagggagtaaactagattcgggcacagcttaccttatcaattcgcccaaacaaattaagtacgcaatgaatggccacacaatcacgcacgcgcatagcgttcaattgtgttacagtccttcttattacgacttaacgagtacatatacattatattacttctatcctatactgctcccaccaaaaaaatacaattgtagcatgcgtaggtcctgtataggacgttttcagattccaccttcagtttagagttatactttataatataaatctaaactgtttaaaaatttgtttaatctaaacaagaaacaaaataatttattaatggtgtatttggttcagatttctaatatatattcgctgcaaaaatctggaatctcaaccaaaacggtacaacagtaggatagattcataaaaatctatatttacctagttgagttcggaatggcccccctactccagattttctgtcatccatattaaaaattgtcatgctcttataaaatatatagtcgacggttgttttgaccaaacgaatttcaatttttcacaatcatatcatcgtcagttcacagatagaatcagatttttatgaatctacagctaaatcacaaccagaccctaaatatcttctaaaaattaataactctagcttaacggttttttggacctcataatgatctgctctaccaaccctagttatcaaattttttgtagctgaagtagtctcaaataggaccacagtatcgagtcaaattgttcctagtgtaactaagtttacataaaaaattatttaaagatatctttatctttactatattcaagcaccagttttaacggtcgttccacgtaaatattttttcaaaaaaatcctacgtttgtttagaatcaacccgcactaatataatctcttctctactactataataggagagtttaaaaaataagttgaaattatgtataagtgagtgcttgaaccttggttgctggctccacattcacacccacctaatcactagaaaatatatattttgtgctttattaaaacaaaaattattctatgtcatatatataaatcatagcaatgcacgtacatataactagcatatatatatatatattgtctccgctcttcgcataatattttttatgaacacacgggtatcataggcagcaaatcagaggcccccaccactcgcctcccc

SEQ ID NO: 3778 - DNA, 1638 bp, Zea mays
  misc_feature (1)..(100): optimal_loci_217732_G1, chr6:66033077..66034714, Cluster 23
agatatggctgaatttgtgttgtgtgctcatgaccggaaattgttttcccctattggacagttatagctacggtgctaccaatcttatataagaatttccaaattaggatgtcatgcacattagctaattttgagccaagtttcatctatgctagtgtgaaggcaaacgaacaattacagggtaacatggtaaggatagggattctgctaaaagagcttacatttcaacacacttacttaatgcaggctacttaattttgatttaggagataacattcaggtatgtgttttcttttccctcactaataagtacagagtgagagaaaccatttaggtttgtgcattgctcaaaagtccctacaaatggtgcatttctattcacttgatttcatggctgaatagtatttgtttatagtgaaatactagctaaaaatttagaaaggtgatatgttgaatactccctctgttttttgtaagacgtttgtctcttttgcaatctttggccttatgcaccttgtgttctctggagggagcaggtgtttgcttggagaaggtagtgctatttgagtgaggattgggtgtatatttgtagaactattgctcgatacatgtcattatggatatttccccacttcagcatatgccggtgaccatattatttttcttttgtgtaaaaagagtagttcactaatattattgtgtttttatgcagtgattactcgatgcatctcaatcctttgaggactaaagttcatcaagctcatcatgatttggtaatagatatgttggagtcagcaatgaaagatctattgtaaataagtagagatcgcctcacttacaagaagcttctcaggataattattgttctggtaagcagaacatatttgcattcttctctatgaatatgaagcatgaacttagtgcagctactacaagcaatagctagttttaactgaacatggagaacaaatgttgtaataaaaaataggcaattttgttgtgttgtgtattccattttgagcttatttcgtggttgctatgggctagttgtctgttagagttctcattgctggagataacatcaatcggacgtcggaacaagctgcatatagctgaaaattggttgttttggctagacatttcagatgatattagacaattcaattttctataaaaaggccatggttcttttcctcatcctgaagaatgacatgcgtgagtttgagtaaatatgcaagtcatggtttaccacacatgtattgtattttagttttggggaggacaaatgatcaatttatatgactgatatgaaaaatttgtaaaacatatattatattcagttaaatttaatagactcactttttgtaagaaatatattaatatgttaaacataattagtgattctctttgcctgagtcaaactcttgagtttcgaatgtatatatatgcaatttgaggccaaatatcaatatatcttttagatttttcagtttaatggaggtgtttgtttcatatgtgcaccacttttctaattaacatacttcgaattctcaacgctcgtacatatcaccatccatttatgtaccctacgtaaaaaaggaattccccatttctttatacttggaattaattcctttc

SEQ ID NO: 3779 - DNA, 1971 bp, Zea mays
  misc_feature (1)..(100): optimal_loci_223707_G1, chr6:102373630..102375600, Cluster 23
ctagatggattcaataagaaacatcgacaatatagcataggtaaacgttcgacaaatataccataactattggatttcatgatgaataatacttaatacctcataagaatagaccgaagcataaacctacagtgccaactacataaaacacaatgactcagatcataccatttaaaattaaaataaataaaaacagttagattctaagaataacaggaggattcaaaagcaacattaaagaaacaaggtaaaagaaggcaaattaaaagaagtgacgacacacataaccgaatgagacaacagatgtattgagtaaaggcatgtgagaatgacctgattctcgtccccatcatgaagatgagcatggtctgcgctacatcgggcagatttattctgtcgagggcaaaccccttcaccatgacggtgatgagctccacaacatccccgtggcggagggtgtagagtcgctcagcggtgcccgtgctttgcgatggcacactcatgcttttgcgactgtgtttgtgatcgtgtttccaatatactaatcatgctagaatgttccacaaaagtagaagaataaaaaccaaatcactgaaaattatggcaacattatataatgtcaatctaattttaccttcttaaacaatcatgcctacttttcaaatagaagcgaaaataactctgatcacaagacgaagggaagcatctaggtaatcattttaggtatataaaaaataatgttctaaaaacattaaaaagatttagaattctaaagtgtcaataatatatatactccttatgtccagacatttaactttatctagatgcaatttcaaaatcagatacatagcagtagcacaaaaaatagatacacaacaatagtacaaaatggggtaatcacatttggatgacaatggttgtttggtatgtatatcaccttgtattaggttgcatctctttttttatatatgtcttcatgcatgcatgatctcaaatagtctctacatcagctaagcatcacaatccttcattttttgtataacaataaataagaaacaactcttataatcttataatctctaaaggtaatgaagtgacctattgaagttctacatggtgccaaccaatggaacaactacagtgtagcagattaacactgggattgcgacacataatgcctttttttatacaaaagcatggagaatagtgaatgaaaaatgaagtgtcaaaggtggctttttaagaacaacatagctctacaaaatggtgaaaatgaattattcataagtagtctttagttcgattaaggtctatatctttcaaagaaagttatgctaagttatagctcttggtgtaccgttctacatcaaaggaaaaaataactacctctaaaaggtattcactattaaattgtttgtttgcagtattcgaatagtgatggtgagctgatctgctagtggagcagttgaaccaaaactgatgtaatatccctagtatccaacttaagttcctcttaaaacataaactaaaggaggagaaagaatggtttatgtggaacatctccaaaaaagacgtcagtggcattgctttccttcaacccgtctgtgagcatctgcacaaacatttgtgtccatactttatttataaaaaagtgtgcacgatgcctattagctagttatgccaaatttagaatacaacactgaatacataaaggaaaatgtgtgtgcacttcctcagtctaccctatgatgcatgttagcgataagaccacatctagtaaaatagacatttatgacactatgttcactatttctagaatcataaggtttcttatctacttctaaatagttaatgatttctttacaacacttcatcagtggttcgactttaaatgttgagcacaactctagcagagaaccaaacaatcattttgcaatctacatagacaacagaatgaaagacgagaattca

SEQ ID NO: 3780 - DNA, 1560 bp, Zea mays
  misc_feature (1)..(100): optimal_loci_224181_G1, chr6:104471623..104473182, Cluster 23
tgaattgttgtctacctatcaaaattatagctcgacctctatttcttatgtacatttaatgtgtggcctttatttttgtcttttttattggttaattaccaatgactccttctattgttgttgtttgtgttctgtagcaacccatcttattttttctttcaatattttccacatgacaacttggataaacttttatttcagattagatcaaatttgaaaatctacagtttacaactactgtcaagtgcttatctttgttagtaatttgttgtcctatgggactcttttgttgatcacaccctatggcgtgcatttagcctaggaaaacttcaggtagggaaaattacttattttagttttcgtttagtttttcaccatgtcgctatgcaacaattgatgacttgtacagctcttgaattgttgatgccttctttgaaatagacatttcacattccggttggaacactctttctttggtactccacttgtttttcaacactcaggagtcatcaaatggaagtgtatccctttgtgtccctctacatgggggaggaacccccccacacccacacacacaccacacacacagggagctctaatatcctcctttacttgatcagtgtttttaactgcaaaatgtgtattgcgatactacaaatattatattttttaaactccaagattgatgcaaaaaacaaaatatctcaattaaagtatatagggggagttggataggaggaatggttggagatgaggtgaaatagggtgaaggtcatttaaatatgaatagaaactacagatggcgagattttgggagaagtcgttggaaccggtctaaacagtgtctggctgggtttatgtttagatgacctaagggtctgtttggaagcacccggtttttaagaaactggtgtgcttccaaatagaccaatttatgctttagtttctagaaactagatttctagtttttaagaaaccaagaaggtggtcttccctagctaaaactagtttttgctcgacaaattacgtactgcccttagttgctttggtggaaattacggtgatcgccaccgcactcaataatatgcatgtgatcccctcaaatatgttatgcttgatttgaatgtttaattattagttaaaattttttacttagaaatattagtttaatctatgtttaaaattggcaggaaaggaaaataaaaggaataaatgaatcaattacttttaaaatagagtaagggtaaatttgtctttgtgtaccagaaaagctagaaactagtttctaagaaactggattccaaacatgcacacctagttttttcaataaatcggttattagaaattggagatagaaatcggtttcctagaaattgtggtgctttcaaacaaccctaagtgcttcatccccaaaacagaaaccaagtaaaaattgaagatgtttttgtataatatatgtttggaagcatgttaacccgattttggctttctgtttttcatagttgtttggagttgtttcaccagaaaaagataagaaatagaaggtatattttatattta

SEQ ID NO: 3781 - DNA, 2208 bp, Zea mays
  misc_feature (1)..(100): optimal_loci_226813_G1, chr6:118682559..118684766, Cluster 23
tgttttttttggagattgttaataacgaaaaagcgtgtaacaaaactatgacgacaaatgacatgtcactaaatttatgacaaaaaatatgaaacgtcattgaacatgtaatgccatgcatgataggtgacgaagtgattttcctcatagagatgtcataaatttcaaaatgtgacataaatttagagttttgtgacataaagaaaatgtcatagaaggtcacaagtgctgtagtgaattttagcgttggaaaaatgtataaaagcgtgaaatagcaatagacaacttaagatcttaagaattatgtaccatggccgtgggtgagccattttcccacaacaaagacgaaataatatttgtgaggatttctttaaaaataaacatcttgcatttggcacacattaaacacaagattgaatgtcaaccatatggtgcgcctgagtagccaacaccaatttttttgaaagcttcaaagttctgatatagattagtccagattcctgaccagctcaaaaccttctgatacaaatcttgtggccaattttggctcatgttgcttgttacaaggtttgcaatctgcaagttgtgaatgaaaaatgcatcagaaaagaccacaagtactgcatttatgtttagcaaaggcgttatttaaagctgagtacatcaacaaaagataaggttcagtcatgaatgttttaaattgcaaatgggaagttatacaaaaaacaaatatattgatatattccttcattttcccatgacagaaaaacgaatataatccctctttatataccctaggacaagcttgcaagagatcaatcgtttgattattgccaaattaagtgtagtgatggaaagtaccacaacaacaagcagtaagttgccatgttaggatgcacaatagatatataattaaccataggtataccaacctctatcatcattgtgtgcatgcgtgccttgaagtttaatcaacctaaaccacatatttattggtagtttataaaaaggctagttcaatgagctaactaaacccacgaaggccgggaccaagctaggggagcatgatgatatgatcagacaataaaaaagttaagaaaacacaagccttttctcctctaatcctccaccttttctactatgtgctatcctaaacttgcatcatttgctgccgacaacaagcttaaggacatacgaaaaaacataaggaatcacagttctagcaagctagaacctcgccaaagcattaatatagttaaccaaataaaatgggactagaaccggaggcaccctcacgggcgccctatcaggagaataaacaacttgctatggctaaagtcagcaggcagttagaagtttgttggattcaatagcaattgatatatacataagtggttgcttgcagataatagcatttcaaatataaccacacacataataagtcatagcatagatatacacatacacatacacatatacatatataattaagtgacatcaatggtagctggatgacactacaacctttaaggcttttgtttagctacatgttacattaagccttcaagtagaaaggtaatgacatataatgtgagagatccacatctgctttagttttgacgctaatactgtcttgtgcaacaatttctagcgtcctattaagatcatctggagacaagtgacacctagcttcttcttctcatctattgtcatttttctataatatcaaaatatagcataaggaatttacacatatattgtgcaaggagttcaatgctttaaatggtagctacctaccaatgtcgtaactttcatatgtagccactgcctctccatggccctgctcaactccaaaacaacatctttagttgggcaacgcgatagtaaatgacacctcagtagattatttacaccactgttcattttaattgcttcgagttatgtatagcaaggctatgcagttgcaatttgctctaacttattgatttaaaaggccaatgctttgtataatttaacccaaaaaataagccacaattcattttaagttataattttagccaaggaaaaagtttggtcccatcaagattctgttgttaaggagtcaacacgccaaacattaggtgcaatgaagtatacaagccaagcaactctcaacacactaacaattaagcgcaccttcggtaccaaagaacaatctaaaaatatact

SEQ ID NO: 3782 - DNA, 1505 bp, Zea mays
  misc_feature (1)..(100): optimal_loci_228981_G1, chr6:129821589..129823093, Cluster 23
ttctctattgtccacgattcacgacaacctagatatgtaagagcgttctcaactgaacatagggtatcacatatattattaattagtgtaaatttatgtatcatgtgctactcttaaatcttgttgtatacaaagtgctgatctaatcttctagttggacaatatactctaccggacactatcttacattttattctttttttacagacaaggatatactgttattatagggagtctctagctaggtagatgaaagccgccaaattgtaactcaattggttgctgtatgcaatatccttgacgggaacacaacggggtaggacgacagctgcatttatatggatataactagaaatcgccattgtcttttgtcgttgtgtcccaatcagtcactatattggcatgtgcgtataaaaagtacgtatcgaaatctttggttttagtcctatcaaatattcgtgctgtgtttggatgcgaacaaactcattcatatgaataagacatcaacattgtctttagtttgagtcccaatcagttacctattgacatgtgtgtataaattatgttgtatcccaaatctttggtttgagttttatgatatattggtgttttgttcggatagaatttgtgttaactaattttttttatcgatctgtttaggggcatttgtgctaactaaattgttgcctctgttgtgattttacctctcatttttttaacttcaagattttatactttcattttaaaaacaaagcgttgttatacccttgcaatgttacgtatagttaacaatgttaaatctgatgtgaaaagacaaaaatatctatataatttattgtactttatctctaattatattacgtaattgtgattttatcaccgatggggtttcgcccacacagaatagtaagatggtagcttggacttttcacctatttcttttcacatttttatttttttaatcactgaagctgatttttgctaacgacgctgagagagaggagggcaaacagtagcttagttttcaaaacagaggaataatatcacaaagttaaaaaaacggaatataaaaccataattgcaagagcagcgaagggtataatcataattgtcccatctatctacgtatgttttaaatcagtaagtacaggcatgctaacaaaaaatgcattgattcagcattatcataaaaatgttaataataatgctccaatttttattttgttcttagatcgtctccgatgaaagttggtaaaggcttctctacataccatctccgatgaaagttggtaaaggcttctctacgctaaaataaaatgtatctaaaatatgagtctttaacgtatatgatacataggacaatgttacagagaatgagataaaaaaattaaagagtttgtaaataacaaatatagatgagaggtttaaagtatagggctagagacaatcttataatcacacctttcgtcgagtcaccatcgcctgcacaactgcatatcgtccac

SEQ ID NO: 3783 - DNA, 1523 bp, Zea mays
  misc_feature (1)..(100): optimal_loci_229285_G1, chr6:130885208..130886730, Cluster 23
actacactacagagaaaagaaagtgaatggtagagtgagaggtgtgaatgaactcaaacacaccctatattatagagtagatctatttttttgaatttcttgaatatttgttataaattttaaacaatcaaaatggcacgaatggatcatgagatgacgcatgataacagatggtcaatactaattggttctccaacacacgagtcaatatcagtcgcttcagctacaacaccattaatacctaccgaccgacgttggagttcaattgatcgatagtgaccgcctaactaataggagcataggagctaaatgtcggctaacctgggtcaccaggcccccttggcctttgctcatccactgctacagggtcaagacttcctgtcacttaccttgagctctcgtgctcttcagtcccccatccactactagtcactcacatctcttctgcaggtaggaagatttgagattgttttggttatttttttagttttgtttttgcatctgatttttgaacctcatgtactacatcgtcggtcctcatgaaattaagtagaaattcagcatttgaaggctacttacttcatattgggtatatgttcatttatattaaacaaaatgtcccttaatatattattgtgagctccacaacttattaagtggttggatcaatcagggccatagctcaatcccaatacgtcaaacaaaacaaaagctttgctgaatttagtcgaaataatcaataccaacatctggtgggttagtgaaactagtctaatgagcccatactaacgctaagctcctggggatgggaagtgaagaggccggcgacgacgacacgagtgagcagaagggaggagggggaggatgtggcagggttgcagaggggagcgggagagggaggggcttgtggcagcagggtcacatgggttactctacatgtgatggatgagagatgaaggaggaaggatgatcaaatcatccaaataacattgactattggatttaagtgagtaagagagaggagggttatctaacgatatgaaccgttggttttgattgtgcgttatttgtcggtgcaatttgtttggtggatgtagtggaggttatcggtatagaggtgttttgattgtgtggatttcacaatgttttaacaggtggattatataatggtatagaggtgtagatcaagacattaactaaaacaccaatctcgatgaaaatattacgagggaaagagtgtgaccggtagctaagcactcttttcaaaccagtatgttgttattatgttataataataatgggccaattctaaaagtctctcatagtcacacccagttctatcttaactagttagttgcttattcaccaatacattttctatatattacatatggttcctttgtataacataaaccaacatgagttgcaatggttcgaggtgagtactctcttcatagagaccaaggttcaaatcccagtaagcgcatttttactcgcactttatctatacccatatataaaac

SEQ ID NO: 3784 - DNA, 1916 bp, Zea mays
  misc_feature (1)..(100): optimal_loci_229391_G1, chr6:131491848..131493763, Cluster 23
ccattgttgtggcatgtgaatatgtcttgcttttgcttgtgcagatgacagaaatcaggggcacagggcaaggcaatggcttctttggccagaacagaaccatctgattggagaagaaaaggaaacaaaaatatatttttaggagcatataagggctatctgggctgctgcagtctaggtccaaaggcacgttctagcccaatagaacatatgagagcatgatttatggcacatatagagagcatagtcacaaagttcccagtgcgctggggtcatggaaggtggcacattacttgcgacgggcagggggagagccccccccccccccctacatccatgaaactccattggagaaagatgtggaggcctggagggtagaggagaagggaggaggaagaagaaaaagagataaaaatgagccttcctaccagcttgtgctgcctccgccactggtcattaggaaatcagaccccctttagcccattcctagatctgccactggtgacgggtttttacatggcagggtaaaaaatggctctgcatagcagggttggggaagactagcctggtctgttttgagatgaatgtgtcttggacgatggatggtgttcttttggtctaagttcagtctgtttgctgttatcgccagactaggtgtgtaataagggttgttttgaagcacagttatttgtttgtctgtcgaaactttgttggcggtaagaatagtggagcttgagtaggagcatgtttgccgggtggatgaaccctttgtgttcatgcttctgggtaggaattcaggatgtggtcgtgttatttcatcgttaaaaaacttctataattctgttgttcttgagtaatgaaatttggttcgtccgtgttgaaaaaaaggtgttgatgtctttgaccctgttttatgtgactagactgaattttattggaatgacacataaaacgcaaagatgcttatatagacacttaaagagagaaaccaaatgtgacatcagcaagcttttccacaagagtcagtctacaatggaaacaattatttcgcagatgcttaaattggtaaatttagaaactttttcaagcacttgaccatataatgtatttacatcataatccagttaatttttttatttggagacaaaagccaggctcctgtaagagattgaagcaccagacacctacacgagcgccgattcaggatgcaagaacacatgctgcctcaaggtagcttacacatggattgagaccttaggtgtctcctaagagcccagtgctgaacgtgcccttacagagtgggtgttagagagattgctggagatgcttagcttggtgtctaaaaagttaactagtgcgtgccatttatggtctcaatagaaaagaaaggcattaattgcatctgtgtatgttggtgattgattgaggggcatcatagtcatttccctttctccttaatctgccttaaaattcttatacatgcaaatgcttgtagatggagagagtatgaattataagtatgttcagtgcatagaaattatacagctggattcatatttcaaaatgcttccaaactatatcagtttcctagttacagatgatacgttttgtgagaaaccaatggccaaagtataacattaaagacaaaagaaaaacaaatatgcctataaaattgtggaacaaagggagtaccttctgaacaatatttcgctaggtgcttaccacttaagttctaccaaatgaccccagaaagaaactataacgcaattaaacataatggaagtcctagggggtgtcactgctgaacttgatcagcgaatccattggaagcacgcatcgcagcctcgcaggtttcaagtatatttttgcagcagcatgtttcgcacagcagaaagggataatcggcacaatacggg

SEQ ID NO: 3785 - DNA, 1742 bp, Zea mays
  misc_feature (1)..(100): optimal_loci_2304_G1, chr1:12415855..12417596, Cluster 23
gatggttctgtgccaagtgcagttaatgtggtcggtctcttactcaggcctggggttgaacctattgtacattgatacaacatgataactgaggaaatgtacttatgctatgatgattgaaatcttccttattcaagtgttcttcatgataactcttttctacttaccccctattgaatctattttctggttgattgaaaaagtagggctctttcataagtactccaaactatgcactctttcttgattatcccaaactatggacttctttcgtatttactttaccctttgactactcctctcaacttggtttcatggataggtactaggagatggttgaagggaatgagattttgttggtggaagtggcgaatgaggtagttgatgtaatctattgtacatgtaggacttgtatcaaccttgttggtgtttatgccttgaacaatctaagtatgaattgttgattatgctactattcaaatatgagaataagtccatttgtccaatgatgttattttcatgttattcttacttgtatgtatgtgttcccagatgttcatatatgttgttttactggttataacatcttttatgtgttgattttgatatgtcaggcttgtatgtgttgtttactccttctaaaagcctatattgttgtttcctagttagcactacatgtatgttatttttttccctaattctctcagttgtatgagctattatctggatctagtttagatgtttgtgttgatttctggttctgatagcatgtatgatctaccagtttcaatatctggtgaaatgataaaccttatcagaatgttgcaatgaagattaggtggtttgtctttcttctacgtgcatgatgctaactacctgagcataatttgtatctaagcatatgtccattgtccaatgatgtttaacacatggtatctttacatgtttcactatattttgtgtatttgttggccatattgcatgacttctgatgtctggttctaacaacttgtaagtattgttgtcttgatcaaaccaagtggttttttatcttttatgtgccaatgatgtatatgaggcatttacattctattgaaatctatgacttggtatgttgtccatcgtggttggcaaattggagttcttccacatgggaaacctgccatgccaaggtggtaggatacaaaggtgcatgtttcaaaggttttatttcaagagaggaggcatgtgttgtatttcaaggagaagatataaaggaaaatccaagaagtgctaagaaagataggacatctccatttgtcaaatacgacattattttgtttcaaactgtagttatttgtgttttagggggtgtttgggattgctccactctattactgttgctccgctccacgatttgtttgctaaatgttctcaactctagtaactgtgctccaaaaaacgtggagttggggtcaactccaccatttggtgaagcggtcaaataggtactccacaaaacatgttttatatataaacatggagttcagggttaattacccaccaatgctattcgttatggagaaataatgattcattttcccatcttttatttcctctcatcaccctttctccctgccagcacacatcttcttccccaccattccactccacgttttgtcgagctctctccctctgtccacatcggtctagcttgccttgtggacaagcaccactctagcaactatccatgagtagctagt

SEQ ID NO: 3786 - DNA, 3074 bp, Zea mays
  misc_feature (1)..(100): optimal_loci_230893_G1, chr6:138639377..138642450, Cluster 23
aggtacatcttaaggtgaccatctctaataatcaatttacaaatatggacattctaagatgaccaactatgttaatcgatggttgtcatatataggcgattgtcattggacacctgcctctataaatgatcttcatagtcatgcgtttgcttgaaggcctcttgggcatttacaaattacaatagtaatatcttgatgtgcttgattccattaatctgaaaggttgcctcctaaaatcaatttagttgtaataaaaattgttaatagtttgatatgttgtaagttttagaaatttaaaactacattcttttacataagctagaaacctcctccatcaatgctaggggcatcaagatttttctttggataaatgttagtcgagccaagtttagagagatgactattcatgcatctatccactgtaaggattcttgtcctccacttttctacatttcttacacttttgaattctaccataaaaatctatgcttcctcacattcttttgaattctaccataaaaaatctatgcttcctaacattattttgaattccacttaatccattgtaagaattcacgtcctccacttaatctatgtttcttagacttcgttcataactctttctaacattcttttgaattctaccataaaaacaaactgactagatggctccaagattcactatggttccttgggttcctataatcaattatttgataaagatatcccattagggttagccttcaaggagttgtacaatttataatatggtgaacaacacaccaaaaaataacgaccaagaggaattttatgaaaacttgtttaaaaggtgtttgcgaataatagatactttgtgtttgtcttctcatccattagattacatgctttacatggcatcaatctagatgtggatgcattaggtgaaaggattacttggtacaacgaaactaatgtggtatagaaagagatgcttagagtgtatactcattattattgttatgtttttatttaaggttctcatattctatttacagacactacttacatattctggatgataatttcacatatgcagcttggagcttctagtcaattcaacatcaagccaaggaacaactagatactactagtactatgtagatgtaggcctcactacacatggatggcaaagtcatttgtattttgttttgaaacctaacacattatcatttagaccaagatgttccatctttggtatatcatgtgttgatccttggaaagcaagagaggtacacaaatgcatgcatcgatttatttaaataatgtgctttgttacataatcattgatacaacatgaatgtgctttgttacataatcagagatattcactacacaaactatatcatgtaatgtagtaactagtggtgatgggtgtcctccacttggtttgtcttaaagagactattgtgtgtaattttgtatgtatgaacatatattaatttgtacattactgtttgtacattataacacttggtatgtatcaacttgatctcttttaaattatgatatattcattattgaatcatgtgacggagattcgagctcgttgtaattatagtataatcttgacagtagcgagatatatctatgcattaatagtattaaatgtagaatactagaaaatattttttacatttattattaaaataaattaataaagacttaaaaagtgaacaacactgctgggtttaagccacttaccttgcagagagtataatactctcactgctaagtagaggcttgatccaacaatgaccctcatcctagcttgttggatgtagctaagtttagtctagatactaattttttggattaggcgtcttaatattatgaattggaagcttccaacggtgctccaaacatttatcttcataggacaatctagcaaaaaaactaagtcctaaaattcataagataattataaatatatagtctttcatttggtggacttcaaccaatatcgccaataataatcactagatctatttttttctaaaaatcacccatctatacccttataaaaatacataaagtaaacctaaatctttatcttatctaaattaccaacatatgccattatgaatcaataatgtaaagcaagggctaaatttgatttttaatcgtcactatgagataaaatataaaataacccttttaactttgtatttaaatcatccacctatctttcatcacaaattacttataaatacccatatgagctattatcgaaaacaatgctataactgtagaacacactatagatgttctaattatacattgtattcattattaaattaaagtaaaaataaattttatatgccattatttagaccaagtaaatatacatacattatattaggataactatttattttaaaactttgtggttctggaaaatgttctgttcacaaaccatatacgaatgatactaacactcacatgatattatattgaaactcaatgaactataaactttgtaagttattactttatagaagtttatatattttgattgaagcattatgcaatatgtatgctagtaatttaattataaatacggtataattaatgtgagctaattgagtgtcgtggtgctggccaaagcaaccttttattctgttatagtaaataagagtggagcacaagacctaaaattcatctcttaataaaacacaaaatgatttttttgcaaagaaaataagattagagtttcaaatgagcacaatgttgatttcttacaatagctaataagattaaaagtcaaaatctgatatagagatttatcgtaaaacttttaataaatatttatctctattatataaagcaccattttttcatggttccacattcgtcgtgctcatccttctccttctcgctttatgcaaaaataaggcaaaattatgtacaagtggggatttaaaccttggtttttagctccacattcacactcacctaaccaacacacatatttttgagttttaataaaacaaagtctagccatgtgatatatataaaccatagcaatgcacggacat

SEQ ID NO: 3787 - DNA, 1605 bp, Zea mays
  misc_feature (1)..(100): optimal_loci_231461_G1, chr6:141048157..141049761, Cluster 23
caaactcgatggcagatgcgagacaatgatttagacaagttgaagccactgaatagtgtattcttacgtcctatatgttggatttgtcttgctttgaattattcatattagttgttacaaggggtacccctgcatatctttatatattctagagggtaggcacgcaattctaattcttgttggctactatagaaaagtcttaatcctattataaatattaccattctatagtcaattaggtcagtttacttgtgaaagtcacatcaccttatgttgtgtatttactagcagtccgatccatctctttgtcaattaatcaatatatagaaaacctttagcatggtgatccgtcggctatctttcaacttgaaagcacctatatatatacacagagacaagtgggcatccatgtttatatacatattcattaatgtttttatgcaactatttttttctctttatctttctatagcatataattagttcacgcaggagtagtgattacagtggttcagtttgcgagaagagcatcaaccagtacaacttgtcttcagaactgcattaatgggtcaaatcattttgcagcgattgcaagttgaagcaacaccctgcagctagattctttcgttggactagtttacagagcccatcatgtgcactgcacgagacgaagaagaatcgatgcatagacaatctggtcgatttggttgggacctaacaagaacaattagtacccttaaataaaaaattaatacagctataaaatttatatatgtcgatctgtcaaactagtttaagttttatcaaatttttcataaatagtattaatacatatgtctgtattaaagttcaatataaatacaattaatctaaaagtacctattttgtattataaatattaatttttaatatagttttagttaaagtttaaattatttgacttctcaaaaaacaaaaaaaaataagaattatatccttctgtggatatagagtatttcttacgtagacataccttgttgtagctatacatagcactagccttgtctctagtgccatcctaccacattaattataatttggaaggctctaacgcaccaagcttacttggtcgctgtattggattagatcgcattgatcaagacaacgttagggaacatatatagatacaatatgtttgtgccaacttctagggtttttaagttcaagtttttgttttgctaatagatcagttgaaatattttttgtaattatttatgatattggttattcctacatgcattttccaacttaaaattggcccttctcggcttctcgatctagttagggtgtgtttggttgcaacgataagacaaggcaaaataagatgatccttagataaagttgtttggtttagggttaggggtcgggacaagactgtcctagtagtatccccattgtccctcgaaattagagggacgagaggagacaccagggaacgtcctgactatctttaggtgtcccacaaccaaacgcacctgtgtttgtaaaataatataagtccatggtattaagaacaaaagtcaacaacacataatgtgaacacatataatcttgcactttgtatgg

SEQ ID NO: 3788 - DNA, 2687 bp, Zea mays
  misc_feature (1)..(100): optimal_loci_233355_G1, chr6:149583787..149586473, Cluster 23
atacagaacattgcatatacataaaaaatataggaggatatatacaggccaattcatcaaccttgagcatcatagctaaatatcttggcactaactatatatgttgcagagtaagatgtagctcgccaattgctaatgctgcaaccacttatatctagtgacaagaatcattgtgaatccattagtttaagagcaagagtaaaacattggaatgaggcaacactttgcttagtagtattcacatattgtatttatattttcctgtcggaaagcgtatagctaagataatcgataaatatggttccttatgattaagttctaaaacaattgcacgactttagtcaaaggtaaacaactatggtgtgtgttgccttagggtggtagcaatagggatgatgtaaggtaaagaaagagtagagaagacaatggagtagatagtaggagagggagagtaaggagtcatatgttactttactaccaagcaccatgaagctataaactatagcaagttagctaaacaaaggaatagaggggtacacaagcactttagggcacaccccactctattcttccattttcacatgttaactagaatagaacaataatgatccctatgctttaataattagacacattgtggtgaaatatagaggatggacaaggctatcaccacttgccacccaccactaactatcaaaaggcctagccaaaaccatacacaagcgatagcctaagcaccacgcgtcatctatatgctcactactttgatttgatctccaatgaaatgagattaaagcaccctaactagaacggttatcttatgcaagatataatcacactaaacaaggtagttaactaaactagcaattaagcttatagcaaagctttaagactactcaattaagtacactcaaataaagtacttgaaaatagtagaagtatatgttccaaataaggaaaagtcatacaaaagtcgaaaggtataggagctagatcacacttagaagttttcttctacactccaagcatagctcttactctatctcctactactagcctagctactatagagtgaactacattagatcctagagcttcttgatcttctttgatctgagttatcctttcctatggtgccaacatcactatttatagtgtgtatggagcatgtgggtacttgtaggggagagtaaagaggtagtggatcactggtggggttggacgtcccgtaggatcggctgaccctaggggggaaatatcatcccgtgtataggacctccttcgtgcacccgtacacaaaatcaatctagaacattctttcgagcacacgttttgttgttgttgcaaatatactactacacacagggaagcgtatgtggaaggtgtctttccttaaacacacataagcgcttaaccaataacaatcacgccagccgaaggatgatggacgaagcatcgagattgactttgtgcgcggatgcacacggaggagatcttatgcatagaatatattcccgtccctaatgtgccatacatactggatgagttggccaggcagggttatacctagcatgcatccatacctatagtttgttgatctattaatcaataacaatatcaactgacgatgctccacaagtgccccttgagtagtatatcgtcgcacaaaatctgaatggagactgcagatcagggggtcaaaggttgatttgtttgcttaagtatatatgtataggacctaggctaattaattagcgatcgagcaggtgtagctagctagctaggagagggaatgtgtctactttattttcctcgccttctgtgggcacgcacgcacgcttgcatattatatactcgtatatatatggtgattagcaagttttttcaacgttcgcaaaggcacacatgtgtcgcaagcaaagcaataagacgcaaagctagtcaagaaaacgacgaataatgcattgcacgcacgctcgcggattaaagagatgtgcacatatatattattataataatcaaaggctaaaccacacacacaaggactaatatatacggcggcgcgatcaactgcagagatcgacccggccgtgtgaagcgaaaaaatatatagcagaatgacgacgtgcctttttatttttgtggtggaagtcgcgtgcaggatatgtaggtcttatagtaggcttttcgaccaagtccaactttagggctctccttggattggacgaccgatcgatcacgccttgatttgttccaacttccaaccttgacgcagtgcgatctatgtgcgtggggtacggtgtggtcgaaagcacaaatggagagagactcgacgtcgacgaagataatgtaataaattagtgcgcttggcctggccaaataaagtgctacacaggagtttagttgcttcttgtacatgtacgccgcatgcatgtgtgtgtatacgtgcacggttcttcttcgttataaaattaatgcgcgtgccatgcattgatgcatgcatgaagagttcatgtgtatacgtacggttcttcttcgttataaaattagatattttttagttgtagattaataaaaaataataatactaaaaagctagtgacaatagaaaaatggtgcacgtgtgtcaacttagcgggttttggcatcaaatctttgagtaacaattataagtattaaatacacac

SEQ ID NO: 3789 - DNA, 1805 bp, Zea mays
  misc_feature (1)..(100): optimal_loci_234041_G1, chr6:153191455..153193259, Cluster 23
ctttgctctcacggttaatatatattaatcgtacgtacgtgtgtcctttaatttaattaattcagaactgatgggtacttattactggatgcaccagagaacgaactattatacctgcaaattaatatatgaacgacacgcatgcatggtcgtctttcacaccatcgtgaaatcgatctagagcatcatgcacatcatcccagtattctgcgcactactgatgagagcagcaaagtaacacaataatgtataacgttcggtgcattactacatattctctttgataaaagagcaaaattcctcgaacttagcaagctctatcactcgtacttagatcgaaaccagaaaaaaaaacggtcctataacttggccaatctgtataaaaccattcaaaaccgggtaccgacatgacgtggttttagatggaccgctaagctctagcacccttttctagttgagacttcaaggacccaaataatacatcatgtcgagtttaacaagtgcaagcaagtgggagagacacacgttctcacacactcagcgaaatatatataaaaaaaggcgcatccgctaggatttgaaccatggtctttagttagaaaagaaaagaagcaacataatcatctctaacaattacaacttatattggtttatgttatacaaataaactatatgatatagaaatcgtagcgatatacgacaactaactagtatatgtttaattcgctagctagcgtcgcttttcgttacaaacgacaaattccttttcatttcatgtttgttcttattatgcagggaacaacgccaaagcacatagcctatatatgtgtcgcgctaatgctgacacatatatatattcttctagaatagagagttgttcctatttgtataacatataactcataaagcgtccgtaccatgttatcataccgcataatttcagaaaaataattagaaatgatcttggtgacatggtcggaccccacaattaaattcgcccctgctgaaatattgagtgctcgctgcgctggagaaagaatcattctgcctcaaccctgataaactttggggcctatggctattctgtatcttatatgtacgtatctacgtcggatagaaacctattggctattatacgtgcacagtacagtactttcaaatataaaacgaataaacaataaaaaaatagtacacacaacatgcattatccctgtactactgtttcctacaattgcaagaaaagtgtgtgacagtacacaagtctattagtttggaaggacagtaatggacgatcaaccagtaccactaataaattcctactcgcctatagtttattggattacacatctctgtcaaatcttaggggaaaacaacagagcaaatgaaccactagacagattgaataagcaggaaccagaagcctaatggaatgaacgcatataagcgttattattactagttggatttgcacatatttgtgcggcgtggtttgttgtaataataaaaaaaagcattgttgctagaatggcttatctgtcatcaagaaaaatagtggaaaatgtaactaaataaacattttcttgattgatttttccaagcggggaaagccattattgcactaacgtcagaatccattttcttgatttattttccatgcatattccttttttctaacacatacttgattgatcggcaccagcaaattttgttaatggtaaataaacatggtgtttatgatgaaatcgtttgttcttgtcaagcgcatatcaaaatacctattacatactccaaggccgccttcttta

SEQ ID NO: 3790 - DNA, 1633 bp, Zea mays
  misc_feature (1)..(100): optimal_loci_237627_G1, chr7:2635310..2636942, Cluster 23
aaaccaaattagaaggtgtattaaagtgttctctataattaaactttgctatatagactagagtatatataaactttaccttctatgtatctcaaataaacattttaatttatcctagtgttgaagtcaatcaattaaattcttagccatgacaaagcctgttgaggaatgaagacataaagacattgcaagatgctacaaagactaactatgtatgaacaaagaacacgcaacgctaaaggagaatcttggacagcatgatggtatcttttccccacctttgaaattggtgtggattctaaggcaagcaacaagaggattttatttgagggcttttaggatttggatgtgtgtgcacttgctgaggaatctctgccatcccaccacccaaaaggaagccaccactgcacaaaggacacactacactgcactgcatatatgcatttgtggaccacgcccacaggatgatcagcaggaaaagcaaagcaaaagcaagatgctatcggatggattagtggcgaactagatgccaatttgcagtgatgtgtggatgaggaggcagccagtggttttgatgccctcctttagggtgatggcgaccttttgggatgcaatggttggtccctttcttgctagctagtgcatctctttctttctctctcccaacttgatgcgccatggttaatgcaacggaattctttcggctgaaatatatagaaacaaaatattgtataagctacaacagtagccgaattaaagctacagcaagccaccacgaacaagttggtcgtccactgagaatataatatatccttagatatactccttcagcttcagtttataatttgtttgactttctttactgtaattttggccggctattcttatttaaaaaacttttgaattgtcgttaattttttctctgatgttgtttagcaaataatatactttaaatatggttttgattttttattttttttctaaaaactgaataaaacgagctgatcaaacttggtaaaaaagagtcaaacgaattataaattgtgacggagtgagtaatatatactctaggaacaaggaatcttgtcctctgcgtccagattgcatgcaggccaagagattcctattctggttcatgatgatgctgattgacggtcattgtgatctgatcgagaaacatatgctgcatatggggtggcctgaaacaaaatttaatcaataattgacgcgtacctaataattcaagagacgcacacccacggaatattcaccaccagtgaatcattcctccttcacgagggacccaaaagcatataaaatctggatgcagtgggaagctagctgcacgcacagaaacgttgtattgtactccctccattcctcacaagtcatgattccaactgtcttttttatcataggttaaaatgctttaaattaaatctgactagaattataaacgcaattacaaacaattatagcctatttatttaatatacgcggtgtaaggttattatgttccttttatccgtcagttctgatttggtgatcatgaattacgaggggattgaatcccctccaatcctcttgtgaccccctttcccctcaatccccttcaactccgtaattcacttgt

SEQ ID NO: 3791 - DNA, 1512 bp, Zea mays
  misc_feature (1)..(100): optimal_loci_241003_G1, chr7:20722065..20723576, Cluster 23
attactcaaactagcaaaatataatattgtttctaaacttgactaattcaaactaagtttgctcatttggcctcgttcgtaaatttcacatagggatcgatggcacaatagcctcaaatttaccatactccacctgcacaaataccaaccctagagatatgtgtttagtgtttgttatattcttaagatttcaatcgttccatatcaacatctaattgttgctaataacacattttggtctatgtagttgggtttggggatgctaaaactgcatttgtaaatgtaatcttcggtaacccttctgaaggtagcgaccagaacaccaatcattcaagatatggctactgaacatttgatttcatgtaatacatatgactaataatttgactgacactatggatatttttgtgcgatgtttcataagaaaattctaaattctaagatatgtgatggatatttgtgaatggacatttgagctattgttatatgccaatgttatatgagttatatggatgaaatgtacatgaatcattttgtgtgtggtgaatgaatgaattttatgtgatttatatgagaaagtaaataaatatcatctattgttggctgttgatactaccattttttgttagctaaatagacaattgacaaaagttaatcttctagagataactttcatcgactaaacgaccagtcgatgaaagttagctaatttttgttggcttgttcttgaccgatgtaagttatcattatcggagctaattttttgttgtctgcttgtagccaacgaaaattagctaaccaactaaagctaataatttccgtttcctaatggacattagccgaggaccgacaaaagctagtctaagtcgatgaacattaactaacttctatcgggaaacaatattttcattgggttagagtcgacgaaagatataatttattgttgtgcatctcatgattgaattcacaaaagtctccataaaattgcttccaatgattgtgtcatgctaaaacgcagcagaacagatgagtaatgcgagccctagtagactttaaaagataattttatatgtatacagttggaaacatctctctatatggtagtgttgtctgttactctagatgctaaatagttatttcgctcctgacctcctgtcctacggcctacgggagacgtctgcccggtgcccgcgcatgcacatggactgggaaagacccgtgcgggaaaccctagccgcatgcacgtggaccgagaaaatcttttttagtttgtttgttttcgttatatcttataattaaaatatttaatcactgaagcgatatcatatttgtgtttctaatattttttgaagaaaactagatcacatgctatatatattttaattttttatttaatcacattgactgaccttgataatacagtgaccactgataagtacaatgaatgaccctaataactataatgactgaccctgataaaaatacaatgaccgacccactaaaattacttct

SEQ ID NO: 3792 - DNA, 1700 bp, Zea mays
  misc_feature (1)..(100): optimal_loci_243301_G1, chr7:34457154..34458853, Cluster 23
aatgggaaaatatagaaaatttaaaaaactattgttttcctgttgtgcacattatagaaaatcattttttgtaaacaacaggaaaatacatcaagcaaagtgacgagatgcacaagtgaaaacaactccttttcctgtacacgaccgatgacaagatgtgccaacattgctttatgaatcactttacaactagcagccaaacacaattcatcaacaaattcactcctaccagagaatcgcctagaatcagtccactagagaatcagctctcggagctagagaatcatggagcggagctctaccaaacgagcctttagtttcgactagatttgttgaatcaaaaacatgtaattatgcatagacattcaaacgataatataaatggcttccttttgttgtagttatggagccgcgctttagttgtgtctaaacaacttaaaaaagaagaaaaggaaacctttaatgattattaggtcaaaatgtaagatgaagctttacatccattaaaaaagcttaggatagagtgatagttcccctacaggtcgagtttataaggtgtaacataacaatctcctaaattatgatttgactaaacatctttcgtattgtattgtttgtgactattagataacacatttgattattattggataacacatttgtttatgatcatgtttggtactataggttgtgtcaaaacaacatacaaaagaagcaatgaaattttccatgattattattaggtcaaaatgcaagatgaagctttacatctattaaaagcttcaaatatagtgataatacgtcttttggtccggtttataaggtgtcttttaacatagcagtctcctaaattgtactttgactaatcatttttatatcatattgttcatgattattggatactacatttgattataaatctaatacatagtatcaagcttgcattacaatagttaaatgtttttggtcaaattgttggacaaaaaactataaagtttgactcttgatgtaagcaaaactccttataaaatggatcaaaggaagtaactaacaagcccctttcaacctatcaatataatagaccatacaacaatcctctttggcatataatgtattcattgatatttagaaacttcattttctcatagatctttcttgtccaatcagtcattcttgttcacagtttttatagtgttaatcaatagttttttgacaatgtaccaacaaagttcttgtgtcattttacttgggtttctctacttttgtaaactttatttgtgtacgaatcaatcaaatagaaagtgcagaaaaaatccaccactatggaaggtccatggggatactaaacaagtttgaattaccaagtaaacaaaaacgtgtagatgttagaagttttccattgttcaattcttcaaagtattttaattggtcttgtaaacaaaccctctcgtcaccctaaaaatgaatttcatattttttgcttctctttgcaaatatgagttttagctttagtttttagaatataaagtacatgatatcctatgttacaaaaaggtttcataaacttttaattgttacttttatgtgttctgatatttggtgggttgatttagtcctaacctgtatatgaaaataatcttgaaatatcttaatgtattttaataacaagagcctaaacaatcttctatgatatcttaatg

SEQ ID NO: 3793 - DNA, 1419 bp, Zea mays
  misc_feature (1)..(100): optimal_loci_243311_G1, chr7:34482420..34483838, Cluster 23
aaagtagctctagtgtgtccaaaagggctggtgggctaattttagaaccatatcattaaaaaatcgttgtccaaccagctagccatctacaactattcttttttctattttctagcctcacctagtagtatccaaacagacccaatatctactaaaattaatatataatataattagtatatatagcactactacgtacaatctttttttctttcccggagtgtatatgtacatactctgacttttctacagtctaatgctaacttattctttcaattagaaacaaacggtgtgcctttaattagggacgcgcgtgttcttttttcacattatacatatacaaaatctaaagcagcagtaacagtgcgaccatgtcgtcgtcttcgtagaattcgacgactcatgcaggaaacttcaactcttaattatgtacgttgactttccttgcttctgtggttgatattctcgatcccaaccaaggcttggatgtcgtcaaaacgaggaagtcgcccctctttgatcgaagaatttggactatagagataaataatattttttattattatagcctagtttttgaccaacagatataacaacatctttcgtttgaattcagactggcgggggtgcgtgtcggcgatggatgctgtttccgggaagtaggtagcgcgatgtgttctacacacatcacattattgctgcttacgtgcgtgatagctactgtgctcaaataatggtgtatatagtcatcagtattctggacctctattttttttataaaaaaaaccatgacgtacgtacgtggaaaaccaatcttacaggcaccaatgagaaacctatgtgggatctgcatatatgcacaaatgacaaggacgatctctgatgaaagtgaagctcagcaattaaaatgtaaatttcttgtcagtaaacgtttgtcttttgttgttaccatctcgatgtctcggttattttaattattgaacaggtcgttgatgagaagaaaaagtgtaataatataatggaaaatatataactatgtacggggtggccagagatcgagttggagccttggaggacaccctgtagccagatgcatatgggcaacgcttaccagcagatcatctgttaagtacacaggtcgcaacaaatataataggcccaggataatacaataatatataatgctgctcagttagccggccagtccttctaaggggtgtttgggagtgaagttttttcacagttttggaaaaatactgcagtatttttaaatactgcagtattatatacagaatggtgtttgacaagctgactaaaatctctgttttcaaaactgaagtattgtaaatactatagttgttttaaggtattctaaacttaggtctggacctcagtttccaaaattgtgatattgtaaac

SEQ ID NO: 3794 - DNA, 1981 bp, Zea mays
  misc_feature (1)..(100): optimal_loci_244009_G1, chr7:38607822..38609802, Cluster 23
gattttcagaacttgagtttctgacttgttattgatctttgaactatcttctccaagtcactttggatgaacttagagagagatcatatgactcagacaaatatatctagaggctttctgactagtctaagtcatagatctttgtcattttaattctctaactcatatcccttttttgctcaaacaatctccaaaatagtgatttgttgatttcgagctttctagcctctctagatgtatcgaatagactcgtagggatatttagaacttattcaaagagtagaactagtactcttagaaagttgtgagtagttcaactttaatctatcccatgataatatagataatgacttcaaatagttgtacaaattatgtgccataatgtcgaataacatgatgaaggatttttctagagttgtggtatctctgcctttagaaataaccactaattcatatctagacaatgactttctaggttgcattggtcgttgaagtgtggaattaattcatggcatgtagttgggtggccagtggtagtattgtaactaatgcaaaagtggtgaagtgcagtcatacattggaatcccaaagtttcctggtggtctttggggttgcatcttgatgaaaccatcataatcttgtttatggtctttagggttgtttgtgcactagagttgctggatctctcttttaacctgtttctcatgtcgctggcatcttcaagcgaattgtggtctttttgttcttttctgggttgtaatctttttgcaacacatagtgtttttcttgttcgagcttctttatttcttggttaaatgcttctaaatttttgaggaccttggcttgcacataagtttatgtatcttcatctttgactttgctcggtgggggatcttacacttttcctttgagggtttcagttcattggcaatctgtcttgacttcaccatttgagacatccatggctttagcaattttctttgcagtctcatttgctttcgatgactctaggtcttttgtccttggcttcacatcctttttagtggcattgaaaggtttgagcgacaaccacgagtgggcaccaactattgttctagaccaaagccttcgtgcatagggagtcgctgaacttctaaaaccatggctaaatgtaggaagaatcgtgaagcaaatatgatatgaaaggggaatagaaaagcttgttgagagaacaatgggaatcaccattcatcctcctccttgagactattgattagggcattatgtgtaggcctcctcttacatcgcaaaagtatgtcatgcccccatcctaccctaaatcttgagtaaatttctctgtcctaggggcatgcttgtgagatcagtacaacggcccaaaaagcattcaatcaccctaggacatgggggccatagggacctggttcgctgatgctaccataagtcagcttcacttgggtggggggatatgccctttcaacctccccctttgttaatattgtctttgcttcttttcgtgacacggggaagaggtccaacaaggtcccttcacaacttgtcatctatgaaacctagcgaagacctgcaacaagtaatgttaagcaaatagttggacgacatgaggcaaaggtgggcatgacgaaaggggcctctcccaacaatctccactataagttctatttcaatgtgcaatctatccacattatctattactaggtattcacataattatctactaatagtaatgccatttcactaacttatagcctttaatataaggtatccacatcatctgcactgaatgaaaatactactttcaatatataaatactagaaggcattcatgtattgctatttatttgtcgttccatcatctcataatttaatctaatgttgtttgattctattggattatttcattaccttgtccatttttaggaaaaatggaagtaagaatatgtaaatttaattcatacatactatc

SEQ ID NO: 3795 - DNA, 2069 bp, Zea mays
  misc_feature (1)..(100): optimal_loci_253600_G1, chr7:105234608..105236676, Cluster 23
cctacagttccgattattggataacttactctctcttactcaaatccaatgaataatattatttgaatcatctctcatccctcatctgcgactccgccgccctagcttccccctccctcctcttccctcacctccccatgatcgtagcgtcaatataggatatatgctagtagtaaacaaaacattagacaaaaaagaacagagcgagtgccaaactgttagaaaacatacaaggtactttaaagtaccttagggcatgtacagtccacaaataacggttgtctatatgtgttttgaaaaacacgtacagataatataaacaacaagccatacattgagttgtctatttatattgtctataaatattttaattcatgtgtggaacaagggctaaagcaatcatatagtggttgtattatagtctcttgcattaaagcacaggctgaagccgctcttcacgagagcacgatctatgcctctctcctcctcaattagcgtccatattagattttttcatttaattgctgcttacatgactgcttagagatggcatatttaatgccactgtacgtgccctacccttagtgcggagagtgtcatcgttcatatgtgtattaattactctgtcacttgagcatttttctgatatagcaaacgatttaaaaaggaggaaaaatattttcttcataggatgaaaagatgtgataaacagataataaagaaaaaacatatgattagataaaaaatattctgtaaaaaatataagaacatagtaatgtctatataaattaataggcatataagtatacacattaattatttctagcgttggaagtgcctctgctcccatgctgcctgaggttactgggtagatcgatcttcacatttcagaatgaatgcgccgcagacagttagggcgagtctctcgaggcagaaacaaaggcactgcgttgcgacatggagcttgtgagaaccacatgttgccaattggacgaagcatcctacgccggctggtttgaaccgactggtcatagatagatttcgatgatgttggacttggacagagacgcaagcaagagaaggatgagacggttctatccatttttaatttggctgggagtccaaggagtgcaaagcttccttttcattcaatggtggctaaaggcatccttccgtcttacacgagcttcgcaaaattctactatactccgttagtcgaccattaatgtaacgacttctgagtttcaaagtttcactaaggatatgtacagcccatagacagttgttgtttatatgtatattgaaaacaacataaaaatagatgtttacactctctgcgtagcttttaattgggacacaaatcacaattgggacataaacacacagcatacctggtttaatctttaggaaatagtcgcttcctcaagcatttcagtgtagatacatgttcttccttttcttcaaacagaggatgaacaacattatttatgctataagctaacaacactatttatgccataaactaagtagaggatgaactaattaatctaacgtcctcctcttatggttattctccctataaatcattgtaaacagtggcctaatgtgagcatgcaaaaaaaaacagagcatgtaaaagaaaatctattatctgagctaccagatagaccagttctagtagttgtactttgccatcagtccactagtcaccaggttgagaatataatcttgtacctttttcctttacttttttaatcctcttaccacagctaagaataatctaatcttataattgatattttcataatgtttttccttactattttgtaacaaaagcctagtctaaccacacactatttattaactgaataataacacacgctattttgaagaactgtattagcataattgtatagctcaatcatttgtaaagcacaccagtagaaccatttcaagcatatatctagacaaagattgaatctttgaagaaactatctagaaccagatgttggattgaatctcacgtaccaagttcttagttctgaggagggaaacccagattgagctac

SEQ ID NO: 3796 - DNA, 2466 bp, Zea mays
  misc_feature (1)..(100): optimal_loci_264909_G1, chr7:166734529..166736994, Cluster 23
ttaaatttatttttcacagtatggtctgtagtattttgcacggctatagcttgccaaaaaatagctctgtctctgacttatcctaaaaacagttttttttgtaaagctgaagcaatttcgcaaataatttgacagaaacagcttatatatactagagtcagagtcatttccctgtattaaagtgttagaattatagtcatccagagccagagtcgatgatgctactatttgtggctttttctccgcagttaaaaaaaccctgactattatatgttttttgcagtaagtcatttacaaaaaaaagtgtttagtaagacttgtttttttagagaaaagtcggaatcgaagctctgccaaacgagctctaaatggtggtttattgaagacgaaagtaactacaaccgagagttgtaagaacttattgttgtttacacaaagaaaaaaggaaaaggacaaaacatttatgattcaactgatcaaattaaaggatcaggatcaaattaaatgtggccacgatacaagagtttttaagcctacagagtcaagagcagatgtcactaataacttatctcatgcttggcactgcaaaacgaagcaaacacgttataaaaaaagcatgacaccacaactaggagaaagaattactttatatatgcactatgactaccaaaccaatgcaaaatataattgtttttttagagaaatgagtgctttttattgatcatataataagtcacaatcatgtagatctatatatttaggtcaaaagcttttgctctccacgtttggactcattattttcttttggtgaagagtttctttatagtgcctccgttggaaaatagctcaagctagggcttacaaaatatggatgtcacggtctgatggtcctagcctagcatggctacttggaatttttttcttcgcctcatattcctctagttcatataaaaactcagctagtagttataatcatgggtatgtagtaggatcattctgccaactggcaaattgcagattcactccaaacttttggctccaaaatgtggggaaagattgcctagatgcagtctggaccatttaatttcatttacaaaattgttggcggctttcgtgtatgctcgtttcagaaggaggggggggggggggggggggggatgatagaggtaaatgggtgggaaaaaaagatgtcggcatttcaactgcccaaactgacttttcttcggtgtggttgacaagctctgggcagaagcatggccgaacaagaatccacccaaaatattcattctgctggtgcaaaatccctaaccgcgcaatggacattttatatattttattaataaaaaagagaggatggcacatattacatcaactctttttttttctctatttaagatcgaatatcatgacttttgcgcgctccaaaagaatgaaaaaggctgcaagcttaaccattttcaatccatttcaactatgcatcaacagtgagtactaccttttttttaggtgaacgaaagcagagggtccatacccgatcgatcctatataaattcctgtgaaagacaactatgaggttgtactaaaagtagacatgcataagattctacttggttgtatctaaataatcattctatgctaaataaactttagctatcttagggccaaataggcatgactaaataaactttagctaagatcaaattccatccattatcgcctcaattaattgtagaaaataacagctaatacagggcgattgacatgtttaaccttgttgattcttactggtggcgccaaattaattaattaaaagagtgtccatatccttttatttatattagctaatccattatttaggaaatcaaataccctgccgcatgctagctaatattttcagctcaattttagttagctagagtagaaccaaatggggccatgaataaagattcaattcaaggcccggcaggcattattatcgatctcttcctccggtggaaaataccctaaaaataaggcgcactactaacaaacggcagctactacttccacgttctatgatgtgtatgtgcattgtatatatgggagtaggcgagtacgtgctttacagtcactgtctctcaagtaataagacatgcatgattaccttgtttgaatcttacgttgttggatcgtcgacgaggtgttgtttatttgctttgttccttttgttcgttcccatggcttgaagataagatgtatcatctagtagacatgcatatgcatgcaccggtgcggtacgtgagaagaatatttacgcagaaatgaaggctaacatgatgagatcgagtcgtcgaaccattatattggaagaagactagctgcgtacaagtactactggaccgcattgcttgatcgatgtattctagcttgctgaaatattgccgtgtgataacttaaaagaaccaacgtgtagtactcctttcgttt

SEQ ID NO: 3797 - DNA, 1662 bp, Zea mays
  misc_feature (1)..(100): optimal_loci_268143_G1, chr8:7293919..7295580, Cluster 23
cgaaggcaacaccatttataattcctctagcatgtaccgtttagggacgtgaaacagatattcgattgacttgatgccatcacaattctagtgtttgagtgagtaatctcacccaacagatataaacttgcttggtagctttaaaatagttagacctctcaagctaaatgccaatacacattctctaatgcatggcccagctcaaaaccgttccttctgttggatgaatgtacaaagaaaaaaaacgtgtttccattctacaaacatgtaataagctaagggagcattaatttgcacctatatataaaatgcattacctaactaacaagagtcccaaagtttattatattatattggtggttaatagaaatgactaagaaaaggattttttagtggctacaacaatttacttgagggtttgcacccaacaaaactaaaacacttccttggagcgaggtccccagttatacctaagcaattgaaatacgcatttttttttggagttgtttgataattcatggttttgaatagcgtgtccatggaaatgtgtaatttcctcggtggtttgggttgttactaaaaaaatgcattttcttggaggctttgcacaacccaagggccaaggtaatgatatatttcttgagaggttctaatttctcgggtaggttaaaggagtgtttggtttataggaactaaactttagtccatccattctattctattttagttcttaaattaccaaatacagaaactaaaatagagttttagtttccgtatttgtcaatttgtagactaatatagaataaaaatgaagagataaaaaaattagtttctaaaaagaccaaacacccctaagacactgtagagtattaattcatcacgtaagaaaggttcgcaacatgtgccaacgagaaaacgacgacacgaagtcaactagctcttccacccagcactactactgttgaaggaactgaacgctttcatgcatctagctagctaataacgaccaagaattgaatggaaaaaaagctgcgagaatgatccactgccctttaattaacgctgccccaccttttgcatatacttctcctccgatccactgaccaccacacgcccttaaccatcatcacttcatcggccgtcggattggacggcctctgtatatgcagtgcacacatatcgtcgtctcctgtccattccatcagtttcatgaacgaatcgacctctacgcgctcaaatagtctctttctccagaagctactacttcactagtccctttctgcttctttcttcgtactcgtgtgtacagagatagataggctaccgaagatagcctaagaaaagtatatacacattgaaaaacagcgaaaaatatttgtgttcttctagtatagttactttgtcattttgtgatagtgcatgtccttttgagtctaagttccagaattgctacaagtattcatatttttaatttctagatttactctatagtaacaaaggatcctagtgataggcggatcgaacaatgccagctgccaacgaagcatgctagcaggatgctgataggagtataatgtggcttttttgtgtatttattacaggggcgagtgcacatatatattatattcgcaaaaagaaaataaaagggaaaaagtgaactaa

SEQ ID NO: 3798 - DNA, 1447 bp, Zea mays
  misc_feature (1)..(100): optimal_loci_268269_G1, chr8:7772537..7773983, Cluster 23
accagtcgtgagccgtcggagactcggagagcgaaacgggtccgagctggttgctgagacgaccgtgaaggcgtgaacggaagggggatgcggtggacggccggcccagcctgggattgctcggcccgggagagcgcgcacgggcctccacctcggccgttatttttcacacgtttcctttgcatttttttctctctcactatttcttaatttgtgttcttctcgatttcatctctatcaatggctagcacaacattaattttaaaataagatataacaataattatattaattagaaattttggcctgtcgtagagtataataataattttacctctatttattctaactttgtaattttgtcgtatgtgttttttttatttaaagcttccgtttatccatgtttctaataacgttaggtgggccgagatttaatcaatggaaatggagagacgaacaaatgaaaggactaccatgttctttcacctaacctaaggtgttcagtcctttatactgtctccaaccatttatctgatatttcccctacgtatagggtgtctccaactatttctctatgcacattaactcagttattttatattttagaagtatgtatctggcaaacttttttcaggttgtctgtaccaagaatagttttccttttcagttttcggtgacagtgacacattgtgttccaaacattctccgcttttgacaattcgacacatgttcaaaatcgttatggtggtaccagttttctctgtcacaacgcatggacatgggtaaacagaaaaaaggtgaacgatgaacaagcaaaagataaactgaacttacaggcgaagcgaaaatatcataataatagctttcgacgtaagaatctattgatatcgagtggttgttagcaaatacacactttacacaatattagttagttgttcgtacaatgttatggtttttatatatcatatagttagatcttgtttaaataagatgtttattcaaacatgattatatttttttactaattattagttatatatttaaagtattatctctttatatgacatgaacaggcgtgcgctctagtggtacaagtcgcttgctttgagctgaacgtcttattccatgctagcgcaaattcagatagcgccctcacaagtgcttgttcgctgggaggatgcataaagattttcatcctttataaattataataattataatagattatgattctaatattcttcttatgctcggtatggccagttggccacaagttggacacaagaaagcggtggagatggcgtcgtaggacgacaaacattatattgagttacgcccgtttgttaaccctctaaattatttaatccagcttaataaataagttaccaagcaaacaaacaacatatattattagagtgaattatatatagtgtgttgtttccttcca

SEQ ID NO: 3799 - DNA, 1521 bp, Zea mays
  misc_feature (1)..(100): optimal_loci_271941_G1, chr8:29820192..29821712, Cluster 23
gtcagtaaagatgccatataacacataggcttgagatcgttactatacttgttcttagtttaggtcaataagattatggaaggtaggacgagttaggtaggctgtataaataaggaagtgagatatatagctcgttattatactgatttaatatctaatgaaatttattagtagttggagcctacgactcctagaagaaaccgccgtggtccattggccaaggtcaatccaagcaattcaagcaaaagcaaacatacccatgttgacaaggcttctctttttcccaaacctcacttctcccgaagtatcagagtatctcacttccctgattccctcttcccttgcagcaggctagcattgcaaggcacgaggtcatggcaggcgaaggccagccaaaggatctctctcaaagaataagggcatatacaacatgaaacaaagttttttcaaatacaagagatggttaaacgattgtatgatataaatttaaaatcctagatcaaaaatacagctaagagatatcgcgtatgaaaagtcgtgaagagacgagtttttcccgaatagcctgtttcttatattttttttacttaacccaagaagacacgatattaaatggggttatatatatgccttaaacgccacctttgccagtttatttgttaatttatctgagaactagttgttcttcgttaccttaacacgatgtcacgattgattatcatgagatagtttacatgcaaatatatcagtttttcactgtatagttctggcgatgcgtacaatgagccagcatacacatagagagaagtaaagaaagcgaaatgtttttttttcctgtggactttggaaaggaatctttgtgtccctttggaaaggctgtgtcttgtgtagtaggagggttaggctagccttggggcatgcatgcacagtgcacagtgcaatggaaatgcatgcacgaggcggatggccgctagaatcctactagggcctgctagagttcatacgctagaatccaagggattagcgttaaacaaaactcaaaggctactgctagtaatttgcatcgctcgctcgcgattcgatcagctgattctcacctgctctcgctttggatttcgcatcgcatcgcatctcatctcatatcatctctccggcatatagtgtattgtatgcgccacactgagtctgtgtccaacaagctttttatcacactttttactttaaactcaactctataaagaacattataaaacattgttttacataaacatatacatgttctgttaataagcacgacttggcgtggcaagtcctgtaacccacttcccaattcccatgcatgtattggccatacactccatccattgtcatcatttttcaaattaaagagcaatgtttgcatctcttcaatttattcattcattcacgagttttcaattaccaaaactatgtattgcattgcacagttcggttgtcgtttttcttattctacttttctacgtgataaaattaataccatat

SEQ ID NO: 3800 - DNA, 2124 bp, Zea mays
  misc_feature (1)..(100): optimal_loci_290742_G1, chr8:146544312..146546435, Cluster 23
gctagaaactcaaaacgaaacaagcttaaggtagctgaaaagaaagtaagaaagaaaaaaaaaacagagatgatggaaaacaaatacccagcccttacggatgcagagtagtatagtagcgtattcttgtcttccgcagttggttcagacttcaggctactgaatcataaaatgaacaacctttcagtctgtcaagtgaaagcgcccccatcggctgctgccggaacaaaagaatgtggtcagtgagtatgaaggaacaccatgcctacgatttaaaacgcacagttcgtagcatttgctttttcccaccgcttgcgttgcgtttgtcgtagccgtgcgctctgtctagacctggacacaagatctcatgtgtggatgtcaccaaaatgagcatcctgctggcagcatgcatgtcaaggctcaagtgtcaaccttgcacgtagtacgtagatgtacgtcgtcgttccggccactgggtagcacagggcccgtacgcaaattactctcaaaagatggggcttctgcgctccatccaaacctacaaggtcgtctccgtctcgccggtcgctgcacgtacatgtgtggtcatgttttatgcagtctaaattggtgaatatcagcagtgtcagctcatttcggccccagctaagctccattattcctgagtccgtcatcgagatagttgcgaactggttcagttgtttgaagatttctgaacgccatttgaaacccataattatgaagttggagttaatctatagcaaacgatattatttgggagcaacatttaccaagtacctacggggcgaacacttgcacatgaggtgccagacagtctgtgcatacgacgcccatatctctgctgccaaaatgtgcccgcactccccatcaggactaatgatcgcgcgagcccaattagtgtagatgccccttaacagaagtgcctaaaatgatctagcagattgctcatatgccaaagggcatggcccaaatcaagtacgggccagctccgagaggctttagttgcccaaccagctcatggggctgaattgtaacatgttcggacacagccacaccacacaggttgctcttcattccaaagcttatcaattctgaacctccagttagctttcgccgaggtgtctcaagagtcaagtctaaacctccagtgtgcagcagccttgccactgggcaatggcccattgcaaccaaaaaccatgcgttaaatctgacagcgccaaataaccaccgaaccatctgtcatgagatggttaataatcggcagacgcatcacgctccgaccgtgatgactgatggccagaatatatagatagatacaagtagagagtgtctgtccggtggcacggcttatgtttgtttaaatatactactgttgtgacatgttttttaactatttgtcataatattaagagcagaaaaaacttagcatacttttatatatagccagtttaattatacttcataatacagataggttaacaaaggaaatataaaacataatagaactcacaaatcgtgataccagatatttgagacaatttttttttattgtcgcaacaaacatagcccagtagacatggacacgagtgttcttctaatagcaaacacatacaaagtgagcacttctttgtacacatgactttcttggtattcgctaatctcttcatttggtgtggcagcgaaaactttgaggttgcttgtcgtagatgttcatatgacatagccacaagtagttgtctatgcgagaacaccagtttaagtagataaataccaacacgagggattgtttgttcgttcttgagatttattgagagccgttatgacgctagtcctaatagggatatgttttcttttaaacttaaatatttcattgttcgacgggcaaaaagtatgcgcgggaggaatactctctttcctgcatgtgttctaacacagtttatgcatctacggtgtttctctagaatgctaacaattagatattttctatattaaatttcgaatataaatcacatgatcaacaataaataatctagttgtctgttccacaataagtaacctaacaagttgactaacaggttaatcataaaaaggcagcacacttct

SEQ ID NO: 3801 - DNA, 1822 bp, Zea mays
  misc_feature (1)..(100): optimal_loci_291669_G1, chr8:151010573..151012394, Cluster 23
atggcagtgtgggtggccattgcatattgctcccatcttttttttcctcacctcaccgactagggtatgtaaaacctagagactataaatccatttttaaagtaaaagacaacaacaaagacagtatgatacaactctaaatctttaaattataaatatagttttcgtctcttgtattttttatttaaccccctaaagactttttaagagacaagttattaaatggggaggtccggaatctaaaacatactcactcgtcgttcccacttttcaagaaaatcaaacttttctatttttgattaaatatataaaattcaatattaatatatatatttagttttattaaattaatcatcaaatgtattttttactataaacttatttagagatgcaaatattattattattattttataaatctattaaatcttaagaaaaaaataaaagatatatattttatagtgatattctttagaaagtagtacagagtgacaactatatgcagagatcccttcccctttttggcaattatttcagtttacacgctcataaaattttagatttatttatttcctattatatatatatatatatatattattttacaaacataatacatacagagcaaacattatacgaaaagcaataataggtatcgaaaatagctctatgttacacctgtaacgatgttctccgaacaatatcactgctttgatatgatattcaatattattaacttttctattttaaaaaaatgttttagccttttatctaagtttgaattttgtttccctgatttaaacacatataatacataccaagaatttagacaatacacatgcaaacatattagaagtttgatgactaaaaaacatttaaaacgctagtttcttatattattcgtgacacgatgatacattacttattataaataagaaactaaaacttcaaatgtttctggtcatcaaccccccatcatggtataatgccctaattgtagtcattctcaatttttaatcttctcgtatttctcctaccacataaagtctttgtcgtggttgtagtctttaattggatgtgcatatttgtgcatgacaacgtcaaacatgtgtgctatgattcatgttacatgcttactggtgacccatcaattctcgttatataattaccagtgaccctatagctgctattgaatttctctaactctctaagttacttgcaagtgtagaatttatataatagtgtccgtcaaggttgtttcgacgcattgaactatataatatatgatcgattaaaaaagttgcaactaacaactagcatgttgccatatttggtcttgttcttctcagatctcctatcgatgaattcgggatcgtcgatatacatcttctaatcactatacaaaaaatatgtgagtcaatagccatttaaacatgattgtttatgtaaagggataagtattcacttataaggttagtacaccctcaaagtccttgtatgactcttttaggtaatttaaagagtcaagtacaacgataattccccactagatagactataaatacaatctagtgaccactcgtgcacgtgctgcaccattcaaaaaaagaagtttcaaatattgaaatatgaaagccttttgacttaaccagaacagtaggggcaaggggacacccattttcctcgatggacttcatgcatatatacacatacattgccgcctgatacttaaggttgttgtggatagctttatgggatttattctctattcatcattcaagttcttaagatctttatgatcatctgagtcttgaaacatgtg

SEQ ID NO: 3802 - DNA, 1541 bp, Zea mays
  misc_feature (1)..(100): optimal_loci_295802_G1, chr8:171270157..171271697, Cluster 23
  modified_base (242)..(242): a, c, g, or t
  misc_feature (242)..(341): n is a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
tagccagcttgtcaaacaccattatgtatataatactgcagtatttaagaatactgcaatattcttccaaaactgtgaaaaaactttcattcccaaacaccccctaatttttctatgtcgtagcattttaaaatataatgagaaataccttatcttttaatttgatgtatcagtctctatgacatattgttttcaaagtaatttacttaatcttatatagagagagagggatgagttatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccattatatttttgcccggagagggatggagaaaaaatgtccccgaaaacttttttaatgtcgtcgtgctattagagattatgaaggaggaatccttttttctttgattgatgtatcagtctctatgacatatgttttcgagagatattaacttaactttatagaaaaagaggagagttaagaccgctagggacataaaagtatatactgcttcattttaaatttatgattactttttataccgagtttgattagctcgttgtattaaaaaatcataaattattattaatttctatagtaatatcgtttaccatataatataatttaattacggctttgaatttttcattttttcacaaaaaagtaaacatgatgagctggtcaaacttggtaaaaaaaaaatcaaatgaatcataaattgagacggaaaattaatatatacattatgatccacaaatatcgtcctaaaaataaataaatagaataaaaggtgtttgaattcactggagctaatagtaaacagaagcgggcccagacatttaagattgggtattcaaaaattcaaaagattaaagaatttaggattctaatgctattttatataatacattattgacaaattagtgttctaacactataaatcaccaaaaacatgggtattcaatgaatacccatgatacccctgggcccgcccatgatagtaaactgctaaaattagttaaaaatatccaaacaccctctaaagcgatcaaaataaactaacatcaccattcttgaaatgttgccatgttatacaattataagatttgtccagatactagctcgttttacatgagcaacaatccctccgattataccattgctgtcacttgcaacgtgagctttaatttgattttgtttcttgcttctgagaaaacaaattaagctctcggctttcgacagtgaaaaatgcacgaatttcgtttgtgctgtggaggaataaaaccgggtggagctagcatgtgtggtatacccggaaaaacaggtgctgtctacgagggcgacgagggggtgaatgcaaaagaggaggcaagcatatacggcgtttaggacgtcgcgagcctgcgtcaccggtggcccccaccgtgacgtcgcataagcacccataatccttcctcaccgcccgcctcgccttacccgcaccatgatacctccgcgcg

SEQ ID NO: 3803 - DNA, 1448 bp, Zea mays
  misc_feature (1)..(100): optimal_loci_311466_G1, chr9:86385237..86386684, Cluster 23
ccatgttttataacagagctttgatatctgatactagttatcatggtgtgacttttgtccttactggtaaaaactttatataaatatctttttgatgtttgactttacctttttgtctttcaccctagcaagctcacatgtgcgctagtagtaaattgtctcctctttgggcaattttggccattgttattcttggttcaatgagatcatggtgcttcttagctacttgggtagctctatgcaccatggttctttatgttcagctgaataattgcataacattgatgttcttattctctatagatataagctatctcaatggtcattgcttcctttagtgggttagttttgataggatgcttagatttttaaataaaacaccatttttcatgtggcatagggaccttgccatcctcttatgcagtttatcaagtgcatggattgagcaggatgagctcgaagctactactcggtccagatgcctcccttagtcttctcaagcggcactcagtctcaaatctctagagcagacactgcctagatggagcaggtaggccattgatgggatcagaggaggagtggtgaagattgaacagactcacggaccccagccatagccagggttaaagtgggcagttttgaaaaacctgacatccatgtgtgtcgtaacaacatcttcagctatcagacaagacaatagtggcatagaagggtgtgaaaaaatgaaatgatatgcataaataacatgaacttttttagaatttggagcctcctttccctctgcatgggggtacttccaggtttgagattatggccatggatgatggagttgtgtggggtttgttgtcatcatccctctttatatggtgatctttgtcaataacagaaaaatattttattcagtatatctttattttaggttgtccttttgtaaattgggtgtgttttacttgcatgtattattctctttgagaaaatttctaacaacataaatcatttatatctgtagacgctgctactcttgggatttttctctattactttaatggaaggtgtataacaccagacacattagattggggtgatgagctatatgatgctgaatcaaattattttctttgaaaccataattctcgtgtagttcacttctgcaggaaacctcctattgtagcataatcgaattcaaccttgtggattgttctaggaatgtttgttcatgtgtttcgactatttataggttgagaaattgtagatcttggttgttgactgatcgaaatacattcacatatattgcaaaagagcataacagatgagatgagagctattactagagagaagaagatgagcatagaagaaggaagcatcggtgctttagattccatggttgttgactgatcgagatacattcacgtatatagcagacctacttgcaaaaaatcatcacatgg

SEQ ID NO: 3804 - DNA, 2384 bp, Zea mays
  misc_feature (1)..(100): optimal_loci_313339_G1, chr9:97800424..97802807, Cluster 23
aaaataaataagtgttataataataaaataaaaaatatttttaatgaaaaatatggaaatggaattataaaattaatttattaattcaatatactagtgaagagatacgataagaataaaataagataaactaaaaataattaattagatatattcattaagagatatagttaaataaagtgcatatgaacaatatataatttgttcacggtaggcaactcacaacaatttaaaccaaataatttttagcttttctgcagcagacaacatataacaatttcatagcagacaacagtaccgaacacatccttaaccgctatgctcgaggcattttcagtcttccaatttatatttgttccaaagttatttacgggaaaccatttaggttcgtgtgtgctacaggcctacaacgaataggtccaagatggccaccaagaccaagttggtgccctattgtttctgcccaaaaggcccactgccaaggcacgttttcttatgtttttttctgttcttctgctctgacgaacgatcaaatcaaatggtcgcatcagcggctgttgacagcacctctgccgccactccactcgatctaggggtcaagtgctgggcactgcagcgccgcagcggccgttcgccgcgcacacggacgcggatggtgactggatggtgagatttgaatgcacacggacggccgagcggagtcgacgcgacgccgagtataacatgcgtgtgtcgacatcgtggtgtaatctcaaagtgtcggtcgcgtaggtttccaagatatcacttttttttgcattcgactatgaatatagatgttgtcggatataaatacaaaactctcaaatttgaatatctacttgaattaaagataatatgtatccatgtatttataagtagttttgcagtataataaatcagtaacggttaaaatgaatctgtacaccgtaaataaagaaaaatattaagaataaaatattttaatcgctattttatacattaaatcaataaaatataggtaatgtatattccctctgtccatacgagtttatcttttttgtttaatttaagtcaatcactatcaactttggtcattttttactagatgtttcataagattttacaacaataaaagtaaaattattatattcgtcgtagcttaagaattgtcttaatatgtatttcttttagtttaaaataatttaatcttatatagtttgttggttaaagttaaaaagtttgacttgggacaaaattagaaaggcaaactcatacagacggagagagcattaaccattgagttcaaataatttaaaatatattctaaaaatatataagaaaacaaaatactaagtaaataatattctttaattcattaatcttaatatttatatattatttacaatatttaaattaaattaacaatagataacttcttgataaagagatacatatatcatctattatattaaaattatttttatatagttaattagtttctagtttgaaaataatttgtactatatggatataaataatatcaaacattatatatttttgttgatagtgatgtggcatctaatagagaataatttaaaaaaaataaatgtaaatacatccatatctggatcctatacaaatacagatatctatctttatgataaagcagaaaaaaaatcagaccatatctttcgcatatcccctacggtcattgtatattgacaaccttctgctgttgtgctaaagaaaaagcttatttcactttcactgtattatagtagctagtaggacaaattaaacagccagagaaagccaaaagagacgatcgagaactttatacgccgaaacagtgccacgaacagaagcagtctagccggtcttttacgattggattggattttcgccactgtgatgaaaggatcggatagaaggcgggaaaatgacaggaggagccaaggaggggttgctgacttgctgctggtgaactgacaggcgcatatacacgcaccgtcgttctcatcctcttgacctcttttcctggatgagtgccattaaaatggtcaccaaccggcaaatggccaactgttcctactacccgcgtagtcgtagacacacggcttgtgtaatacagcgtcgtgcgtcgcgtcgaccttgttcgctacagagcgaaggctccaaaacgaggcagaatattcgtgggcataatccttctagttcccaaacaccaccgggtgatgcacacatgcatcagtccaggcctcctagatggcgccctagcccttagccaatgccaatgagcttaacaaaagtgatctatggaacgaacccatggtactctttcctctttcttttttttttgctaccaccaacttctttgtttttta

SEQ ID NO: 3805 - DNA, 1779 bp, Zea mays
  misc_feature (1)..(100): optimal_loci_313985_G1, chr9:100933246..100935024, Cluster 23
cgaataagctttgaagttttttttatttgtacacccttgttgatcaccttgacctttgtacagttcttcatacaattctccaagtatggttgtctacgtagaggtcatcatcgatatatccaattcatctctgtgcaaaatagactttgatgggaagttgctcgatcgacgaaaattagagcattcaatggtaagttgtgacttttacccgtgtgcccaaaaaggaccccaccctccaagggccccaaaatattagctagtaatagtttagtcagagtagaagatctagctaagttagctcggtaataggaaacatggtgtttgtcgtggaaaatggagtgttaatctctcatgcaactcgttttagctacgaggcgaagtgtagccagtacatgtttgaagtaatgaaagaaaaaaaaatgtgtttgcgtcctttcggaagaacttacatcccttcacatgttaacgacacaaccacgattaatatatgagattaatgtacatcatcaatctttaacaaagaaaaaaaatcggtacaggggcttaaattatgccggccaggccctggatgctatattttggtgtgtgccggaccctgccttcgccgctggtagtcgtcgtcaggccagactgtccacttctaatcctttccaggaggcgtgaaattggcggcgaccaccttgtgagtgccatgccatcatcggttcggttggccctttgcgctctggcattggttctctatggtttcctgatggtgaaatgaaaatacgaaggcttgtttcaggccatgttttgatctagtcgttacattctctttttataaactgcagcttaaggtgacacggtctcctactgtcctgcgctttattttctagctagaattaaagctacagagacttttttctctaaacacatgacactgtctctcaaactacattatgatcatttatttatactatattgtttatacttataaacgtatgataataatagtatattcaattataaatctaaccatatcgaatttgtactataataattaaaatttattagctaaattactggatcaaatattttaattttaaatcatgatatatgtgtgtcttataaaagaggttggaggaagtatcaactaacttttaatcactataattttagttttaggcaaaaggtcacatgccggttctcttggtcgtgtgcatacgagatggattgatctattagaaacgaatccttgtgtaggtgctgagagggcttaacgcacaggtaaagatctggcctatagggggaccctcattctatattggaggctagttttcgtgacctttcttggtctagcttcgattgagattcttattaatataatataatataatataatatcgtgaggtagtctttctcctacagtccgagtttttttaaatggacgaattaatttttagcataatccaactaattattagcccgtcctagtagtttatgtattcaaacagcacaaaactaaactttactcgcctaaatttcaactgcctaaactttagttagattaatagctagtctaggtgatcaaacaaacaattaggaaaaggaaatagtcctacagcactgacaagtacaagcataggaattcagtgactcgggcatatcgtttcagtaaaacttgcttttaggccataaagcaaggttttaaatatccaattatagcgactgatatatttcgatatagcatttttagcagcgaaaggttatgttgtttagcttgatataccccgttgtatc

SEQ ID NO: 3806 - DNA, 2288 bp, Zea mays
  misc_feature (1)..(100): optimal_loci_322567_G1, chr9:146406774..146409061, Cluster 23
taacaactaatagcatggtaaactcttgttttcaagagagttgtgacttatgattatcttgatacaataaattttcccttataaaaaaaagcatggtaaagtaaatgcacacaaggcagacacgcaaggaagctgtttcttagcgctgtatgactgcttccagctcaatctttccaagttgtactgctatgtgtaatttctgaaacggaagacgcaaaagttcgaacgtctaccatttaccactcattaagcaaaaaaaaggtggcctacttgaatctaaaagaaattgtccaagcaaagagaaaaaggctgtccaacaaaagacaacttaactgtactgcatctgaaaacaaaaacatgtgaagcatgaataagaaaaaatgtcaaaaatgggatttgaaagcatggcctttcgaaccattacctgaaactagcgctgttacaactgcttccagctcaatctttccattctggaatgcaagacacaaaaagttcgaacgtctaccatgtccaagcatatgtatttccctcccacaaaatatcttaaacaaactaaggtttttatattatatatcaaatatataaagaaaaggaacgaccactcattaagcaaataaaggttgtctgcctgaattttaaaaaaattgttcaagcaaagaaagctgcttacctgtactgaatctgaacaaaaaaacaaaaacatgccaggaatgaataaaagctatgatgaatctgtaaaacatgtcaagatcaaccacacattaagcaaagaaaggtggtctgcctgaatctaaaaaaactgtccaagcaaagagaaatagattgttcaagcaaagaaaggttacctgtaatgaatctgaatctaaaacaacaatgcagaaacatgtcaagaatgtacaaaaactatgatgaatccaaaaaacatgtcaagatcgaccactcattaagcaaacaaaggtggcctgactaaatttaaaaaaatgtccaagcaaagaaagcttacctgactgaatctgaaaaaaaagacaagaacatgtcaagaccaaccactgaatctaaaaatctgtccaaacaaagaaagcttacttgtactgaatctggaaaaaaaaagacaaaagcaaagaatgaacaaaaaaaaatgagaatgtacaaaaactatgatgaatctgaaaaacatgtcaagatcgaccactcattaagaaacgaaaggtggtggtctgactgaatctaaaaaaatgtccaaacaaagaaagcttacctaactgaatctggaaaaaaagacaaaaacatatcaagatcaaccactgaatctaaaaaactgtccaaacaaagaaagcttacttgtactgaatctggaaaaaaaaagacaaaagcaaagaatgaacaaaaaaaatgagaatgtacaaaaactatgatgaatctgaaaaacatgtcaagatcgaccactcattaagaaacgaaaggtggtggtctgactgaatctaaaaaaatgtccaaacaaagaaagcttacctaactgaatctggaaaaaaagacaaaaacatgtcaagatcaaccactgaatctaaaaaaatgtccaaacaaagaaagcttacctaactgaatctggaaaaaaagacaaaaacatgtcaagatcaaccactgaatctaaaaaactgtccaaacaaagaaagcttacttgtactgaatctggaaaaaaaagacaaaagcaaagaatgaacaaaaaaaaatgagaatgtacaaaaactatgatgaatctgaaaaacatgtcaagatcgaccactcattaagaaacgaaaggtggtggtctgactgaatctaaaaaaatgtccaaacaaagaaagcttacctaactgaatctggaaaaaaagacaaaaacatgtcaagatcaaccactgaatctaaaaaactgtccaaacaaagaaagcttacttgtactgaatctgaaaaaaaagacagaagcaaagaatgaacaaataatatgtcaagaatgggatttgaacccatgccctttcggaccagtacctgaaactggcgccttagaccaactcggccatcttgacatttattgatagaagaagaacatgttaatttttattatcagatctgttcatgtaatgaattcaagagctatattacagtacattttaaaattcaacttcgttaagtgactatgaacatgagtcatgaatttagatcacgcacgagacaatagataaatttgagagcggagttggggctctgttcaggacgttgatccggattagagtctctcttctgaatactct

SEQ ID NO: 3807 - DNA, 1733 bp, Zea mays
  misc_feature (1)..(100): optimal_loci_32356_G1, chr1:198535375..198537107, Cluster 23
ctatataccattggtatttttagagtattggaaacccaattccaacccaaagtttccatggaacgactagcttttgtctaaataccatggtttataatgttgtatccaaataatgtttctcaaaatcatggtatttttggagtcggctaaaactaattatgacaaccgcaaagtatagtattgtaaaaccttgttttagaaaaagattgttgccaaccagacactaaatatttagttgggtccttggctttgttagggcgtatataaccctatttaatataatatggagtcccttgagggggtttagagggttaaatgggaaatgttataatagacggtctttctagagtctgtctctacacgattctctctatatatattgtcttttaactatatttatagtgtgactgattttaaagatatatgtagtcttttagttgtctcttacatttgaaaaatcgattcagccaggttttatagaccttaaagtttatctttttcccattcaattgttcagcagttgaattaaatgagtttgtttaaagaaattaaattaaatgagtttttgttcgaccgatggtctagaaaaagcaaagtttcatccaaactttaggccctatttggaaataaagtatttaaaaactatagttttgaaatgccaacacatatctacaattttttaccacaatactaaaactttggtctggtgctacgtttccaaaactataaaagtactaagcatatccaaaactataattttgaaaacaaagtttttgaagagtctaacgaacaccgcattgaaaaataaataccacagtatctcaaatactacagtattctccaaaagcagagaaaatactccacatccaaacagtcccttacaaatttagttgttcttttttgtccattttgaagcatggaaaatttagtgtatttgtgtatttgagcccggcttcaaccttaccgtgataatatagggaattcgggttcacggagccatccggccatgtaaaaaaaaatgcttgacctggccctccaccgtccacgcctccacttatgccctcctttgtcttccctccgaccccccgttactgcctcacacgttcttggcgcatcgtttctctatatatattgtttttaaactatatttatagtgtggctgattttaaagatatatgtagtcctttagttgtctcttacatttggaaaaccaattcagagcctcaagattttatagaccttatagtttacctttttccattcaatagttcagtagttgaattaaatgagtttgtttaaaaattaaattaaatgagttttcgttcgaccgatggtctagaaaaagcaaaatttcatccaaactttaggccctatttggaaataaagtatttgaaaactatagttttgaaatgtcaacacatatctacattttttacaataatattaaaaactttggtctggtgctaagtttccaaaactgtaaaattaatgagcatagctaaaactacaattttgaaaatagagtttttgaaaaaagtctaccgaacaccgcatcgaaaaataaataacacaatatctcaaatactacagtattctccaaaaacagataaaatactccacttccaaacagtcccttacaaatttggttgttgttttttgtccattttgaaccatggaaaatttagtgtatttgtgtatttgagcccggcttcaaccttaacgcgacaatatat

SEQ ID NO: 3808 - DNA, 1464 bp, Zea mays
  misc_feature (1)..(100): optimal_loci_323572_G1, chr9:151072470..151073933, Cluster 23
gcacactcgtttcatccaagaaaatattgctacaggttagtactaatcaattttttatgaatttggatagatttatatgaaaaaagtattaacaacatttatatcttaaaccagtttactacaaaaatatattcattaaaattatctaacgatactagttatatactataaatatatttatatgtttttatatgttttattaaaataagaaacaattaacttctcgaaaaaataaaaattagtactagtattctttatgagatctaggcagtagacttcaatttcgaacatgagcttaggccgcatcgagatgctgtcctgtgatgaccggcctttttttttacatcaaattaaattgggcttgcggctttgttagatctgccatgtcattttggctcgtttcataaactcaagcatgcattggccaatgtgaaaccatgctagtcaatagagttctcgttgaccccacaaaagaagttccgcttttaaaatatttttaaacggcgacggcgcaagctaagtcaaacgacagatcgatggcagcttcgcaaatgtgcggcaactcgaaactcgtgtgtcttggttacagaaattaacgacgaccctcggtgccagaagcatgagctcatgaccaaggctagatgctcttctgtgcgcgctcccatatcggtccagtccagacgaacgatttaggccagctccgagagtccatctgtatattattttccatctagatgggaataaaaattcagttaattttttttacttcttcaattagattttgaaatgttgatgatctctattctaaatttctaagatagagagcgaagtcaactctctaaaatacgtataccatatgaaagttatatctacgggtaaaaagatataaagaacgacttttattcaaataatgaattattagagagcgaatctaaaaaaaggctcatagagatccctcttagattctatttgggtccatagtaattgtaataattagctaatactccctttcaaattctaagaaaattttacttttctaaatacattgcttttattatatatctatagacattttatctaaaaattttatatctcgacttaatatatatctatgtatatagcaaaaactatatgtataaagaaaagctaatacttctcaaaacttggaacgaatggagtataatctaattatgattcaaaccctatattgtaataatcctataatccagatggattgaatggagtataattagattattatatgatggattgatataattgaaaccctatattgtaataatcctataatccagataatgcatattttttagaaaattttgggtgttaaaagtctggtttacatccacatttagcttttcttctcttcgccatcaagtaaaaagtggccctaggacaccacacaacgtcaaataaaaaaagtgaagtcaaactaaatgagcgata

SEQ ID NO: 3809 - DNA, 1538 bp, Zea mays
  misc_feature (1)..(100): optimal_loci_323894_G1, chr9:152509839..152511376, Cluster 23
atattgtttttttggacgtatggttttatgtttacaaaacccgctgtttcatttcacaatgatttcctttcaacttaagctaccaaaacaaaccaagaaattactttcacatagaggtttggatgattagaatatacacttttattacatatacgtgagcatttccccctacggaaatccctgtatgaagcagtacaaaactgatttagcattagggaaacgatattgtaccatagcattcccgtgtgttggacactactggctaaacataatttctatccaaatcagtatatggctatatgttgcgatacaacagctgacaaactgttgtagtttttgtcagttctcaccatcttttcttttccccaaagaatcgtaaaggacttcaggcaagtgtttctcaccatcttttcttttcccacatagaatatgtatgagagctgtgtatcttaggtatactaatatgtcagcataacctcgcagcaggaattctggtatgcttcaaagtttttttttgaataatatgtgttttgtttttatgtaatctttgtgctctaatatactgctccgattgatatgttggcctgctaaagctataattttcagtttacttgcatggaactcattatttttatattggctctattttatttgaacttatagtagcacatctgtccattattgatatttttttcttaatacatgattaatctagctcctgttattctattcactatattgaattagttttgaccaaaaaccctagtaagctggaatcacattgttttgtagatgtttttcttcactataaatgcttaaaattaacctgataaattcatctacgggctctttcaaatggcaagcccactgttgttgagttttatgcaaactggtgtgaagtctgcagggaactagctctagatatccacaaagttgaacaacaatacaagtctgcagggaactagactctgagaaccctattgttgatgtggagagcattgtagccaaggccataagagatggcgcaattgatgccaccatagatcatgcaaatggctggatggtatggagcacttagacaacactaaagtgacgagcacaaagatggcctcacgtcctgcaaacatgtactgtcaagaaagcgaacaggaggaagaactggctaagcacatggctgaggtgggtgacgacttctatatctgccttttgagcaaccacttgcaattatggacttgttcgaacgcctggttaaaccctgcctctagctactcgagtcatgcaaacactggactttgaaattcatccactgtaatgttatgttgatcagtgtttttctttaaattcaatactttgaattttaatctccctgaattgttaaaccatgaaatttacccaccatgcaaacgactttgtttatttcatgcattctctgctcccacttggggcttttctgaaatgttgtattctgtgttcgatttttgtgtctttatttaataaaactaggctctcgggccttttaaataacttgacgcccagct

SEQ ID NO: 3810 - DNA, 2042 bp, Zea mays
  misc_feature (1)..(100): optimal_loci_326723_G1, chr10:11611893..11613934, Cluster 23
ggcgaccctaggggtggggcagaggggcggccgccctagcctccagatccatagggccctgatcctagatataaattcaatagttagactatcagtgtatgacataatagtttagcaacgaagtaccaaagagtttatggttacgacatgttcacaatcagatcttatatatctaaacatgttagaaaaaaacttttaaggtaatattttaatatctatctttttatttacttattgcttgatataaatatttttagatgtatcttaagtgtttatattagtagtatttatatataaaaaaaattagaagggccctgttttaaatcttgtcaagggccccaaaatctcatgacctccactgattccttcagaacatttcacacaaactaaatgagcttaaacatgaacatcaatggaccggggttttgaaagggacctctagaaataccattttaagactattatatatatctcaaaccaccgtatctaagaatgatcgtttaaatagttaccgcccaaaaaatctatatatgcacaacaataatctgaataattttcatcggctaaaggtcctaaaaattatatgttatccatgaaaattagctacctttcgtcagtatttactaattttcgtcaatctctaacttttgtagattatgtggggtgtccgacggaaattatcaattttaatatgatgtacttagtcgacaaattagctttaccaacaacaaattaatcattatatccatccataacacacacacatacccattcacaacacctatgtattcattcacatcacatacattcactcatatcaatccacaacacacaattcatccataccatatttataaatttataagaaatcttcaagtagcattagttcttcataagtctagatcattcaaatagaataaaagtaccaatattcatacactaaaaccactctcaaataggatctgccaaatgattagagttctcaccactatctagagggttcttgaacaatttgttaacaaataagttagatatgtcagcatctgcaggtgttgctaactatggagtatgagtctaataatgatgtaaattataattagttagaattgatttacaatggctacaattagatagaggtgagccaaattaactaatgtttgctagaatttgagctatattaactaagttattctacagtggctaagtttagctatagttgaactagcttgactatttttcctagaattgagctaaggtggttaattttgctaaattaactaagttacatagaattgagctatattggctactttgctagaattaagctaagttcgcaaatttttattagaattgagataaatttgctaaatatatgattacttgaggtccaagcattggtggagaaccccattacaacggtggtggtggtggtgttggcatatggaacacatgaaaagtgatgttttctccatcttctataacattgtctgagaatggaataaataacactattatatatattatatgctaacagtgatgatagaagatcggttgaacttacttgaaacatcatctgctgttttgctatatagttagagaaatattcatcatgttgttggtcatactattgtcattgcctctactgcttatcgtacaacctcattgatttttgaatccaaagcaactcatcttgtgtctttgttcgaacaacgccaactcagagctctacggtgaggatgctgctttctaagctctcaccttcctaaaattagtcactccatttaacatgaagtaacctgaaatacaaacaatttagaatttcaatttcgtacttgcattaaaaattttgggggaaattgtaatatcatatcgctcgtggctctttccacctccactagtgtgcacgatagaaggatcaactagtagcgcttatcaattgcaattctcttcaaattgattgactatttcttgatcatattgcattaagagtataaaaaaccaagaaaggtaacaataaagtttgatataataaaaataatgtg

SEQ ID NO: 3811 - DNA, 2602 bp, Zea mays
  misc_feature (1)..(100): optimal_loci_329124_G1, chr10:25017109..25019710, Cluster 23
tccacacgcctctagggtgatagactctaactagctgtaagcactaagcagtaaaactcttctcaacttcttttttattactagtgattgtagtgagcgagctaaatactagattgttcaagtggtataaaattttgcattcattagttatattgttatattgtatctctcattttatacaaataattaacttgcaatgtgtaggttcaaatttaagtgctaatgttgatgaagttattagaggcgagaaaggaccaaatcacctctaattaggtacctttatattttttcaagtttattgtatttttagatactgaattgaggtaaaatattttagtctatgtttttggtatattttgttttagcgttatatttagccgtacaatattttagggttaccttcatattttatagtggcccggggcgttagttttatagagctccgccactggttctaaacatcgacaacatgaacgaagatatgagaaggatccacatgttagccgttaaatggttaagcaaagaattaaaactggatgaacgagggaacgaggaaagcgaggcggacaagtagtttttatatgaattttgtagttttatttgtttttaaaaatttgttgtattttatgaagtttgtttaatttatatagttttatttttgtaacgagaatgttttttttatgttgggacagatggagtatagtagataacacactacacactagtgaatagataggtataaactcggtgcatagctgtcatccctgctactgattcaatgccatgaacaaacgattggcacatgatttgcatgcacatatggtccagcagagactccaagtatgaccgtagcacagtagtaacactgtgtcatcaattcggtgccggccagttaactatgagcagacgacgatccaattgcccatgcatcgcccagctctcacagcaccgtcagatcaaagatcgtgcggcctacacgagcctgccggttgatcatttaaataagctgcattgatggaccgtggtccttgtgaatgatgccgtctgaatttaggtctgttggatctgatctgaacatgcatgggcgggctactggagcaatataaaagaaaaatggtctaaaacttgtaatacgtatatctgaattcatatctgtttctaacgtgatatgattttccttattcaaattcattgttcttataatatttctttatccaattttagatccgtatttaacaaaaaaatatagaatattccacatttatccgcatccgcgaagaacaagtataacatatctgtttaatttttttatctctataactagtgactaattatttcatttcaatattattaatgatgcattaaaaccatttatattgtatctgtatgtaatttttaatattaatttaatactattaatgatacataaatattaaattaattttagtatttttataatgcattttaaacctaatatattttgttgcaaattatttaataattttttatgtcaattaatttatataatttataattttatgataaacattatataaataatgattgattgattgaaaaattatatatatatatataatgagttattcttggttatgttgtataccaacatactttattctctaataattatcaaaattgataaatcaaaatgtctacttgttgcctaccatcttttatttaataccatccattataatttagttcacttctacattggagatcattagaagggcattctgattttatttcactttggttattgacgaacttagtagaaaattttctattcatctatgtaaaatttaacaatatgcactttgagttgaatcgagtaaatatccaaatagaaatccgaatttgagacatttgttttgtattcatattcaaaaagatcagcatccatatttgaatccgaactaaaatatggtaaaatatgacattcagacccagtttcatgtgagtccaatttttttttctatccctaactacgactcacatggatgcccgtggccgccgccaagtttgggtggtttggttggttgcatgttacctgagagacttacagccacatttttctttgagctgcctcacttgttttctacaatttttctttggaccacttgcttgctgctgctgctgctggtggggtagaatcgaagtagaaggttctgattcagccacattgccaactgcacattcgtgcattgatgcatggagatgattgacaggttggcacggagtgtgatggttttcaataaggagaagctcattttatttttatttttaactccacagagatgcatgttagcataagaaaacaaaagtttgaggtttcatagtagtagcaacatattgttcatctggaagtaattatatattattgcaaatcatttctaagtttagtggcagcaaaaatagaagacaaacaaaagaatcatcatgctggtttctttacccaaacaaacaagacacgcaagttgcatggaaaaactgcggtctgcggctagctagctgttggcctgttgcataaacttgttattcaccgctctcctttgggccgccatcgcattgctggacgaat

SEQ ID NO: 3812 - DNA, 1841 bp, Zea mays
  misc_feature (1)..(100): optimal_loci_338902_G1, chr10:87127402..87129242, Cluster 23
catataacacaccgtcatatggatagacaatttgacccctattgaataattatctaaataattatttatatatgaatacttgtaataattaatataagtattagtcaataaatatttattataaggctatcaatttttattataggtatttatacataaataattattcaataagggtgaaatcatattttccacacgaaagttaataccgttagaggtcagaagtaacgataatgtcatatagggaactaagtttatattacgtctagtgttaaatagggaagatttatagtctctttaatctatgtccatgctaataatggaccccataaaccctaaaaatagcaaaagaatcatctaagtgcttgcaccatacttttagaagggcaaaacctagcctacacatcagctggaaaaactaattcttgaggtcacttatgtaagaaaaatcaaaacaataaagaaaatgttcctttgtagcattttactgtaaaatgtatagcctaaaaacctaataccctaggctaagagaaacgacgccacaaggaaaatccataaaaagttttcattatcagcaaccaacaacaagaaataaattaaatttctttatctctctactcattaaacaataaaaatgttatggttagggtttcgtgacagattaagcaataaaacttatccctctacccactaagcaataaaattattctttatctctctacccattaagcaataaaatttatttatctctgtacctttggttagggtttcgtgatggacgggattcaacttttataggcataacacctttgcaagcggttgctttaagaggccgtgtgcaaaaaaaattattacagacaacccacgtaacgtaaacaaccacgtataaagtttttttttttttttttttgcaaacggccatctgaagcaacaacttgcaaataaatatttttttataaacagtccaactgtttgcaaaaactgttgaccagctttatacggagtgcagaggattataagctgtttaagcttttacaatcctctctgcacaccgcttaaacatgtaaagtatacatattttacatgtatatataagctgatcattttaaaaacaactgttaacttatggtcgatataagctggtcatcttaaaacatgtaaagaggattatatactttacatgtaaaatatatatttttggaagcggcgcacttaaaacagccgctagcaaaaacaggccgtagttttttagaggcagatgtccaaaggcagtcgcgttcaacaattttttttaaaaattttttgcaagtggctagatttagtggttcccgcgcgcgcggtccgaaacaatgcagccggtttcccctgtaaacgccgattgaaaaacaacatatgcaagttagttgaaatgagtgtacgacgtcgtcagagtgactgctggtgatgaagttccaaactgtgctttcatgtcacgtgatgcacggacgcgataatgcatgaagttaagttgacaagcaagtggccggggtggcaaattgtctctctgattgggaggcgctggagacttacttgtccggcaagctctaagccacagcatctctagctactagcaagctagtgtaagtgtaaaaggggtctggaattaggcaaagctaaggtggttaagaaaatcaagtgtgcatgcatggatctgtcatgcacacgtacgcaatctgtgaattgtccttctccaagatcaagtcctatcccctagccagcaattacccgatcgaggtccgtccacttgatgttgtgaaaaggtgaaggatggatcatggatatgcatgcacagatgcatgagc

SEQ ID NO: 3813 - DNA, 1419 bp, Zea mays
  misc_feature (1)..(100): optimal_loci_340413_G1, chr10:95539809..95541227, Cluster 23
tatgggaggatcaagaaaaggtttaccttgccctctacgcaaaaataccggtggtacactgtttcaatcgtatttcaggtaacatagttgagggttaaatatgtatacctagtatggagtatctatgataatagagaaagaaaaaataagccagtatggatatatatgaacatgcaaacaataaacatgggggagcggtccaaggcgtttatgttagatgaacatacctgttgcaatcgttggaagattgtagatgcattcaccgagcgtgatgggacaacatgcaaaagcagttagaaaacaggttagcaagtggattttaatccatgtaaacaaattttggtactaaatatcaacatgtgtgcatatatgagattatatatgctaccacatttggtacacaaatagatttatatatcacatcacagtaaatatattatggaggcgttctttttttaaaaaaaaaaggctaaacaatcacatgcatatttggtatgtgatgcacaaatttaattgtatatatagcagtagattgtccattctataccagcacattatctatatattaaaggtatatgtacttgtattccaaatacatatgtatacatgtgttcatatgtttaccaatgtaagctactacatcatatatatgtgaggaactttttttctcaagctcgagctttgatgtacagttctatgcttcaagattctgaatcttcccagtagatttgctcctcgctcttatatataaaaaatacaatagatcagagcgtgatgaacctttactaacggcgtgaataatttataagtcgaaacaactgaagatgctggtaagagagcagatgttgcagacaatctttcactatgagtagtttggtcattttcgtagggcatcagttgtttagttaggctagactccaaatatccagtggacatataattcataggacaacaaccgttttagtcgcaaaactcatattaagtccaaacagatgaacacataatccatagacacatggaaattctaacaaagagacaatatttcgagtggcaattctaacatttgcgctacgattgttgcattggatgctagaaatttgagtttgtatctgccataaagaattattgttgtgccaataagattttatggttagaatgtacctatgtttgtacatatatacctgaaagcacatgttgcatattatttatatgcattaaagtttaaagttacatgttgatttcactaaatggtaatagaacaacacgtgttcgtagtgtctgtttatgttgataggtataaattttatgagtttgggtggacaatgagtagcagtaatgtgtaaggtggagacctttttttagagaatagaactatttatgtgttgtgttgatgccatgggtggggcagaggttcgacgg

SEQ ID NO: 3814 - DNA, 1693 bp, Zea mays
  misc_feature (1)..(100): optimal_loci_343321_G1, chr10:112322095..112323787, Cluster 23
gccattgggaaggcactagacgtgtttggtgtagaagctcgcagtgcaccagacatgtatgctgcccccattttaagcccttcatgaggtaacgattggattttgaattggatctataaatagacccattagctagccttggctggcatcccttcacctattacacttgagaacacctcatagggatagataaatacactccattcacgtgcatctcgtagttcatcttttgggtgagattgtagagctcctagttcatagtatatagctgttgtgtctcgtggcactagttgagcggattgggctggttctactcttgttactattggtggttgtcatcttttagacaacccaaaagttaatggcattgttgagaagctattagagattgttgccggctccgatcatcattataaggagctcttgttctctttccctatgggagatttgcaaagagtaactacagtgaaatagtagagtgttggagtgcctattaatatggttcttatggggcatgattgtaggcttgatgtgtgatgccaattagtatgtgaaccacctagcgtagacttgctacaacaaggacgtatattgccgataaacaatcgaacctcgaggatatatcttgtgtcatcttttgacccatgtggtttgaactcttaacttaccattgcaaatacatctatctacttgttgtatatattctgctcaactagctttgtgtagactatactttgtatttattgatagtagccgagtagctttctttattcaatatatactaaagatcaagctaatagattttttaggggacttcctttcagtaaactaaaactagagcaagtattcacttatgcaccatgtttataccaatcaactttgctctagtgacaaatgtgttttataaaataattttatatgttattcacccaccctctagacatctaggtcctaataagtcatatcacagcccataccccattattttaatgcctaacaacctatgataaaaagatgagaattaattagtttgccaaaccacctcactttaattgaactaaatatgattactgggaaaataggatatatatatatatatagacatttaaagaccacgagccataaattttgggtgttatgaatgattcttttgtaattctagatattaagaacccaacatgaagagaataataagaagtgcaaataaatgattaagtcaatatgatctatgaagctcttgatccaaaggtctttgagtcagtcaatgatttgaaatttgctcatgatgtttggaaaagacttgaaaattcatttgagagcacattgctattaaagaagcaaagttgtttatattcaatatgcaagaagatgggtgtgctagaagtgttctataggctcaatgtttttgtaaatgcgctaaggaacttagggcacatggtggatgatgaggacttttctcattggtttttgagatgtttgcctccaagatttgatactttagtcaccatgattatgtgaggtgttttgaaggagtaaccctaacccaagtactaattgatgtggtcaatatgggaagagatgggaaagataaagaagatgataagaaaaaggaagaatgtgtcattcaaatccatcacctgatctaagggcaagagaaagaataaggaaggattgagtgaagatgactgctcaa

SEQ ID NO: 3815 - DNA, 1905 bp, Zea mays
  misc_feature (1)..(100): optimal_loci_344664_G1, chr10:119144946..119146850, Cluster 23
agtaggccactagcatggaaataggataggctagtgtcatcccatgtcatggggccaataatggggccctaggctaagaagacgtatgtgtaggaggtggtccatcccagtaaggtggctccatcagataggacctcacagtccctagatgctatcttggtgagatcctagggtgttattgagcagatgcactccatgaccacaaccaagtaaaggttgctcgagaataagaggaatatccttgagcatatggggactagctagaagtaggcgtttaggaatcctgagtgacaataacagtggactccctcgcaaggagggaggtggaagaggtagtgaggaagacaaaagaggaggcactggctactagttcccttgcctccaaatcctaggagcaggccaagaaattgaagaaggtggcccttcaacacgagaaatttaatgatggattcatcgtagtttatgcgaaaaacaattctgaagcacagtttagccgcataagcttaaattgtaatggatgcaaatgcatcacaaaagctaaagttggatacattgtgagaatatagtgtactgaggcatgttaaaactcagtttttcttaagaaaacttaggagtctaattctttgacctgcaaacaagacattctagtttagtgaaatctgttgaaacagaaatgataagtgcaacgattcacatagaattaaggtcactagaaaaatgccctatcgggccctctaccatacatgtgtaaaaaataatataagtgcaatggctggtaaacacagtgcaacaatatctagatatgtttagatatgtagaggggagattggcgtagccctgatctgtgcacttgcaaggatttgcacagacaggtaaaacaagttggatctggtgagtatatttagtattcatctagatatgaagcagcttgagtaagatatgaagccaccatgcacacatgccctattatatacttgcctcataaagaatttagtatttagatagtttaaaatgtatttcatctagaaagcaggcctcatatataaaatttgtgtgggtctattttctatataatgaacaacatcattttttagtattcataaggttgtatatttgtttgtaaaggaaaataatacgacaatgtagtactaatccaaagccaaaaaatgatattgtacctatagaatctcaatacatttctttggtagtgtagctatgcttatatattgtttgcatagtaacttggttacttgcttgcagatagcaattaactacggttttgccaccataacagcacttgaagactcccggatccatttgtgtgcatcagtgcatgatgcattgttatgcaaaacaagaaagaaaaaactcagtgctcaagctacagataaccacaacagcttagcaactaaaaagaatgacaatacataacctaaagataggtggatatacatatacataacatgctttcttcctacataggcaaaagattgttcatctcctacgatccagttcagaatagatggtctgttgttaggcatgattacagatgaacatgttgtgtcatggaagcaattattcacaaagattgaaaatgtaatacaagacttgagatgaagatactctagtcaagccatgaaggaagacaccaacatttatatagttgagagattacttttggaggtgtcgaggaagcttacacaagcagaaaagaaagttgaggtaatcgtcctgcatcgattttattattctatctattaactgatttttatgcaaaagtttttagattattttttggtatgttaacatatcctctgtatacaaggtttctctgagggagtttaaccaaattaccatacctagagggggtttacatgagaacaggagggagaggggggttaccta

SEQ ID NO: 3816 - DNA, 1631 bp, Zea mays
  misc_feature (1)..(100): optimal_loci_345674_G1, chr10:125093604..125095234, Cluster 23
ttccatgagcactcccaacacagatacagataaaatagtgttcgttagacaactaaacatgttgttcttagagtttacatgtaatctctccctcccaggcatgcataaataggcccacccaggtgtttggtgtaggtaccgagatccttatgttccctggatcttgatccaacatcttgggcatgttcaattaagatcagcaatgcaacactctcataaatactccctctgtttcaattttaaaagttaatctgcatctagacatgatgggtttggtactgcattctacaaggcctaatgataaatcaataaaggggaggtgatgacaatgatcaatgatttttatgtagaatacatggttatagctagattgaaaataatgctagacaatttggaaatacagattcataatgaatgttagttttgttttaagatttttgccaagttggtgaggtactgactatctggcctagcaaactaataactaatcagcaagagtcacattgcattaatacataaaccatatgtaattgatatcatacatgagctcggacaaaataagttaaaaaaggtaagattgcttttgaaaaggcttatgataatatattaattatgtcttagtgaaaaacaaaatggtgaagaaaggttccataaaaagacttatcaacactaccaagattatcatcaaaggagcgacaatatgtgtgaacattaatagagaaattgaacttatttgcaacttgcaggcactaacacaaagggaccatttatatccttttcttgtcaatctggctgcggatgctttggaagagggtgttaaggggattgtgtcacatctgttctagggagtcatcacatgtaagcaatatgatgatgatgatactattcttctaatggaagcataggatatgaattatcacaacaacaagcataagagagtgatggtcattcatgtactatgacaaatttagatgaaccataatcattacgtgctagagtatttggtcattgagaaacaatttcaccttaagcgggatgcaaccaactacaccctaatgcaaagatatttttaaagacacttttgcgattgttatccattttccattgtgctaaaaaggcctaccttcctctcatacaaacatggctactaaattatgtatttttccttgtttcttgatctgttgcactgaggctttgctttctttatttttcctaatatgtatattaattaaggctgcgtttggtttgcttgagatttttggaatctcattttgcacagaatccaatgtactattccagaattcagttgaagttagattctatagattttagatacaaacacactaccctatgcataatatctaatgtgtttgactcattatgagatcttttttatctggattctaaaaatcccatgggaaccaaacgcagcctaattagtatgtaggtgaaccactcctattgcctataaaaaacattacctgagtcaatccttgacctcatgatttatcatctgggatttgaacactgatgatgcttgctgttttctagagataggaacaaacacaaacatacatggtgcaattctgtttattatctgaaaaacgaagtattataaatcttctgaatga

SEQ ID NO: 3817 - DNA, 1570 bp, Zea mays
  misc_feature (1)..(100): optimal_loci_347106_G1, chr10:133491965..133493534, Cluster 23
tcgacaacaactcaaattattttacaataatttaaatgatttttaaaataaaaattattttgacaacaatttagattattttgtctcgtgacatcaaattaaatagtttatcaaaataaattttaaattttgaaaacaattaaattattgtaaaataatttgagttgttgtccaaaataatttaaattattgcggaaataatttgaattgtcataaaaacacgtaaagtctaaaaatagggcaaaactcgattacactccaaaataagggcaatagcgcaatggttccctgtcttttctaatgaagacttaacaccattttgttttgaaaaacagggctaaacatgcaaaatctaaaaaaacagaaataaatctgtagttacactctaaaatagggatactggcgtaattgtcccaaacacaagactctacgcacggtgtgactactattttaaacttacatagaaactaggcgcaacatattagccttgacactcatagagttgtcccccaaaaaaataccatgattagctgatcgagcctccatgcgattaatgaatccgagcttggggcaacatggattattaaaggagaatcggtaatgaggtcacccatgacctcaattgtaaggtattttggtgaggcagttgcatttgattatacccaaaatataagctaaccatggggggaccatggtattgtctagaaccgtatgcgtactttatcagtaaactggccaggatctagcagagttcatatatgctgggcgaatgaactgcgtgatctgtggacacttgtagtgccgttctgtttgttgtcctaggggaaaaaaagatctgcaatctgtgctctgctgtttttttctccttgaacgtagtagcacccactacaccgcaagaattttcaagcactgattgcgatttagaaatccgcaatttgtcctttttgtttaggggataattgtactgcctctgaacctgtactgaaagctggcatgcagacatatttatatccattattactctgcgaccaaccttttaaaaaaaacaggtccgtttcaaatgtacgctaatactgaatctagcaataagaaaattgttgaactggatgttaagtacccccgacagaaaaatatggcagtgtcaacagttcagcacgcatgatacgacagccgatccctgaattatgatgccaacctctctgcctctctggctcttgaggttttgatgatagaaaggagaggtgcagactacagttcgtagttgctggtagacagatgataaaaggcaatggttccgcgacaaggaaggtgcaggaaaagtgcactcgggaatggaggcagcatcaagcaagttgtagggtagtgtccttattgtgacttgtgatgcgtctgagctgagccttcccatgcggccatgtctgcactctgacccttgccgcctgcccattcgcgcccatcagcaacccacgaatggcggaatggccaatcattggacagcagcggtttcggtattcgtttcccaaaaggtcagataatgtggagagagcgtggtataatgttcagagacacc

SEQ ID NO: 3818 - DNA, 1832 bp, Zea mays
  misc_feature (1)..(100): optimal_loci_348227_G1, chr10:139044150..139045981, Cluster 23
gaacagaggagaagagtctatatactagtataaataagtgattttcatagaagaggatttaaatgatatcattgaagcacatgcatgggcagattttaaggggggctgggggtgcttcaaccccccccccccccccctatagatgtcccagcagtacaacatagggacaggtgatgctcatcttacgtggctacgactggcgcacagccattggcatgggcatggcaacaagttcctagaatctgagctcagcgagcattcatgaaactgatctaatccgatctttacagaagataccgagattactagtataaccatccaatgctctatacacagagattacgtaaggtcatctcacatgtgtacgtttttcaggtctaatctgatcttcacagaatatatagagattacacaagagaatggagaaggaagacgaaagaaagagagggagatgagcctccttgccagcttgtgttgtctgcgccattggtcacgagaaaatcattctctactttagcctattattggatccgccactagattgaaagctatataagtatagagaatataatattttctatatttaacatgaaaaaaacaaataaagtcttttgttcagacaatcttagacggtgtgggtgtaaaggtatgaacaacccacataaatgtcacatatcttaagagtatataaggggataagtgcaaaagaacacaagagacgtattttgatgaaataacgtctcaacggttttctaagtctaagatacggtttaacccatatagcccacataaatgagtcgtgacttagggcatgttcaacccacataaataacttgtatcttaaggggtatcacggggataagtgcaaaaaaacacaggagacatatcttggtgaagaaacgtctctagcacggttttctaagtctgaatacgattccatccatacaacccacataaatgagtcatatctagataggttctagcgaataagatacaaggcacgcttagttacatttggttgcatgaaaaagtttcttagattgacatgctcttaaggagttctagtaaataagatacaagacttagatacgggttttatgaatgagtttttttgtacatgtagctagtgcttggagaaccgcaacacagtatttaggttgtaagtgcactcagagaagagacaaagtcgaggagacgtgggttcgaaagaaagaaagaaaaaaaaaagtagtagtgtaagatttttgacggaagggagaggggattggtgtggaaaaagaagacggttgagggatgacgagtttttttaacgtgggtctcacctatagatttaggcatggttctatacattataacctatttaacatacagaagtcacgttattttattggaactaagatcggttccataaattagagaagatgcccttaattattatggccaggaggaccaaagcagcaagctgcagtgctcgcccacacggtagtagtagcggtagcagtagcactgtccctaccgtgcaccgcctgtactacgtcagggcctctttttaggtgtcatgtagcaaaaaagaccagacagtgtggcctttgttgatagctataggtttctttcgccagctcgatcgtcttccctgatgaaagttttttcttcataactgcttgttcctacctccgaagtgtaggaccaagaagtgctttttaaaccgtttttcaatggatagttttatcacgttgttttcaaagctatcatgcgaacatttatctaggaaactctcatgaaactcccgtcaagaatggtctaacaagcaacatgaggcctttcttgatcac

SEQ ID NO: 3819 - DNA, 1481 bp, Zea mays
  misc_feature (1)..(100): optimal_loci_41211_G1, chr1:244302501..244303981, Cluster 23
atagttctatggatggtgaaccaccaggaggcttgccattctcaatgtagactctaggcttcaaaagatttcttggatatataatagaagcatatatgaaactagggaatgatcctaaggacacttatgtcactgatggccatatctgtaatgctaaacacgtgacaagttgtattataccaatatttccaatgactattgatataacttacatatatagaaagctgccactagagtagcatcaagcgttgtcgaggtttatattgttggacaccatggcatagattcttcaaatgtagagttgttgtgtagttaatcatgcacagattgtctagtgagtggtctacactttgtatttattgtaccaaatttattattaccttacatggtttgtttctattacatacataatatggtcaagaaatagtgaatcaatttagagaggattgcaattggcgagcggtactagttgatcattttgtggtgcatgctagtgaagttggaaagagccacaaaaggtatgatactatatttctcaaattctataatgcaaatacacaaattgatgttctaaattgtttgtgttgtaggtactccatgtttaatggagtggttgactctaggtatagggctttgggttacagtttagggtttagatcagagcttagaaggtagcgtcctcgtcacaaagatctagagatagtagccatcgatggaatgcacaagaggagttgcttctgatttaagaagtaatgagtctacgtgatgaaaaacatgtaattctaagagtatgatcgtcgacatcaagacttgaagtgacatcatgacagtgggtgctagatgtttgggagagaataaaccaaatacaaaatagagaaataaattgtattggattaaagttttcatgtttttgaatatatagtacgatgttggatatttataggtgatccatcttcgtaattatggaaaaagatttaactacacttgaactataaagttacaattgcttgtttgctttaggataaattggtcaatttctattttcactagtcatcatgtcatcaatgatgttcagtctttgtaaacatgtttaacttctagcaaagattatttgtaatctttgtttggttgcacaatgatgtaactcattcttataaggcttcattggacatctatctgtatgtcaagccttcataaagatgaagtttcgcataccttagggtttagtagatgaagctttgtgtatcttgccttcgctagcgagacgttctagcaaaaggtggagcctttgtgtttatgtgcattgattccttctttcttatcacttttattgttttgtataacatgaatttgattatgtaagctaatgccaacaacaaatggtcattatttagctcctaattattgagaggtgcatttgcttgtgctgaaatccctagtagctatagttgaaacctagctaaaagcacaagccaaatttc

SEQ ID NO: 3820 - DNA, 2593 bp, Zea mays
  misc_feature (1)..(100): optimal_loci_444_G1, chr1:2300275..2302867, Cluster 23
tctcgtcgagcccgttctgtagtgtcatttaagtcactcaacattctaatctttctcattttacaccaactcattccaattatattttaaggcatctagtaacattcaagtatttattaatcacgtataatctaatttaagatactttgatgattatttaaaacattctgttttctcaatcatttagttatgcggtacaagttttgatgtcatctattttgtagtgtcatttaagtcactcaaattctcatctttctcgttttacattaagtcgttccaattatatttcaagactttaagtaacattcaagtatttttctaattacttgtaatctgagatttaagacactttgatgattatttaagacattcactttcttctctcaattatttactcattcaatcattcattacttattttgtttaatttaagtcattttgttaccgtttcaatcattccatatcattcaatcattttgtgacttatttaatatatttcatattatcaggagttactacaagaccgtcttacaaatattttaattcattcaatagtttatcacctagagactcataatataatttaagtcatccagcatatagattgacataattattttatcacgattggacctgtttaatagatgaggtgcgtccagttgaagcatggggcacgcacggtggattgtagagttaacgaacattggacgctcgcactggctcactgcaactaggagaggtagtagttatgaacagcacgaggaaccacaatatagactcaatctattttaactcatctaaatatatgttcacaactaatttttttagtttatctatattttatttatccatctaaactgaagctaaatcaatctcctaatgaccaactaatggctaactctgaacttctcagatgaaattgaaatccagattttatttaaatataccttgctttagccactttgcttgcatctggcacaaccttgcaataatccttcctcttcttgcgcctatcataatttagtccccacatcacaatcacttttactaatgttattactttgtaatatatctatagttctgtacgcagggaagttgtgttgccggatgtagaaggccattatattgcactgtgcaaaacaaggttgcatgcatcatccttaaaatttgaatagtttcaaagtgatatgaaaaaaaatgaggtggtgatgagctgattattgcacggtgcaaattcaaagatgtatcactgatgggcactaatgaggaaaatcaaagttgttgctttgcttttaaggtggtgatgaaagataactactttttcttttgaggtggtgatcaactgagtatttagtacttggacaatgtaaattcaaagatataacactgataggcactaatgaggaaatcaaagctgctttgtttctccacatgagcattgtgaaccagattattgcacgtactcttcgttcattccgatgattactgcctcatcaggtgtcctttggtctatttttcacatttgctgcttttgttatatattttctagatgttgagtggtcgtcgtttccttctctttgctgctttgctaacatccttgagattgttcatgtttctttcagtcaccatgatttagcactgggtcattgttctaacagttatatatgcccatagctagctggattcattgtatatatatcaagataagctgtagaaaacagtgatttttagtactttcacatctatatgattaagaaccgtgaataattaagttgcttgctttctttctttcaggtgacaaattgatagaacctgatgaacaagcatcttgtcgtcaactccgaacattttacttcttgttttctatgcgcagttccagtgttttcttgtctccaagctagtaaaaatatgttctgttttctacttgctactagtataacttctctgcagatttgaacactttcaaactgttttgttcctctcttttcctctaccatattgagctaaaaaggagttgatctccagcaataatacatcaataacgaagttattgaaagccacactttcatgcacgtacgtcgatgatgggtgaaatttggacaaatcactggttcattcatatataggtggcttaaatctattatttatgaaactatatgcaatcatattatttatgaaactatgaaattgttcaacaatcaagatatataataagcgctactgcgcgctggtgatcatctcccttgaaattcctgaagaaagaaaggagggctatatatgttggatccattgacctttgaatttgaagtgacacaacaacacagctaggtaactgcatccaataacaataaaatatagtattgtgacatcacaaatattcaaaccctctgtatgaatagctctcagttgaagaggagatcgatgttcagatatcttacttggctgattggatattacagtaattaatatagtgttgtttcttcgaggcggaggccgtcgacgtgtgcgtcggcgggcagatctgtgcggggggggggggggggggggggggggcggcgcacggcggcatggcgactcagcgtagccggagctc

SEQ ID NO: 3821 - DNA, 3478 bp, Zea mays
  misc_feature (1)..(100): optimal_loci_44702_G1, chr1:262445574..262449051, Cluster 23
tcaataatttttttctctgccattctttaatttaatagagaattttatgaaactaatttgaatagtaaatattgatgtttcttttacgatattgatgaaagttagataaatagatttagaagaaaaataaaagaaactatagtatgtaacgagaggcgtactgataaatcaatgagaaagcctaaatggcacgattctttcaaacactaagaacatcatcaatatttctaaaaaataattgataaatcaattaatcttctaaatagataaaaaagttgggtgcacatttgttgggttcctctaatttttaaaatctcggtactaaaaatatatgagacaattttatatcagaaatcatggacttcctaaattatgctgaccatttttgtattttgttcctcgcctatatatttgcaccatgaaccatattctactctttattcttctctacgtccttccacatttaaattggtcgatagatacacacgtgaatatatccttaccaagtgcagaaacattgggagttgagatagagttattgaagagtagattttttcagttttgtcaaaaagtgtagattagaagttggttttagaaagtcttggagatgctctaacaaatcaatcaaacttgaaaagtagcatcacacacataggaaagaaaaaaatgttgacacaaataaaattttggaaaaacacacacactatgaccaagtatatagaaaacaagcctccctaattgttactcctccattctaacacgtgagaattttatgttttgctgtaagttaagcttatataactttgatggaattggaggtaaatacaccaatacctaaaacatcgaactagttttatgaagcccaaatttaaatatcttttcatggtacacttatttgatattctaacctcttagttctaacattcaaaatttgtccataaacgggagcatttctggtatatccaacctctcctccattaagattaatttagcatcattagttcttaccatttagttaataattagtgcatgtcattttaatctttatgcttaaaatgttagttagctcctgctacaacaggtgttaattgcatacaataacttggtgattaattgtggagcatcacaatcattttctttctccttaatgtgtcttactcttaaaattattaacatctactatatcgctacataaatataagtatttttaatggttttcttcaaatatgccacttaaattttataaaaatagataactagtttatttggatgccactttatagtatccaaatgaattagctatctaattttgtaaaatttgagtggcattggaataaacaccttacgtttataaggaagtaagcccaccaccactgcttggcttggcgatctgtgtaaagtagtactccagctttcatacttcactgacaagtttagtagttgttctcatttaaacaattttattacacgcaccacccttgccagttaccatcaattccaaatacattgtggcatacctctcccttttctgtttaaaacttgatgatgccatcttccttatttaaacgtcaaccaacaatttgagaaacaggaagagcaaatagaggacaaaacgcaagaaacgtcagttcatgttcatctgtattttcaggtcagctgcctgccaccctacaaagccttcccattttcatcttctccgttttcatgctttatgagaatgcgaagcaccgggaaaaggacacgctcttcagcagaatgacaaggttagtactaaatattttgattctgctacctatagttttcttaaagaaaataggctggagttgttttcatcattatctaaaaaagcatcctaagtgaagcgagataaggcagaaccgtgtctcatgctgacagtatcattgttgtctatctactaaatattctttttttctaccaatctagccaagcgggatggaatttgccgtaaacatatcttgtgaagcaccacgaggtccacgacatgaatttgaactgagccaaacatctaattcctggacttagtcacgggcttacgacgcatcagagatggacatgcttgcaaaaaagatttagtcaaagtcgtgttcgacatatccactcggtcagtggcagcagcaacacccacaactttactgccatgttttgttagattttaattaagtttgatttattttaaattttattaaaataatttaaatcacaatgccaataatactaagtgcagcatgatttattcttgtatacaaaataatgataggggattgactcaaatataagcggatgaatattttgtgagttagatctaaagcttaacaatcggtacaaagcgttcttcctaagttgtgttgtgctcaatcgtgcctaaacctaatttggtgcaaaattagaacatggatagttatgctcattgatcacattgcatgaattttccaaatagctaaaagaagtcaggagcatatttgttgggttcttcacacagtttccaaaatttgggttctaaaatataagggacaattttatatcagaaaccatcaattttctaatttatcctgcacattttttttattttctttgttacttgtatatttgcaccaggaatcatgttctactctttattcttctctacgtccttccacctttaaattggtcgatagatacacacgcgtatgtaccaagtgcaaaaaaagggttgagatagagttattgaagtgtaggatttttttttaattttgccaaaaagtctaaattagaagtgggttttagaaagacttagagatgctctaacaaatcaactaaccttgaaaagtagcatcacacacacataggaaaacaaaaaatgctgacacaaataaaattttggaaaaacacacacacactatgaccaagtatatagaaaacaaacctcccagattgttactcccccattctaacatgtgaggattttatgtttcgttgtaagttaatcttatataactttaatgaaattggaggacatcgaattaagtttatgaagcctaaattaaaatatgttttcatggtacacttatttggtattctatcctctcaatcataacattcaaaatatgtccacaaatgaagcatttcttgcataatctaacctctccttcattatgattaatttggtataattagtgcttgccatttagttattagtgctatgtcaatgtaatcttgatgcttaaaatgtcagcatgtgttaattgcatttacaataacttggtgattaattgtggagcatcacgatcattttctttttccttaatctgccctgcttgtaaaaatacttagatttatgtagagatggagtagatgttaatatttttggaagagtaaaaaaagattgacttgaaataaacacattacgtttagtagctgttctcattcattaaacaatattattacacgtaccacccttgcccattaccatcaattcaat

SEQ ID NO: 3822 - DNA, 2257 bp, Zea mays
  misc_feature (1)..(100): optimal_loci_45689_G1, chr1:267773440..267775696, Cluster 23
cccaatgacatgtctatcttggtttccttggaaatggatttttgtcatgtctatcttcagtattttgtttgtgttacactatatgacctgttcatagattattgttcctgttttctaaacttggtcttatgactaatagtttttaatgagtggttctaactggactgcttccaaatgtagtcattggctaagccaaaatttgtatttcataaagtaactaagatcagtgtttgtctggatcgtgacaaggctgtagcttttcccataatcgatcagaccatatcctaggattaaggatgtgcaacagaacccttttgttgtcgacgatatcaatgagcttcagtttttttcacatccataactatataccaagccttttgccacatttgcaagccacaccatcgctatgaacagaaaaactattatgttagatgtagatccatcttctatccacatatcataaccataacgggtccttcaaaatttagatgtgaccttaatgctttgatatttgattggtaagggtctacaggatcttatgaccatattacgtcacaatgcaatcagatacttaccctgatactttgtatttatgtttggaggtagcattgatattgtcaactgtagttgtgtcatctgtgcccccttattcttaagactcactatatttggagaggtatccaggagatcatggatgaagaaatggatgaagatgtcatagtcaaggttgtggactgctcgaaccaatcagaggtgataaatcagtgctagttattgctttatatttctgaacaagacgtttctgtctgttagaaattgttgcgacatttgcttagggattcccatgtgccatgttactagttacactgctattgctggtgatgttctaactcctatcggttgtacaatttaattctatgttcccttttctccttactaaatgcttcaagcatcactaattcttggtgtacaaatttgtgaactgatgagacagttcttcggtgtagtttggttaagacttagtaaaaatatagtaggtcaggagctttcatgtttacagcaacatcaacctgttcttgtgccatttctacatgaattagtgattactgctaaccagttagaaagtactaggacctaaaatctggtcatcgattttggctcatttgctctttttattaataattgggaacaatggaggtacaactaggtcataatatgtttattttcttctgatgaactaatagtttgacttgttctctctattggatgttatatatatatatatatattttgttaatgcatttagaaatttgaactgattcctaaaaaatcctttggtagtagatgtttatgtgtttagtgctgttactacttaattttgaaatggcgcaggtttgcgcgacatggcttttcatagcgctcaattggatctatcccctgagcataggagaaaagtatcaatttgtacagtggatccaagtattctacaaagcatgcatcctccaatttcccacaagcgagaatggcatgatctgatggatgaaatggttgttgtagcaataaaataatatcggtcaattgtctttcaaggaacaattgtctttcaagaaccacactttgttgaatacttcagatcggtaggtttcaactgtatctagaattcttacaaacataacactgatggggttttgctatttgtttggaagttcttctaaggtcttgactaaatattgatgattttgatcattaaacttagaaatgattaactaccattgcatcactaacttagtgccttctttttccatctttcagatttggtactatcttgttatgattgatgtattcatctttgcatcacaattttcttgttttctcactctttactaagctaccgtattctttggtatctcaggttcattcttttagcttacaagaggttatcagatatgcatatttgtaatgaactcttttccccgcaatatttggatttattcagtccattaacatggtgtgtacacaacatttcataggtttactataaacaggatctagttgactaatttcccttttcctcttttccccacaaataacacttactgcctatattgccttgtacttagccttgaaaatagttatattatattttacttgcatttatgtttatctttttttatctgtttggacagatctctattaaatgtcatgtcatgtgctacaatcgttaggactattaatagatgttgctctgtctatctat

SEQ ID NO: 3823 - DNA, 1674 bp, Zea mays
  misc_feature (1)..(100): optimal_loci_47608_G1, chr1:278880182..278881855, Cluster 23
tacctagctctagtagctccttattttatccacaaaatagactgctttcacactatttgtgtgtacgtatcactcggattaacccttctttcccttacgttcctttgaaatttagagtttattgtttcacaaaggggaaacacgtcgcatcagaaagaagcatggcgcaacaaaaacctgttagctactctcgatctctctctcattgcttgcacgtacgagctcggaatggaggcacaggcacaagcagccatggtgatatgtatccagcgccaggagagggaggatggagcgaagagttccatccacgcgggaaaaaaaaacaaggatagggagtcagcagctcggatatatgcggcacgaagctctggttctgggagcactcaataagttaggagcacatattaggagctattggacatgattttttctgctattcttcaaaaataagatattgaaaacactgtttgggagagattgtttgggagagaggagatatataagaagttacgacagcctagaacaacttgtgacactagtatagatgatcatataacttcgcagaaaatcatctctcattttattccttatgcgtgttttgataagttttatagctaaagaggctctctcagtggttgcagttgagagtagaagggtgaccactaattaatcttaataacctgtcaatcatcggatatatggaacttttatacagattagcaagacttctcatcaaatcaacaaatgatgataatgtatttatctctagatgattatatacatgaaattgaaaaaaaaatcagtaggataacattttttactaaggtgtataactttgagatatcaaatgtgtcacttcttggatctaaagaagtagagagcgacaaaagaattgtcgcttgagagttgaagtgatcttccaactcagttagttgttggttaattgccatattaaacgcaactatttcataatggtgaatagttataatattatcatgcttgttcatgtacttagtaatatcatacacttaacatggaataagaactctagttatttataaattgtcctaatccatgagttcattttttagctaattgatttgttgaactaaaattgtggcacagtgacaatatcgatataataaagaagacatattgacgaatggcgggttgatgagatcaacttttgtaaaacgactctaccatctatgagacaactaatgaattttggagagaatccaaaaattcaactagcttatagaatccatgaaaatttatcagcttgtgcaggtacacgacaaaattcatcgcgcacatagcaactatcaagtgacaactttggctgaaattcatcggttttgttattagcgatgaattatatgccttaaaaatatgtcaaattttaattggatggacaaatttatttttaccaacaaaaaacttcataaaccatgatatattagttaattacacgtgcattgctacgatttctatatatcatataggtaggtattgcttaaacaagatagttattcaaacatgatccaaactcatagattctcagatcgtgcgaaactgagttaatcggggatcatgacagggtcagcacaagcaccgataatcagtgtgtctcgggattgagccaaaccaatgccgagctaaggcgtgtgacag

SEQ ID NO: 3824 - DNA, 1609 bp, Zea mays
  misc_feature (1)..(100): optimal_loci_49498_G1, chr1:287057810..287059418, Cluster 23
tctatatttgattctacatgttcaccacgatgggcggatatatatccaatctcccaaagatttcaacaccgacgatagcaggtacatccatctaaaccctatcctctgtttactatttatctatttatttatccccacattttcttattacccttgctgcattgtcataaataatgtatgttaatcacatctacttatctactacctacgtcacatgattacaaacgaattatacacattaaaaattagattctactaaatgtacattgtcgcctacatacaaattcaatatgcaaagcaacgataattttggctaagaatgtcaccattgtggtcaggaaggtacatgtgtacacatcactgattttgttgcaactttgctattaataaaatacataaaaacgatgttttaaacctcatgtgttggctctgtcaataagtagtggagatagtggatactaaaaactacactttttcactggaaagtgggaggcatcgcaagtgtttatgttttatgctcatacgatctctgcgtatgttctgtgactcagcattccaaatttacatataaaaccatcttcgcagaccagaggatgatataaaacattggtccaagataccatcatttatgtctcttctgttaattgattacctaacttggtgttgttcgccatcttgaatgtattgatgatttgtttttattccctttctttagagtcagatggagacagatggtggtgaatctctggactttagcaactatccttatatatttatggtatgggattagttttcatgttcatttgttcatgtataagtgttttatttaccatttctctaatgctccatgtagagatggaaaaacaatattttgacaatgttgttcactgtgggttaaccatcgttggtttctacgacgtctattatggaaaaagcaatatttagtcaatgttggagttcactgtgggttaaccatcgctgctttctaccatgtctactttcatgtagcgacggctccaatagtgaattttattatgatatatatagtaggtaatgaatatttttctgtgatttgtttgttgcgaatagtaatggtattgagtcgaattcattaatggagaaggtgggctggtatcaacacttcctttttctctttatgtgcagttcatttcagaaactgcgaataatactggtatcgaatcgaatgcattaatggagaaggtaagctggtgtaaacacttatttttctcttaatgtgcagttcattttagaagttcggattgaagtgtaccaatgttaaaaattcgggctcactttctgttagcatatagtgtgtccctaatgttgttgtatcaaaagaaatgaatggtttgtttatgtaaccgtttgtttttagctagactaagcaaattgccactttgcaccttatcttaaaccctatttttgggaaaacggtaaaaatgtatccaacagctccctacttaggccccctttggcagggctgtctcggtggctctttttctggctcttcgtgaagctgtaccaaacggtcttaaaaacggctcctcaccgagagccatcaaagagccagagccattttactattggg

SEQ ID NO: 3825 - DNA, 3185 bp, Zea mays
  misc_feature (1)..(100): optimal_loci_51640_G1, chr1:300219793..300222977, Cluster 23
atcccctcttgcttgctttcgttcttacagacagcatatctaggaatcatacctatacattggcgacaatatcatagttaaacagaagactcgccaatccgcaaaactagctttgtttatagatttttttacctctcaaactatgaatctgaataagcagtctgtagcatgcaaatgaactaaccagcaaaaccagtgccttattgaagctaccaagaaaatcaggctattagaagtactattgtactatactgctatcagtaccactctcatactgtttgtctaaactgtagcaggccaacatttctatttagttgtgttgtaatacttaattaaatacaaatgattttgtaaaaggggtgcaaggtgtgtcttgggatcattttactctctaagttattcttcttaatccaaaggaaaaaaactttagagaattgcttacacactatactgcacaatgcaaacttttgtaagaaatatgttacctgcaccttaatgttgacctgcaagcaattctctaaagttttttgtagaatttttttacctctaaaactatgaatctgaataagcaatctgtagagtgaggaaatggtcttgctagctgttcataccaaatatacggtttaagtagaattgcttgcatgtaacatactgctatactactatcagtaccttactgctatcagtaccactctcatagtgtccacttgggctcactttatttgcttgcacattgtatacgcttagtctttctttactgtctgtctaaactatagcaggccaacatttctgtttagttgtgttgtaatacttaatcaaagagaaatgattttgtaaaaggggtgcaaggtgtgtcttgggatcattgtactctctaagttattcttcttaatccaaaggaaaaaactttagagaattgcttacacactattctgcgcaatgcaaacttttgtaagaaattctctaaagttgacctgcaagcaattctctaaagttttttatagaatttctttacctctgaaactatgaatctaaataagcagtctgtagagtgaggaaatggtcttgctagttgttcataccaaattcaaatatacggtttaagtcgacacaatagtgaggaaatggtctgctttaagtagtcccaacacgagagcaagaagctctaaggctttgctagttgtttgtgcatgggagatttacttcaataagcattcaatatcgtcgatggtatatgactgtttgtcactgttgtgactacttaaagcagtttgtcatcatattgaatgctgacagacctggagaggcaatgagcaatttgttaaaactataattttcccatgtgaaattgatatacaaactaatgttcagtcaaataaaaagttaagttcgtttcccttgacaaactaatggcatagcctcgcttactgctttattatgcctgactgtatcctagaatgcaatcaaactgatccttagaaattgaagatgtacttttaacagttgagaatgatccttagaaatttctaacaatagatcattaaaatttataacatacagaatgataatgatctgttgttacttataacatacattaaaagcctcgcttactacctataacaatagatcattatcattctgaactattaaaagtacatcttcaatttctaaggatcagtttgattgcattctaggatatagtcaggcataataaagcagtaagcgaggttgtgccattagtttgtcaagggaaatgaacttaactttttatttgactaaacattagtttgtatatcaatttcacatgggaaaaatacagttttaacaaattgctcattacctctccaggtctgtcagcattcaatatgatgacaaactgctttaagtagtcacaaaagtgacaaacagtcatataccatcgacgatattgaatgcttattgaagtaaatctcccatgcacaaacagctagcaaagccttagagcttcttgctctcgtgttgggactacttaaagcagaccatttcctcactgttgtttctacttaaaccgtatatttgaatttgatatgaacagctagcaagactatttccacactctacagcctgcttattcagattcatagttttagaggtaaaaaaaattctataaaaactttagagaattgcttgcaggtcaactttagagaatttcttacaaaagtttgcattgcgcaaaataatgtgtaatcaattctctaaagttttttcctttggattaagaagaataacttagagagtacaatgatcccaagacacaccttgcaccccttttacaaaatcatttgtctttgattaagtattacaacacaactaaacagaaatgctagcctgctacagtttagacagacagtaaagaaagactaagcgtatacaatgtgcaagcaaataaagtgagcccaagtggacactatgagagtggtactgatagcagtaaggtactgatagcagtatagcagtatgttacctacaagcaattctacttaaactgtatatttggtatgaacaactagcaagatcatttcctcactctacagactgcttattcagattcatagtttcagaggtaaaaaaaattctataaaaaactttagagaattgcttgcatgtcaacattaaggtgcaggtaacatatttcttacaaaagtttgcattgtgcagtatagtgtgtaagcaattctctaaatttttttcctttggattaagaagaataacttagagagtaaaatgatcccaagacacaccttgcaccccttttacaaaatcatttgtctttgattaagtattacaacacaactaaacagaaatgctggcctgctacagtttagacagacaatatgagagtggtactgatagcagtatagtacaataatacttctaatagcctgattttcttggtagattcaataaggcactggttttgctggttagttcatttgcatgctatagactgcttattcagattcatagtttgagaggtaaaaaaattctataaacaaagcaagttttgcggattggcgagtcttctatttaactatgatattgtccccaatgtacaggtatgattcctagatatgttgtctgtaagaacgaaagcaagcaagaggggatgcaaaggttgagtaaggctaaccaaggtgcgtgtagtt

SEQ ID NO: 3826 - DNA, 1670 bp, Zea mays
  misc_feature (1)..(100): optimal_loci_54149_G1, chr2:12807733..12809402, Cluster 23
aactttaagatacatatttgtatgtgccttttattcacactgttctattatataccgtattctgccattcataatttatccaaaaatataaaatatttggaaaacataaggatgttttaactaaataaaatactcgttcaaaaattgccatttttggtataagactatctccagtaaataaggtaaaataggggggacgcggaactatagatgacacactgtttgtatagtgtaggttaaaatagttgatgagatagaagatgtgatagatgatctgctgaagatagtttaagagagcttagactccacctttaataatcaatagaatcggatttcagtagattttagaaagttaagtgatgggtacatgcgtccgcgttcctattatctaaaatagctaaaatatgctatatatattttaggacaaatagagtattaacttgtcgttttggtgactatcggtgtctgttacctgatggcaaatgccttcctttttgcgagaatggtaaacggttaacaggcttatgttctccccagaaagtacgatgactactgagcatcttggaacatagtgcagctcatctacattcttattatgacatcaataaattaaataaacgtgtgagatgttcgagagttacagaaagttgcttaaaaataacagtggttatcttttttaaaataatatatgtgtgtgcatgtgtggattttactagctagctgtctagcttctcgtagcttacgtactggtcaaaccatattcaacacctgcgccttctaatcttttacctcagccggaatctatttcatgcgtaggcatcagatgcgttgtttcgtagactaattaagaaactgtaagaacttattgtctgatcagtttgacttagcaccatggagttgagtcaagacaaagagtcttgtcatcacttaaccacactccaagtatggagtattttttgatgtgtgtgcacccctgtttcttttctactgacaactgcacattgtgccagttagctagggttcaattctttaatacctttttttcctccccggtggtcctcttggattcgaaactgcagtccccactggtctctccctttaccacgctatggaactggattgacttcttgactcgcaatactgtccaaaaggcgatcaatgcctgatctctactccacagagctctaagagaggaattgtttgcagttagtgacggagaactgcagtatctgaattggaatttgagttcagcctgtcatgacattataaaatactgacccgttcacaactgtttagaggtacggccggctagctattattgtaaacggttgagttaggtgttctagatgatttttttctttcgtgtgttgtgctgtgattaagacgatatatgtgtctttaacaaaggctagagaatcttccattcaaggagtagtgggtttattttatctagactattaagtatctcagagtgattgaagaatgacatgcatgcaagcatgtgttttgtgtctgcacttcatttgtatttatttgaaaataattgggaacttttgtagtcacacattataagttatttttaacttttttctatatatctaaacacacattatgtctagagacataattttagtgcatatatttatatcatttagaatggagggctatta

SEQ ID NO: 3827 - DNA, 1734 bp, Zea mays
  misc_feature (1)..(100): optimal_loci_54332_G1, chr2:13633133..13634866, Cluster 23
aaataatatataaatatgtaatcagacactaaagcatcaaatgtttttttaaaaggctatattgacttttgttatagtgtttactgttgcgtggatctagtgccgatatatccaaagaggaaaacaacagtcataaaaataacggtgagtaaagtgattttttttgcactcagcaaattaccaagccatatcaaccaagtgcttccaaaattgttaatctatctatgtgtacttgttatgatgcagcatgagccacatagctctcacgcagccaagtaacttcttgttgttctagtagttgataagaacctaagaccctatagttagtacccatgtccatttcgtccaaaagaccagaagagaagcatataatgagttattggcatgtcttgttctaaaatccacaattctaaaaaaacaaatgtatttggaatccactaaccaactccagcaatatataattttcatcctcccctgcgagcaatattccaatgaatttccaggctgaccagtggcgcatttgttctttgcaaactgaatttgtataatgctttgcagctgaattcacttgctatattttttgtgatgcagatcctcacattattattgccttgtaaatatggtttgatgccctttaaatcgggatttactctcagaacacgcggagagatctgttaaggcaagtgtcaaactgcattggacatttggatggactttgctggcaaagttggtaagcagttttgatttttcttactgatctcagctaaatatgacaaccgacctaaaactaaaggcagcattggaggtgcattgcccttacaactgaactaaagacagttatggatgaaccgaccatctatcattgcttgtgttcaagtcgactggattcaaaccaagggtagttacttaccttaccacatgatgaaatctaggaggggttgtgatgttgttgatatctatttttgaaatagtagctttttgtgtgcgagtgaaatcttagattccattgaccattgttgttaatgtattaaaccatgtttctgaaggggattctcaatttatttggatcatcaatagtctaaaaggcgggtgtatcaaacattatacaacaggttttgtgtgtgcaaaggtaattgttcatggaatgcgacattatcacccaggaagcaatgagatacaatatttattccttttgtttttttgtgttaaattgaactaatctatctaatattaagctgcaatagtatattaagtcatgatcttgtgtgtgacctcgatcataaagagcagctgaccatttatatatatatttcaccttgtgcaaaattgggtgttataatccaagagagaaagagtcaatctgaaattcaaggatgggttatctgatatacctcagtatttttgttatcatccagaattacactttctccggtctccgcttttcaatggagcataggagcggcttcatcatctacttctgagcataatttgcactaatttattcatgcatccaaatacaaactgcaatcttaattaagctacacttaaggacaaatccagatgaggaaaatatcctaagaaaatgagaaaagtatgtgggtttgtggctgtagatgtacaacgcattgcaacatgagtttggagagcgatgaggaaaataaatgcgtaatttgcagtaagccacgaacgacggaaagcgaacaaaagcaagaaaagaatttcgttacctgaaaa

SEQ ID NO: 3828 - DNA, 1416 bp, Zea mays
  misc_feature (1)..(100): optimal_loci_55225_G1, chr2:18355963..18357378, Cluster 23
ctccccaagtcccgaccactaatagtcgtgatctctgtttggagacggtgactagtggacaaatagtgcattcacctcaccctcacacacattttttttttgaaatcaagatccattgaacatcttgtccagttaaatcactggacaccgtgacagccacattggttagttcagttcgtggtggaccgatggttcgcagtcgcagcatcaccctcacacatggtccgcatggctacgcgtatctgtatctatgctcgtgcgaagggtggttctatatatttagactaccttaagtgcatagggtaaaataaaggaagcaaaattatagatgatattatttaatattttttataaaaatgatatttgaaatgatgactatgacagaggattagataggggatctgctagattactgcagggtgttaaatcttgagtgattttcgccaaggtaactagtgtttttctacagttttcggtactagctcaaatcaaatttcaaaaaattcacttaatatttttttattttaaaaataaaaatgggtaaaaatttctattaacaactagatggctccaagagctctacaaaaaattggtgtttaaaaattcatgtttttgtgccaaaaaacaaaaaaggggttctagacatgttaacccaaatggatattgttgtatctccccccctcgcctcgtcaacccgtctccactcgggcactccactccctcacccggtctgtgctcagctctcatctaagtggccgtgacactcttctcgcgctgtagctgttgggatccggcgagaagctttcagttttcgttgagaagaaaccgatttttgctctagccgctgggtctggacgtgaagcagtacgggaagaggcgagacccgatcgaccgacaccatttttggctagaaggggccagtttccgccgagaagacgtcagtacaatgttttatgtgattttggacatcaaattatttgtaaatatattttatgcattgtgcatcgtgatttgaacaacttacaaacatatcctatcaattttttgaatttttccttaaccgaaccatctttctcagttcaaaagcagctaaaaatcatcgagaaatgcacaaaaaccaccgagaagaaaatgaaaaccaccatttcaaatttgaaaacacaaaccgtttaaaatcgacgaaattcgagcagatttcgagaatatcccattctcggacactggcgagaaatgagccacaaacgagaaggttatccctgatttagagtcacgttatggcaaatcaactctcaattatactatccatcctgctattgcctttttagtctttatctactaacactacaatacacaacttttataccgaatacttggtgagaaaaaatgatttggactagcgtgaatatggatgtgacc

SEQ ID NO: 3829 - DNA, 2569 bp, Zea mays
  misc_feature (1)..(100): optimal_loci_55531_G1, chr2:20111876..20114444, Cluster 23
  modified_base (1793)..(1793): a, c, g, or t
  misc_feature (1793)..(1892): n is a, c, g, or t
  modified_base (1794)..(1794): a, c, g, or t
  modified_base (1795)..(1795): a, c, g, or t
  modified_base (1796)..(1796): a, c, g, or t
  modified_base (1797)..(1797): a, c, g, or t
  modified_base (1798)..(1798): a, c, g, or t
  modified_base (1799)..(1799): a, c, g, or t
  modified_base (1800)..(1800): a, c, g, or t
  modified_base (1801)..(1801): a, c, g, or t
  modified_base (1802)..(1802): a, c, g, or t
  modified_base (1803)..(1803): a, c, g, or t
  modified_base (1804)..(1804): a, c, g, or t
  modified_base (1805)..(1805): a, c, g, or t
  modified_base (1806)..(1806): a, c, g, or t
  modified_base (1807)..(1807): a, c, g, or t
  modified_base (1808)..(1808): a, c, g, or t
  modified_base (1809)..(1809): a, c, g, or t
  modified_base (1810)..(1810): a, c, g, or t
  modified_base (1811)..(1811): a, c, g, or t
  modified_base (1812)..(1812): a, c, g, or t
  modified_base (1813)..(1813): a, c, g, or t
  modified_base (1814)..(1814): a, c, g, or t
  modified_base (1815)..(1815): a, c, g, or t
  modified_base (1816)..(1816): a, c, g, or t
  modified_base (1817)..(1817): a, c, g, or t
  modified_base (1818)..(1818): a, c, g, or t
  modified_base (1819)..(1819): a, c, g, or t
  modified_base (1820)..(1820): a, c, g, or t
  modified_base (1821)..(1821): a, c, g, or t
  modified_base (1822)..(1822): a, c, g, or t
  modified_base (1823)..(1823): a, c, g, or t
  modified_base (1824)..(1824): a, c, g, or t
  modified_base (1825)..(1825): a, c, g, or t
  modified_base (1826)..(1826): a, c, g, or t
  modified_base (1827)..(1827): a, c, g, or t
  modified_base (1828)..(1828): a, c, g, or t
  modified_base (1829)..(1829): a, c, g, or t
  modified_base (1830)..(1830): a, c, g, or t
  modified_base (1831)..(1831): a, c, g, or t
  modified_base (1832)..(1832): a, c, g, or t
  modified_base (1833)..(1833): a, c, g, or t
  modified_base (1834)..(1834): a, c, g, or t
  modified_base (1835)..(1835): a, c, g, or t
  modified_base (1836)..(1836): a, c, g, or t
  modified_base (1837)..(1837): a, c, g, or t
  modified_base (1838)..(1838): a, c, g, or t
  modified_base (1839)..(1839): a, c, g, or t
  modified_base (1840)..(1840): a, c, g, or t
  modified_base (1841)..(1841): a, c, g, or t
  modified_base (1842)..(1842): a, c, g, or t
  modified_base (1843)..(1843): a, c, g, or t
  modified_base (1844)..(1844): a, c, g, or t
  modified_base (1845)..(1845): a, c, g, or t
  modified_base (1846)..(1846): a, c, g, or t
  modified_base (1847)..(1847): a, c, g, or t
  modified_base (1848)..(1848): a, c, g, or t
  modified_base (1849)..(1849): a, c, g, or t
  modified_base (1850)..(1850): a, c, g, or t
  modified_base (1851)..(1851): a, c, g, or t
  modified_base (1852)..(1852): a, c, g, or t
  modified_base (1853)..(1853): a, c, g, or t
  modified_base (1854)..(1854): a, c, g, or t
  modified_base (1855)..(1855): a, c, g, or t
  modified_base (1856)..(1856): a, c, g, or t
  modified_base (1857)..(1857): a, c, g, or t
  modified_base (1858)..(1858): a, c, g, or t
  modified_base (1859)..(1859): a, c, g, or t
  modified_base (1860)..(1860): a, c, g, or t
  modified_base (1861)..(1861): a, c, g, or t
  modified_base (1862)..(1862): a, c, g, or t
  modified_base (1863)..(1863): a, c, g, or t
  modified_base (1864)..(1864): a, c, g, or t
  modified_base (1865)..(1865): a, c, g, or t
  modified_base (1866)..(1866): a, c, g, or t
  modified_base (1867)..(1867): a, c, g, or t
  modified_base (1868)..(1868): a, c, g, or t
  modified_base (1869)..(1869): a, c, g, or t
  modified_base (1870)..(1870): a, c, g, or t
  modified_base (1871)..(1871): a, c, g, or t
  modified_base (1872)..(1872): a, c, g, or t
  modified_base (1873)..(1873): a, c, g, or t
  modified_base (1874)..(1874): a, c, g, or t
  modified_base (1875)..(1875): a, c, g, or t
  modified_base (1876)..(1876): a, c, g, or t
  modified_base (1877)..(1877): a, c, g, or t
  modified_base (1878)..(1878): a, c, g, or t
  modified_base (1879)..(1879): a, c, g, or t
  modified_base (1880)..(1880): a, c, g, or t
  modified_base (1881)..(1881): a, c, g, or t
  modified_base (1882)..(1882): a, c, g, or t
  modified_base (1883)..(1883): a, c, g, or t
  modified_base (1884)..(1884): a, c, g, or t
  modified_base (1885)..(1885): a, c, g, or t
  modified_base (1886)..(1886): a, c, g, or t
  modified_base (1887)..(1887): a, c, g, or t
  modified_base (1888)..(1888): a, c, g, or t
  modified_base (1889)..(1889): a, c, g, or t
  modified_base (1890)..(1890): a, c, g, or t
  modified_base (1891)..(1891): a, c, g, or t
  modified_base (1892)..(1892): a, c, g, or t
tcatcactgcaacgccgtctgtgtggcggctgaaaacgataagtggtgccatgtgtgcttcttcttcaccttctcagcacactgcagggagcagctccacctcgagttcgactgcgcagacgtaaaacaaagaccaaatagacgtacgtatgtagtgggctaacagctactcacatagagggcatgttcactttatagatcatctttatgatatgacaaattagctggccaggcagaagcaggaaaaaacagagttctgaggagacgtgggctgctggaccggggctggagccccggcagccccggtgctggatccgcccctggaagtgggaacataccaggcttaataatttcaccaggattggacttgattggaagctgcctaccatcaagatgggtcagaatgaactggaatccacataaagcctctatcagatagagcgtgtgctcagtgaacaggtcatcgaatttattcctgaagcttggatgttatttaacttgcaagacgaaaacaatgtctcctgccactgtcagactgcaacaacatgagcggcatattgcaatgttaattgtgacaaacgcagttataaataactcaatggatgtgtataagcctgaaccttatagctacaggaaaggagaagaattgagcgcacaactttaccttggaacacaatcttttggccatactgcattcctttctcaatataaacctcaagaaccttctcctgaacaacattgctgcctctgcggcttgggcgcctatccctttcacttaggatttcagctgatcaagcatacacaataaagatcacaagatcggcacaagcaaaacacaatttgcatgaagatatacacaaatcgaatacgattaccatatgttggatcatgcctaatcctatctgtcttgttacagtcctcattcctacaccatgacatctgtagcatgttcttatccatgaaacacaaatcatcagaacaattaaatagtccaaattcaagcaagtaagcactgtgtatcctcataccttttctaggtctccagttgtcagggtgcctctttatagcagccatccggtatgccattttgaactcatcctggcaggcagtattgcagacgccaaggacctcgtagtacttggagttgttgctccaccatggagcacatcccaaacatttcaatcacaggacaatctccctgcaattctgaaaaaaagagaaaactcaactgaatcaactaaagaaaagtagcctaaaatttttaccaaatcaaatattcatcatatcacttcgtcagcatccatcacagaccatcaaatgaaaactaaaacaccaaccaaatgctaatctggtaacacaataggcatgttaaatcattgactcatttggcaacacccctctaacatattttataatattccgcgcaacttagtgcagtttgtcatttgttatgttcagtttagcttgacataaaagatacaacgtaacttaggtttagacttgttttgaacagttatgatagcaatgaaagacttgtatgagctgatatgatagcaatgaataatgtgggaaaaatatacaagaaataacttttcgacaacgtgtaatgtccaacaatttttttctctgtaatgtttaacacaccatgtatgagatcatcgcttatcagggttaccatttgtacttacaagctttcctcattgccttcaagaatatagtatttgagatacaaattttcgtatttttccccactggtcccgagccgttatttatgggcgaaactgagaaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcactcaccgaaataaatttcaacaacgtttcccggaaggagggaattgtttttctatgcccttggtttaaagaaggagatagaaattaaaatgtataaatgggttaatttaaccaaataaaagaaaaaggaaatagattgcaccacttaggtaaaaaagaggggaacggccaaggatggccacaaaacccaggcatatatatcgaatggaatttttttttaaatttttgtattccagaaattgggagtgggtgtgtgtaaatatgtatatgtgtatatatatatatataaccacacccaattgaaacatttgatattgtctacatctataagtgtggtcaaataatcacgatttatatcatatatagtatcaggagctaaatagtagcataagttaagaatcataaaataaatacaaaacaattttattatcttccgaatctttcatcatagtttgaatagtaattttttttcagctctttaccttctttagttaactagcgtttaagttcataatcaaaagcactaatttttacagactaacttttatgcctttaaggacaagaccgagaacctttgaaactatatcatcaatgttgattgacactttctcaaagttcaaagttcttgacttgacatcaactaaactaatcaactatcttgtcaggttgttta

SEQ ID NO: 3830 - DNA, 1961 bp, Zea mays
  misc_feature (1)..(100): optimal_loci_56089_G1, chr2:23126896..23128856, Cluster 23
ctcaaaagatatgcggagtatgaatatattgatacatccttttgtgcattaacatataaacattttcattaacatgttggccagagtttatatagtgtttaactttttttggattctaattcactgtaaattttgaaatggatcagagtgagtatattttttttctcaactaataagcctccgaatgtcaaatccaccgcaaattatatatggcgagtcagtcactgtctcgtgccaaatcatttttctgcgtatattttgaatcattcaaggcaggacatttgattaagatattacttgatttagtgtcctttccaatgtaagataaagagaagtatattttgatacatagagactccaaaccgaggttactttgtatatccacatggccaactttgtcagacaatataactttattcaagaaataaaaaatgtcgtttctctccctttttttatgcgctctaaatctagtagacctggaaccttttgatcaaattagttagtcggctgaccagtttttaaaatgtctatttaagcgctgtttttggattctatacaactcgaataagcactgaaatatctgtccacatgtaaactgttcttagcagtcttactgcagggagcttggtgtcattgtaacacaactccattggatcaaaatgacattattcgggaatcagcaggagttacaaaagatccctgctgtataaaatgcagtaaagtgatataattcgggaattggcaggagttgcatgggatgcctatcttgagaagcagggggtcatgacgttaatcttgtggtcagtggtcggtacaaaatgggctataacttaaggcagacaaatccacaaaaagacgattctacttgagcaaatgatgaatcatttattaaatcttgtggttggttgcagtgtgctttggccagtagcatacgagaattccttatcattttattacctggaacttgcagtacttcatatttaaaacgatgatcgtggacttatctgatgggccaatacagacactacagacagacaatttttcggtctgctcgtacctctcgtgtttgctcttacatttcttttcatgataacgacttggtgtgaaatggacttttcgactttttttaaatagaaaaaaaatgccgtgaaagtgataacaaaggtttttaaggacagaagcacacagtcggtctatatgataccatatctcttggggaatctggagtcttggacaggaagtttggtagaactgtcggcggctcctctttggaaatgcatatcatgcaaagattgcgttccgcgaggattttttttgtttttgttttcagacaccatgaacaaaatctgatgttgtgttctttttccatttgagcagacaaaaaaagagttgcatcctatattattatcaagataaatttgattatataagaaagaagagaaatcgcagaagacgcggaagctacagtttaggtgagtatgtatgcgtgtatatctactaatcaagagtagcggagagcagctagaacgaagtcagcatgatcgcttgttaaaacttccaatgcaccttcagccaagtactggccatccattgtgcagaaaggaactgttccaagctttggttagccataatgtcaggatctcactgggtcaaaaactatcgcagaagacaccatatatcgccggatgcaccaactttgtctcgtcatgcacaaatgaacaaaaaagacatgtttttcttgtaaggactttggacggcagtggtcttaattagcttacatccatgctacctactgaacttcaattgttatggactcaagtgttaactgttactcctacttattttagatctattgcgccgttctttcctactacaagaatgtaagtacaccaatatagagactgagcactgtattgattcagtagtttcttgttatcgtcaacaccgagttatttgcactc

SEQ ID NO: 3831 - DNA, 2953 bp, Zea mays
  misc_feature (1)..(100): optimal_loci_58453_G1, chr2:37139720..37142672, Cluster 23
caaattatatgagcttatcatgaacattaaatagttgtgatatagacttcttttttctgcctcacatagaactaaatataatgagagagatggataactaaaaaaccaacttttttaaaattaggttgcataaaaccattagtcaaaattaccatagcaccaccgtcattctcagcatgtttattttattaaagttgagtgactagcaaaaatactataatgtcacaatccaagttctgatatccacaaggtaaaatatatggctagtcatccttttcaacatatttattatatatagttgagtgactagcaaaaatagtataatgtcacaacccaagttttgacatccacaaggtaaaatatatggctagtcatctttaatagcaactatcaaattaataatgcaatgcaataattaattcgatcaatttagtttatgggacggtttaacggccagttgcgttgtttctaaagtctacaatgttcaaaaagtcttgaataactcaaactttgctgctcctgaatggatcttcaaagctctcggcattgatcttcgaattgaacctacataaagcttatgtcctatcgcaactaacgtacaaacaaatcatacataaaaatattgtacaagacaaaagttcgaaaaaaaaaacatactaaaagataacaaggtcgtagagctagcgaaagaacgcaaaaaaaaaaagaatttagacagagaagctggcaagctgcgaaggttaaaagggaagccatgcgattatggatctgcgtgtacaacggaactgatccgtggatttaaaattgaaaggtagatgaatctgcgcgagctggcacaatgcttgcaactcagttgactgaaggtaaagaaacaaacatattgtcttcggattaaagacaattgttcggactgcggcagctacaacccataaatacaaaacactatagacagaggcggatccagaatttttctatgatccaaaccaaaactactaaatttccttctttttattttatcttagttattttataccgtattaatagagacttatatagaattaaatagatcaaaccccgggccacggtccgggtggcccggagtatagatccgcccctgactatagaagcagtataagtcggtacagattaaagccaagcacatagactgaataataaagcaattgatgctacacgtctgtgtatcacaggattctcagaataaagaaacaacaacagaataaaataaaataaattggactcagaaaattatttatttcatgcattatctctatttatattaaagcactaataagtcgaccgaagggaaataaacaaagataataaagcagttgatactgcacgtatgtgtatcacctgattctcggaataaagaaccaacaacagaatgcagaataaaataaattaaactaggctcataaaattaaataaatcttatttcttatttttattctctactatattaaaacactagtttttctggtaccacagtttccatcgtcgtggccccacacttaaattgaaaaaataaatacaaaccatagcaatgtacggctactttgctagttcatttataagactgtttaggcctagtttggatattcttggattggaatggtttagagggattgaagagtgtttaaagctacccgcagtggactacttcatttactacccgatctgacatagagtaaaatatctgctgtagtgggggccgtatgtggtactccattctagagtagaagctcatgagtgtagtacggatttaactctacgcgttgcacatattcggattcaactctatgctacagccgtatatgtagggaagacaattaaaaaaataatataatatatagtagttgatatagagttgagatatagagtaaatataattacagaggattgtgttataaggtaaaaaaatttgctgataagtacataagtctttttatggtacaaatttagagttgtatgaatgcggatgaactaaaatctccaataaaactaatcatctctcaatacatgtatctcaaattctcaatgacactcatagtacctaaaataggccctatggtgggacaccatatcagacaccgagcgcggggaaaaactcccaggcgcgtcacgcgtgcgttgtctcgggcgctgcacgtccgagactccgagcgggaccggcgcgcctgtcctctcctggcctgccatcgaatagtcaatagagagaaaatatatttgaaacgtcaacccttgcagatgcgtgcatgtgaacctcagcgtgacagcgcgtcataactcatatcacaggcccaggcccaggctcagtttgttcgtctattctctctcctgaccaccacaccgagtcaccgatcatctatcctcacgtctcacgcttgtctacagtgttgtccgcactcccatgtgacccgtcctcccttaatgagttgtgaccttagccgcgtttggaacgagcagattttctgcaatcgcatgcatgcatgcatgcacccggcacagaaaaggagtagagaaaacgtgcacgcacggaaagggagagaggaagagactgcgaagaaagattaaaaaaaaaagaactggctgcatgcaatggagaaaactggcaataatcagttccatttttcatggaaaacgaggatcgtcgctatgttaaaactaaaggatttcattggaacaaaggaatttcacagtaatatgataagaattttacaggaattagtttaaaaacacagtaaaaacataggatttatgaaataatccttcaatccaaagaagccccaagactgtgaagcaaagtaacgaaaatccagataatccgaagcgtagctggtggaaaaaaaggaacacgaatctctcgtcaaatagttgggaaagatatagagctatttcgaacggtggtggcggctaggtttagattcaaatg

SEQ ID NO: 3832 - DNA, 1640 bp, Zea mays
  misc_feature (1)..(100): optimal_loci_61414_G1, chr2:54252580..54254219, Cluster 23
ctgtagtcatgttcctatatgcacatttatatcttaggtgttgtttctatatgcacattgtaggtgccacaaatgtaagctatcgatccctcctttttctccgcacttcttctagattcttattcttcctttttctgaattattataccagggcatcctgcatagaattcgtattcaagagacattggaaatagttcttcagtgtttaccatatatcaagcagatcaacagaggcttaatcctactctgtttaccacatacatgaaccattgaggtatacaactttacttagtaaatgattataattctacatacacaagttctacatacaatttttattattcagcatgtgttctttgatatccttattaacagttttttctttttaacagattttcatgtcgttaaagacatgactaagctatattgcaagaagtcgttgtagtggtgcctcttctctattgttcaatgttcttttatagtgttgttttgattttccattaaatctagaaggacttggcataactctgtcagcattatttgagtttagaaatgcttataaattatgtcttcaatcttgaatgggatatggctagcaccgttttccttctaaaatcaagcttgtgacagctgcatagttatctctttggtatatttgtatggtactttgcacttttcactataccaaaacatgtttgtgcttggtaactcacattaacaaacaatacattttctgcataaaatggccatttacttattaggtttactctgcaacttattaaagtgtcgacttacacactaatgataatatggtgttttagttgacaatgttgctctttgtgtcagttgataatatttgtaacagtataatggaggattaggttaatttttctcagtgatcattttttatttgtacccaattgtgccatctacattttcccaacgaatagtctcctgacgatgtcatagtgagtagtctcctgatcaatgtctcgccattgtaatttgtacagttcatcaacatctcaggaaacaaatgcttagcatgaatcaaattccagaggaaactgtgtcatgttgatgtgtgagttcattacgctttaatcagagtagtactggtctttccactaactaaaattagttatattgattcaaatgaaatcacacatacaaggtaaaaagtatacaaggtttgttctgcataatcaaaatacatgcttttcacatggtgaactgtgtatagtcttcatcaattacaatgattttaggactaccatcaaatcaacttataatgctccatcaaatacaaaagaaccatccgaaacatcgtaatttcatgagctatgatacaaatggaacaaattaaaggaaaagagtcctagaaaatgggaaaataacatttcgtttctgtttgagtattttggtacatgatgaactaaggtactctatgttatactaaactagaataatgtagagtgatataacttatttggttggagtgttgaacttcatgcacatgtccgttttatgatataattcaagcatagtagcatgtcaaaaaagctttttctataacaatgtgctaatttttcattgccttctttcgagcccttacaatggaatctttgaacaaagctatg

SEQ ID NO: 3833 - DNA, 3067 bp, Zea mays
  misc_feature (1)..(100): optimal_loci_6366_G1, chr1:32650667..32653733, Cluster 23
agatatactttttacactaattattttcttgctttatttaggcaagtgtttcgtatatgaaatacacacaaataagtttgaatgtgagacgaaagttaaaagtttaattcaaataaatattcattttactttatgaaaatcaatgtccaatgtaaagaattactttaagtcgtatatatttctttataagtatttctaattatatagtttattcaaagagtaattcaagtcttatgatgattattttattccatcttctcttagaaaacacttttatttagttctcgagatgaattttctatagatcccaaaaataggatttttgggtgttacaacaataatattgtccatctatttataagaccgggccggtatacaacttgggatgaaactaccgctctgccagccatactacacaataacacttctcaattaattaagtacaatttggtctttttatatctacgtcgtatcatgtagaacttcccttgttggagtccaccttgggcctccttcgctagaagacgatatggaaagcttctaaggtttaattctgcttccttgggatcctcgccatcttcggctttagagctcgcatgaaggcgtcttctttactttgtctttgaggcttttcttatcccttggcttttaactgtattaatccgagaaaacatctaaacgacggttttatagatatttggttagagacctaacacgatattttatatttttttaggacgaagaaagagtatacagagtatatatataccggctgttcgtagagtccatttcagattttgtgctgtctccagcatgatccttgattcagtccgatcagcatcaggagttatgatccttgcacccaccgactgaaaacgccataaaatacggttgaatcggtcgttcgcaagaatgggacgagagaatgcaagattccggctgttttatgtcagaccatcaccacttcgtccggtccgggcatgggcaatggcgatgtgagtagcagaaagcatgcagagcatgtctcacaagctcgccgtagcttcttcctccacagcccatatagcgacgcgggccggccattgtatttagggcacgtagagtaattaatatcggattgtcttgtcacttttgctctcctctccaataatcacaatacatgacaggcgcaggcggtttggtctggtcgttaccggggcggggggaaagggggctggaaaaagtccgtcgagaaaacgatggccggagtgagggagaaaaaaaaaaacaggacggcgcacctgcacgcccgccacctaatgtttaggcaggcaggccgccaattattgtatcgggtggcacatcgcgtgcgccacgagtgctgcgtcgcaacggatggatgcctcacgcccatgggcagcgacgggacggcctgacgcgccctccgtctgatctgcctgatctcacccaacctggctggtaggtcgtcgttacacaaaggcacggagcattgcttctgatgcaattcttaagcctttcttaccgatagaaacgtccgcgcgcgcaccgctggtccatgaggtcttttttccttatgtggccgcttcgctttcattctgttgtggtatcaagagatcagatggtggagaaccatactgtgaagtgcctctgcctcctaaacgtgtctggactctgaactgactacaactccttgtgacgacggacggaataattagtacttgaattgcacggcaataaacatgcttcgagcctgaattccggcagcaacacgggaggatctctttccctgcgtctcaatgccgcatcagtgcgtagcagatgagctcacactaaaatctgccgtcagatactaagatttgacccaatagtagtgcaagttgtaatgaaacgacaacaaatacgccagtgaaaggcaccgctgattcgttcgtagtagcgtgacaggtcaaatcagaatacgtcgattcctgtcgctgttctgtcattatacaggagtagtagctattatttatcgccttgctgatttcttccactggtttcatcaacaggaagtgatgtcagaaatgattgacaagcgcacaaaacaaccacttgatttctctggacaataataaaatctggatggcgttccagcgttcagcttcaaccaggatcatcaatttgatagggacatcaggttagggggttcgattttttcttttcctaataatactaactgtatgaatcccaattataacgcgcagcgcatcatctgttggcgttgttgcgctcacagttgttatgttagtgctcgagtatatatacatcgagtgaaaagtaggtttggaaagttgctggatgatggaaaggatatgatgcactaaagaagcggataaaaccaggcagccagctataaaagatcctagtatagcgttattaagtggttgctacatagaacaaggacaagtgggagctgacaaggcagtaccatgctccattcattccctaatatttttagataaagggtgtcttgatctcataatttcatttgcgggtgaagatgtaggtgccaaattttacttcaataataggaacgctccgtgcctccgtacttattcgttcaatgatctgtggcaatatcatatgattgcttacttgctagtaagttttctaaagtctaaacacgcaaagcattacaaacatctgttgtgcccatttttttgtacctaatcaaggaatgcaaaattaagctacgttggtaaggtagcatgattttgacaggcatgaactcggagccttaaataaactaattggcaatcatgaaaaacctcaaaatttaaatgagcacacgagaatcttcagaatgaaataggcacataaaatagacagagaacaggagtgtatgccttggatttctgaaacagatactagaagatttctatggtttttactcctactagtgctagtttccatccctgagatgttttgttattattagagaactgcttacgaagccagttgacgaaatctcgtaacattactgtgggcatctttggaagcgaatagcgtgattggttcacagtatttg

SEQ ID NO: 3834 - DNA, 2080 bp, Zea mays
  misc_feature (1)..(100): optimal_loci_65456_G1, chr2:78237290..78239369, Cluster 23
ccgcgacgctgaccgtgacccaggattctcgcttctccgtccacgtccaatctaagtccttttcatttatcctcaacatggctgaagattacattcatgtttttttctttcctgattacagtagttgatattggtctgcttggaggtacttccagtcattttgcaaactatgatccccccatatggttagatagctatcttgagaaatgttattttagaaattcaatttgataggtttgccagtctggtcttgtggacttccttcaatcactttgaatttgtgaacttaattgcatgatttgcttagctcaaagtttttgcagtccaattattcttatatgttcttcctaattcttttcagttcatttagtaaattgatgccatttttttgcttaagtggagaattgagccgtgaatgtaaaaaataacttaggctagaaaggcagattttagaaattgatagtactgtcagactgtaatgtgtatgaataggaaaaagttatcatgttagtttctcaaatcataccattttcctcctattccttcatgtttatttcattcatgatgcttttgcacaaaaaatgtttttgacattacattttgtaggcatgagtaaaattattgcccttgcacatgcaaatgcttggcatatgtgactgattagtttgatgacttgtcttttgcacaatattaaatttcctgatggtgcatcatttgacagaagttgaggctactgaaagattctatgttttctaaagctcagacaaccataaaaaactacgggtttatgcaatatggactaagtgaaggtatatattaaccatgtttctatttcatgaacaaaactaattattgggcttcctgaagttgcttttgtagataaaccccccatatctgtattgtgaacttttttttatatctgtatcatggagtgtcgttctcagattcaataattatcaaacaatatgtactgattatattttttagcaagctgtcagttgatgtgatgctctatgtttacattttgtcaaattaccgacaagagggttaagttttagaagaaactactctgcaatggttaatgatatctgtcaggacccaagttggtccccagtccactttgattggtgctatgtcccagtgatttgaggaaagttctagcacaacacattgtattttgattagtgaatgaagcatttagacgacaaaccattttcttctgccttttactctcagaacttctttagtcaacacacattgtattcttgattcttggctatcatttgccaagtttagaagttcaccatccgttagtttcttttgaactaatgcacttcattaacttctttctagaatttcttggatcagttatgcaaaggagttgcacactgccatggccatggtatccttcaccggttggatttctcttgtctaatttatattgctgaactcatcagatgagtacaacattgcattttgacttttttgattcatccacaaaacatgctggtgtacaagaagggaatactaaagattgctgatctgggactcggtagggctttcactgtgccctaaaagctacacccatgaggtactgcttaccatttggagttggaaggctcgatgcaattttagtttttaaagaaatttctgggcatgatccattaagctctttatattatgtatttatgtagattgtgacacttttggtatagatctcctgaagttatttttctcttatcctgttgaaggaacactagcacataacattttgctgcaattgttgtacctctttagttccttcttggccaggaaatctatatttagaataacacttctactgtcatagagtaacacttctactattaagaaatctaagctcatgttgacaatactatatcgcaacctccaatttcacaatggtttgtcaacaatacaacgcaaatcttttattttacatgattcttatgttagggacaacctaaacttcaaaaggttcaattctcaaatgtcagatctcagcagctgtgctcatttcccgtacattaaaaagcaggtgcagtgcatccagtccccctgt

SEQ ID NO: 3835 - DNA, 1914 bp, Zea mays
  misc_feature (1)..(100): optimal_loci_75335_G1, chr2:143251844..143253757, Cluster 23
ttatgttcttgtatgatatggcaacttttatgccttaagaacaaacgtggaggctactttttagccgatactaatagagaccattctttatttgatcactactaatgatcctagtttatttcctgacgctcaaaatacaaatcttccttatttgaaactggtaaattaggttcctatatgacactatcgttagatctaacctctaacgatattaaattttatataaaaaagaaaattttatctctattgactaattatttatatatatgaatacttataataattattacaagtattcatacataaataattattcagataattattcaataagggtacaattgtttttcatttgaaagttaccattgttagaggttagaactaacgttgtcatatatggaaccaaatttacatcaaatgctaagtagggaagatttatatttggaggaccaagggccaagaacgaggaacttcgttagtgtcaaataaggaattgtctcgaatataaatgttttataaaagcaaacctcgctgtcttttcaaaactatctacatggcataccaaattaggtgccacatcatcctctaataaatgctgcaataccttcttctaatataaacttaaaacttactattttcagctactaccatacaaagcatttatactatactatttgtttgccttcacattctcacataattcggtctaataatctttaagtgttttatcttaatcatacatgagcttacctagttttggcatcatatctattacatttaattatgggacaatttattcctaggaaaatattgtagtaacgtgtggtattcttctaatatagtagtttattatcccacattgcatcttttattgttattggacatgtgttctttctagattaacatggaaaattgatttgtaacatggttcattgaaccctttgttattattgtaatagaaacttacatataaatgtttaccatcttaggtagtatattagcttctttttataagcctttctcatgtgagaacaagtttttgaataatggttactctcgctactgcaaaacacaccatccctctagcccatcgccatcgggtatgctagagctagtggtgagccaacttcacttctatgtcataagcctagaatccgaagaatgattaggatcttattaacctaacaatgaaagcccatcactatcgggatatgaattggaccaatagtgacctatcattatattcatctaccctcattactcaattcttcaccattggatctagccacctattatgtctagatataaatagggcccagtgttcttccttgctcccaaggtgttaggtagcaatcaataggttcctctagatgcgcttttatagttgttagcatttttatgctcaattggtctattccacaagcatactgcatacattatatcgatgcaaaactttaatttggagtattcctagtatcatatttatatgcctagggaaagtataagacgaaggtagtttgtaaatagagtttgtggctgactatgaacaatcaccaacttaaacatgggtaatactgatatagtaaaaagggagagagatgataaagtatagataagtaaataagtgttgtagctagtgggacatggagtgagtatatgaatcctatgttacttctaatctagcacaacatgagctaaaccaatggtcatacaagcttgtcaagatatagccaaataatccataatagtgctttggggcggactggcccgaacttcacccaaaaaaaggttgattaggataaagtgccatgagacctatgatttaataactagatccaacatggtggaatacaaagaatggacagggttgtcaccacataccactaactatctaaagagctagccacaatccaa

SEQ ID NO: 3836 - DNA, 1572 bp, Zea mays
  misc_feature (1)..(100): optimal_loci_7578_G1, chr1:39768740..39770311, Cluster 23
tcaaagggtgacaattggtccctgaagcataatggatgggtggcctaaatcttatattgaggttatgctagtagcaatgaacataattcaggacatgaaagaactcaaccttattgaggtccatgtagccaggagttggataggacgatgagtctcccccttatcagagaaagtcaactatgcttgggagtatggagaattggttgatccatcctaggctactttagaaaatagtactattagaagccacaaataatttgtcgcaaatctttagcttagttggagactgtcgaagggaaatcctatcaagtcatgctctgtgacgattccacacccaatggtattttccataactttattattgcatattctgagttatttgattccagttgtgaactcttcttaatctaagttagatattgatgttgtgttggtcttcattccaaacacgttcgatttagcattcagatcgggactcctccccggttgatgagaacctaagactggaggaagaaatttataccaatcctcatacttgtactaccactgaactagaggaggagaacgacttggcttccaaggatgatcgtaaggatgccctttgactcctttgaaaaggaaattaagaaaatcttcaaggtatgactcacaagatagttagtataattttgtcttgaagtattataatggtaggtattaaatttggcaaggtatcaatagagctaccaaagataaagtaagctttgtgccatctagctcacttactagggtaactgttggggttgaacctgcttctgtcgtgttagagccttcagttgagataccttatctagttgagccttctaaagccccctgagggaacaattctggctcccacgtcatcttcccgagtgcctccaaaaactcccatagttgttgttgcccttggttgcattggctgaccctttggtcgcaccagctaaccctttagcggctcctggaccgtcatcaattgccaaaaaagcttattcactcattaaatattgtcaattgatcatcgctgctctagtgcagacccaaatattgaagaagtgttacatgaagtgaagatttcagtatctgatgactattatcaacacttcttggttcgctatgggaaccatctggttgcccacattgacttggtcaaagatcaccactaattagaaaaggccaaacaatttgaagaaggttttcacaaatgccattggctaagtctctaactcatgattttactgagtaaaacattgtttctggtgactctgtccttaagcgatcatggatgagtcaactgataagcctttacttcttatgttgactcacaaaaactccaagttgttgaatccatgatggaatatttggagaaagagaaggccacaagttcagaattaatgggcttggtttagaacctaaggaatcaacttaaagttaagtcacatgaactcgaatgtatgtatcataatcatataaatactagcttgttggagcgaaggtcgtccgccccctcgatcagctttctttaacataagttgaactggttctatctcagacaca

SEQ ID NO: 3837 - DNA, 2563 bp, Zea mays
  misc_feature (1)..(100): optimal_loci_80265_G1, chr2:173327355..173329917, Cluster 23
tgtgaagaagcgggtgcagcgctaggtctcacgcgtgaaacaaaaatcaagtgtggaaataggaaaccttcgtcggattggagcttgatgggtaacgaatatttgcgttgtgaatggattgatatccgcatgcggggagtttgggagcataactaggaaacggttaaaggtcaatttttcctttttgccctaaaacgaggattagaaccaaggttttaagaagctattacatattactatccatccgagagcaactcctctattgtagttttttcctctttggctctttcccacctgttttttctgctctctcttggtttttgaatttaagaatgctaactaattattgataaccattatagaaaggcaaaaataaaaattcttattttatttttctcacttggcacaatcattgctttaccaaatattttaaaaaaattattctaagatgctctcagtaatttgtagggtctgtttgataagtgctaattcctatatagctaacaattagttaaaattagctataacctattcaaactgagactaataaatgagttattttttagctatgttataactagctgttagctaactagctagctaatctcaaatatttcggtgtaattttccaagtagtagctagtcctagctcatttaatcagcccatatttttcttgttttacgttgcctaataaataaaaaatttaaaggttattgcgaaccaaggtttaaaattgcgggctatacaaaatagcgacatcattttttagactacaaggctatagcgtagctataaaaaatagtgaatttataaaaaacatataatatgtataatctataaaaaagaatatggaagtcaagatatctgactaagagcaatatgtttccaagtctatgggagactagggatgtaacataatatacaattcatggaattaaagtgtttagcacttcaataacatatagccactaggtagctacataatatgataattaataggtttgattagttctaaaatactagagtagtaaaatgttcactatctctcgctgtcatggtagcaacacaataccatgatttagaacataacaaaaaagtcatcaagcatagagttatttgaattagattgatccatatcaatagcatgtgcatcatcttcttttgtatgaagcaagctctagttggtcttcattacgttcattaatatcaatgagcttcctcatccttgtgcatcatcttcttctgtatgaagcaagctcaggttggtcttcattacatttattaatatcaactaggtatgtgcccgctcgttgccatctactttttttggtttgaacttttttagtccaacccaacccttttagaccattcggttctttcaactagtatcccaattttgagtccattcttgttttaccagatgatgcaattgatagatttcccaaattcagacaggcaggatacataccctttataacacgttgtttcttttgtaccctacaagctcaaaaaatacattgacagatacttggttgcgcatcttaacaaaaagaatacaacgcaatgaagaaagaagaataaaaataggaccatcaccacggtcaagaaacataaacccttagacaaattttgcattttgtaccatatacggggaatatagccctttggcaggccaaatggctttaaaaatctaggctaagtaatgtgctaaggcagtgaactaaagtgaccaaatttggattctccaaatctataggttcctagcaacttgtagctataattgtacatgaagccatcatggttaggttttgctcttgaacttgcgctatgctttcaggtcaactacgacgacagtgatgttgtcttcgctccccttttgaagagcaagctttgacaagcattccacagccgcttgagtagttgggtttgcggaattcactaacccatggggacgatgatgaacttgtgccattctttttgtgccacagaagtatctacttgcgagcaacttcacataactcttcatttgacattacattctagaggtcgtcgctggcaagaataaggcgctcatcatccttagcctgtggaactattgttacctctaagactgaaattatccatggttatagatatctttcacctgcaactaatacaagccattacagttctgatcatataatacatgctttgtatcttggaatcttgtttgaagtaaaacaactaaaactaccaagctgagagtacttagttcttctacaagcatatttgaattgaagaactaatgttgtgtcctgaatatgctccacttagggtaacatagtcaaagttcatagcagaggagacaaatttcaaaattaggtatatgttccacactatagtgaaagatctattcacgccttgtgctagtaaatagaaactaaaatatcaagctcctttagtttgtatgcatcatatacaagcaaatatcaaaactttgtaatctaagaagtcaagaactcaaaaggaagcatgcagcataatatcaaaggcatagaatgccgagaaatgagtgtactcgtg

SEQ ID NO: 3838 - DNA, 1549 bp, Zea mays
  misc_feature (1)..(100): optimal_loci_83748_G1, chr2:191436042..191437590, Cluster 23
atcataaagctactatatactaattagtgtgctaagataaacatgtaggttccacctcaaattaacatactgagtacaatacactcaatgactaaagtcattatatatacaatgtatcaaaaaatcaatattaaccaattcaccccctaaaagtaacaaaatcctaacccatacaacctatttttttgttcaacacaacccgataagtaaatcaacccattcccacccatccaaaatgcatccacttgagaaccccaacccattaaactcatcccaacctagtctattagcaagcctaccagtgcttggccgttggtagaatgggtcgtccctcccatgtgtacggtgttctctatgttcctaggagaaggatcgaaatatacacgaaagaatagaatgattcaaggtgaaaagtgaatagacaaagagtgacccagatgatttagaaatactttagagttacaatataaaagaataggggggcctattttagttaatgttattggagacggcagcggaaaccatgaggttacgtaaacaaataaggtcttgtttggtagctcaatatttttagagtttcaagacaaaaaatggtttttatgaataagtatttgtggttaaaaaatgtttggttagtgcttgtaaaatttcgttttagatattgtggtatgatcaaaaccacactattttggagttctcgagactgaggctggttgctgaagttttcctctgccatgcaagcccatgtacactatctacatgtgcccactgaagttttggacattgtgtttttcctaacccccgagcagccttttgctgctggtggccagcaagcccatgtacactggtatgacaagtgttaatgctactttgtttatgtgtaaaaaaaactatgtatccaaatatgcatcagtagttagaaataccatgatatttgaaaaccataatattcatgctacagaaattctaaaactgtagtatttcaataccatagtatttgaaaaatgtggtggcaaataggccttaagtaggggatccgtttttttaatgggggcattaaaattcatatccttagttcaccaacaactcagctttgtccctctctaataagtaaaaatgcctcacctactactgctactactatagaggagtaaacctaagcattattgctgaactagaggcacatatttaaaaattcttttaatgttgttgaagacgcttcttgtttaataaatagcaaaaactatacatgtataattgtgaatatatcgtatttttctcccaccaagaaaaatatttggaatgacaaatcaagtacatctcgatttgaaggacgtaacttgtattacatacactaaggtaataagataacataaattcaaatacacttcataatgggatacattgtgtaagtaatcaaccgccaccggccaggcggccaccatgaccggaggagcattattcttcgtgccgtgtgaatgattgaaagagtagacggaccggggcgcatagtactagactattaaacaacctcgatgctgctgcagcc

SEQ ID NO: 3839 - DNA, 3251 bp, Zea mays
  misc_feature (1)..(100): optimal_loci_84433_G1, chr2:195641855..195645105, Cluster 23
tacgggcggtaccgattgaccggaggcagaaccatgttactaatgcaatcttcgatgagctgaagaaatctcgcaagtcattttcaatgacgttccataagagattaccaacataagccgagaggcagccttcgaacttcttggggtcagtttggaactctacctccttttcttatttgaggtggccgtcaccctgcacctttcaaccctcagatatctactaccactgtacatgtagtgtatacacacacacacacacaccagagtatatcagtgaaaaacacaccagaatatgacaaaaggtactaacagttcggcatcaaagttgaaaccaccatgtgcaagtccaccctgttaaacaaaaacgcagcagcttatatgagtgcaaccaggaagtacataggcaaactgtggatttgagtaaaaagggagagagctggttcatgccactcacattcttaactacacttgacataaccaaagtagcctctgcaatgtctatcatgaactgatttgtgtcccaacctttccataacggtaaggtaagttactatgcatgcctcatttttttttatttttttctttctctataaaagaataaagaaatgcatgtatgtttctagtgtaacacaaataatatcgggtcatacacttattaaaaagcaaaggagttatatacaacagtgacacataccaacttgaggatcaccagtgtttgcatcgatatttccaagcagcccattaatctgtggtctccaattcatgatggcagctgcaagtttaacatgtagttctttaagctattattcaactcaatttaggcaagcaaaaaaccttacatgtgtccagatagagtagcatggttgcactcaacattaatcttgaactctcctatgtcacacaagcttcactcacagaattttgctgacaatgtatccacatttcaaaaatatgaaaacttatattactagagaaatctaacccatggaacttgccccatttgcactaagcattaaccagctagttccgtattataaatcgtttctcatttaacactacagatgtttttcattgaacatattttacaccacaaaataccctacacctacttcccccctgcacgcacacacatacacactgaaagtgataacaaagcctcagctgaagtaagagcatatcagtgacaccatatacggctactcttctgaacatagttttttttctgaacatatacttattgaaaacatagagtgctttgggacaagttcaggtaaatatcaacaatgttcataatagcggtaaactaaattggaaagcaaagaattagttcgcagcaatgattttgcagtcatccggatagagaactgggaatactaaaaatgattgtgtgtgcgtgcattcatccggatagagaattgtaaacattccccaaactaaatcatgtaatatacaatttggagtaacactaattgttcatgggcacttaatgaacatagattgttgttcacttggaatctagaaatattttatcacgtaatgaaaattaaatcagctattatataacattcgtattttgccaggtaactgtatcttttatcatgctagactgctaatttgtccaacaactttttcaaaaaaatgacagcggagtagcatcttcaatcaatcaaaaaatattgcattttggtaatggtcttttaatcaatattttgtgctgctttggtccagaatttacaaaagaattgtgaactcaccaggtaattcctttgttgttactgttacattccttgtcactaaacttgaggttgtagagatgttgatgaactattaaatcaaacggtaattcattaacaaaaatgtattcaaatttgtttatccaaatcattgcaatagtaaaccaaggtgacttattatacatagcaaggtagtgtgctggagagtaataaaaagcataccaattgatcgcgacattgtaagaacaaaaaaactcgataattgttccattgtatgaccttaccaccctcttcctcaatccttgcatactcatcctctaaatgtctaaatgtcaaatgtaataaaaactgtcaaatgatggtacaggggcttctctaaatgtctgaatagactgattagtaatcctgacattttttgacatggacagtttgttgaaccttacttcagattatcaataggagtagagtaacaacttaacattgacatgcatgccaaaggataaaccacaaaacataggtgataaataatgtagatggcaaaatgtatcaatatcagtcataggatctgccagagatttatatacatgaaatacaacaatctgtaaatagaaattagtaaattctagaatggtttaaaaaaagtcttcaacactgaattccaccattacatcagaaaaggcacgggtttaatcaaatagcaagcttttttgaggaatcaaatagcaagcttaatacagtcaaatagcaagcttaatacaatcaactcttgtgtataaaaccaggttaccaatttatgaggtgcatggtaagataaataaatggcattgatgagcttagtgataaaccgtttctgaaaatgacctattctgattgttcaaaaacatgcatgcagatcacatcactcttcagcataaatatattgcagccagaaactctcatctacaagcacttcataatggtcaatgaaccagccaccatgaccatgcacattcaacaaaaaatagtttacattcgagttgcctaaaaacaaaaggctctctcccaaccataacttttctctaaattaaacaaaaagggccaagatccagtgcactataccatccttcagtgccatgctccaaacaaaatcgatcttcaatgacagttttagatatctaacatgtagtcaaggagaacatatccatatgcccacaactcgtaagcaatttgttagtagctgcaacaagacactgatatgacaattcaatcatcaattctaatatgcagttctgattatgtgttgctgtcagggagctgattggttaggagtgattgcggatgtgttctttcatgaactcaactttccaaagtctaaaatgaactctaatttccaactacaaatcaacattctcaaaggcatgaatgaatttatcatcactgaacataaatgaggaggattagaagaaggcataaggacagaaaaggcaaacctccaatacaagttgtttctgcaggctgtccacaagttgcagataggtc

SEQ ID NO: 3840 - DNA, 1726 bp, Zea mays
  misc_feature (1)..(100): optimal_loci_85720_G1, chr2:204126017..204127742, Cluster 23
accacatctacagtatggatgataatttaaaatacaccttaatggtttaaagtagccacttatgccaatatgaaataaaatgtaaattaactcctaagctttcattacctacccatatatgtcatcaccaatcataacataaagtaagacttttatatttatagctaacccaactgttataaaaaataaataaaaatatctttcaaatctacactttgatactaattatactgttacgagaaataattcaaaacagtcatagataacgatttgtgtatttctaattatatacttctacaaccataaaagtaagcatagttgtatattaagataaatatttaaaataatatcttacgaaacatagaaaaaatattacttaagaagccacataacaataattatactgacagttcacttaaaattatattactgtgagataataaatttcataagttgttattttaaagtatgtttacatattttaattgaacaatatgccatactatattggtaattagttttgaggattctatgtcgtatttatataatactattacacataattatgtgatgtaaggaattcaacatgttgagtgtgggctttaaataggcaacaactcataagagagagagagacattacaattaaattgtcgtcgtttgcaggtacacaggcgtcaactatggttgacggaactgtgtcgtctttgttatcacttggccaggcctgtaggagtacgtaaagattttccttttccacaatacgtctattggaaaatggaaaggactctggagtcgttggctctgtccacaatgaagaccgaagaagatattcacaactcacaagttgcccacatgttgccgtgctggagggtgcattacaaactacagtctacagctggcatgcatgaatgcgtgcgcgaagggtcaactggaacactatgctcgccggtcgtcgacgaagataaaagtttggcaaatcacgaacatgacatgtggaatgagcgacacaagaacatctcttaatttcactgtaaatatcaagaaaaaaacgaatataaaataaatggcacgcaaaattttcttatattaggccggatggacctaattatatcattacatgtttccatttgtaaattattggcattgtggcatatttgagaaattaattccaaaaattgttgtccttcattttttgattccttgttcgccaaagtctaaatatacagagtggagatgggcagaaaggtcttcaaagttctgactaagatgtgaactaaatgccagatagttaggtttcatcatataatggaatccgtccatccggattttttttcttaatcaagactcagaaataatctgtaaacgatatttttatatataacttttttgaaatttttgaagacatttgtcgcgtcattgggtgttaacgcatacaacgatgtgccagttaagacaagggtgtgtttgattctgttatctagctatctgctatgaaaaaaattgctttctattgtttgctatgaaaaagttgttgtgaattgtctgtgaaaaaagctcaaagtcacttgattcaaaccattatgagttgtctaccatgaataaaatgtatattgtttatatgtattttatttaactatatctcttaatcaatatattcaacaagttttaatattttttatcaaaatattttattagtttcttaaaatatctatatctatactata

SEQ ID NO: 3841 - DNA, 2221 bp, Zea mays
  misc_feature (1)..(100): optimal_loci_90804_G1, chr2:229912009..229914229, Cluster 23
agttcatggggctgttgagtagctattgatggagttgttgcaatctccgataatcaattgtaagaggctcttgtgctcattccccatgagagattcgtgaattgcaacttaagtgaaataatggcttgtggagtgccttttgtataattcttactatgccataagtgtgggcttgacatgtgattccaattagtgcttgaaccacctagcttgggctcgccataatgaggacataggttgtcgacaaggaatcgagcctcagagatataccttgtgtcatctcttgccccatgtggtttgctcactatacttactcttgcaattacattcacttacttattgtatgatattttatcaactagtattgtatagattgtaactagtgataattacattttcttgatatctcttgatagtagctagccttaatcaacatagactaaagacctaactattagaattgtttaaaggctggcataggataaattggttctagtgcaaagtagttgcttgaatgccatttttatattaatcaaactttgctatggtggtttatgagattgtaggataatccttataggctattcacccctctagccatctaggtaccatgcggttagaccatgacaaaggttggtctaaagagaatgggtggtaatgacatgggtttcactatgggttttgaaggttgtatgtatatttctttcttaggtactatgcttggactttttcaatgataccttgcacttcttgtgttgctacactaagatgtttgggtgccaccaaatttatctagtggatcgcaccagataaacaccaaacaaaagagcacatgtgaccatttaaaattgtggttgttggctctgtcatagttgacctttggtcactcatgattagaatgttggtcgaggtggtcagatcaccaaccatgtatatagcctattggaaggcgagacttaatagtttacccctccctatatatagttgagagctcagttctggaggtttctcatccactacaacaaatggatacaaccctctagatcccaaaactcctctcactcacttgtatagcttgaaatctcattcatgtgagattgaagaggctttagcgcattgcaatagtgcgtttacttcttatgtcactaggctagtcattttcgctgaggatatctaaatcctcttggtaattgccatcacttgtcggtttggagcttgtggagatagtttaccattacttggtgattgtgtggggattcaaccagtggctttgtgaggggttttgtgatcttgccataagatttccacaaagatcaactctgaagaggcttgcagaggttcttggttacctaccagcttaacactagtggacaaatcataggggtagagcttgtgtgcttgcatggctagtaaatcagtgatctaataggatccacctcaatgcaaattaagttgacattggaataaattcatgtatcacttgcacttgttggtttattcttgtatttatattgcaaaacttgtgcttatgtagttgtttgtgtagtagtagctctctagtgagtagagtatgtagttcagatcttttgcttgtgtagctcactagttattgctgattcctctagtaactttcatgttttagttgttttatttaaacctgctattagaattatgaaggaatgattgctttaaaatgaatagaaaatgcaaaaattggccattaggattatcttttatacttaccaacatgtctagtgctatgaccgtagagaattttaataggctatccgttcccctctagttgtccgtagctcctttcactaaatgtaacactaccagtgcccataaaaactagaagtgatcttagaatatcactgcttgttgtagcaaaaaaaatggtagtgatacatcacatatgattgcaagccaaataagcaattatatgtatcgtatcactatcagttattggctacaacttgtagtgccattactatccttatttgataaaatcttatccattttcactacatgttttttactacatcaaacatttattgataaatttggataatttctctagtgagaagtggattctcccaaatgccattaaacttgtgggcttcaccacattgcctatgaaatgtgcataaccttctgaaatgcgatttcacaattctgattctagtttaatcactttttgtaaaaacaagtaccttcgatg

SEQ ID NO: 3842 - DNA, 1793 bp, Zea mays
  misc_feature (1)..(100): optimal_loci_92289_G1, chr3:1092662..1094454, Cluster 23
tctctctcatctgacatgaataatgtatgagtgtcgtgttgtagagtattatgtgaagccatcaacctgtaagctttcataattatccgcacgcaggaggacgtccaactgtgcccagaaaacattgcagctcaaaattgctacacccatatcaaaattgcaagtactcgtctttatttttactacactctaggactgaatgtatgttttattcttcccacaggtctgttcacaaattgcagctcagcgtgcagccaatcctaaccttgataaactatatattacaaaagtgagtagctctataggtcctgctcatgagctttttatggatactgttgattacactcgtaatgactatttccatttgactttttcgttaaagtccgtgaagaaattgtttcttgtgcctagcaaacgctttaaatgcaatgaaatggttagatcttgatcacacactattttttgttactaagtgactatgattgtcaagaaaagctaaattcagccttttttagatatttcactctgattgttttgcaataatatcgtataataatgctctatattttttgtgaggccttttttcttaattctggactgcagaagacaatttaggtagaagctttgacttcttttttactgcttgaaggaatataaaacattaaaacccgcttagtagatgcgtactataataaaacatatagtctccaattttctattttatttcatgtttttgttatgttatctctgtatttctaacaatcagtagttgtctatatatatcattctcttgaaaagcttatttgattttgatatctgtattactagcagcctgacatcatattctaattattacagaatgataaagatgtctttatagagtcacttatttgcagattagataataaatgtgataaacttttgatatgtaaattggactctgaattcagcatgcctcaagtaagtatatgcaatttggatcatagcattacatttttcatgctagcgtacttttatgaaaataataatattctttagaattgacaaaaatatttagatgtgtgttaaaataacctacttacctttattctagcaatgttgttagttaacacaagataaacattaattagaaccacttttgtaattaataattaatagaaggggtatgtatttaatttgatggtggccatgcttggaaatgtaagctgccttcgtctgagggcccaaaagcattgagttgttagagctgtcacataatttgcatttagtacccttaaatttcaagtatagaccaaccaaacctcacatataggtaatggaggaactcaactctcggttggaattgtgtgggcctttcacgttctgattttgcactgaattccacgtctgtgcttgcaattacagaaaataaagttgtactcatgaacatttatcatttgtactctgctgtctagccaaagttgtgtaggcagttctgctaaataaacggccaaaattagggtaatttaagaacaactaaagaacggcaacacaactggtttggactagaaacatggtagttttttttttctggtgtttgaggtgtgttttgtccagctacctgagttgtttaagagttgcagtgaataattactgtggttataactcgatggagcagagtaggatcatgactgattctgaaatagttttatatcttgacttatcagcaacacacaatatctttacttggttacaacataacttgatttagtttttattggtataatactatgatgtatgcattttttgaatga

SEQ ID NO: 3843 - DNA, 2665 bp, Zea mays
  misc_feature (1)..(100): optimal_loci_9383_G1, chr1:49375497..49378161, Cluster 23
gttataattgtcaatctcatccaccttgtctagattgtcccaaatatcgtcattaatttgaaattagttgccacaggcagggccaaaaaggtcatagtagtaaatggtagcatgctctaacaaattatcatctccctcaatcttcttgccatcctcttcaaaaaaactcaatatagttttattttttttccattggcaactctatgaaaaaaactcattattgccatcgcccttaagaagccaagtttcatgagatctctatctccagtacatctcctcttcttccatcatcataatattttcacttaacatcctgacttttggttccatctggaggccatttaagcccctctcctcttcaattctctctagctcggctaaccaaagttggttttggattttcctttttttttctttttccacctttttcattctagacccaaccttttagaaactgtttgcaaagcttcagcttttgctgaactttatcaagggaacttttggttctacaaggcttcccccatattctttctatatgctccaaaaatttaagatgagagagccaaccaatctcaaaacgaaagacaaactgcttatcctcattcactatttcagttaaaacgagcaaggggttgtgatcagataattcccaaggaagctttcttatgtggaccaaaggatagatggtctcccaatcttcgctcattaaaattttgtccagcttaactagtgtggggtcattttggttatttgaccaagtgaaaccaccacagggcatctagatctcaattaattcatacttatgaatcaaatcattgaaaagatcagaatgcttatgcagaccacattttttatttctttcattagaaaatctaatgatattaaagtcccctcccacaatgttgggatctttattattttcacaaaatactgccatttcaactagaaagtcatttttctccttgtcatgggcagggccataaacagctccaaggatccattttctatggaaattcttatcccaaacaatcaactttatcatataatctccttgattaaaataccctacatccaactcctccatattgattcccaccaaaataccaccagatttaccattagagggcatgcaaacctagagataaacttcagaaggatcgaaccctttgaccatatctcattatattcatcaatcatagtctccaacagacatatgaaagcaaacttgtgaaacttaatcaaatcctacaaataaacagatagtcctttcttccttatgccactacagttccaaaagaggcctttcattgtaaaacacttgaggttttgtcatccatctttacaagaggattccccttgtcacactccccttttttagcctttttcctcgagaacattttcttttgtttcttagtctattttttctagattgaactagaacaaaatccccttgtgcacctctatcatcataatgctcatactccacctcacttacgttattttcatcaatcgcttctaaaccatccttacactgcttttaatcacttgcaattttttctgatttagattgtgtctagatagttccatttctttaatttggtcagcaatatcaaagttttgatcactaattttaacccccattttttgaaaccttaatgatatcttaaaaaggtaaaccagaaaatttatcaggtttctgggaattaccttcaagatttctcttggcatccatccttctatttttctcctcgattctaattccactgtcctttttgagcctctcgctgacccttctttcctggggagcttcaactttttttttctttttggcaggaaccatacctccaggtagatcatttgtcctacaaactttttcacccccttcttcacctttttcaccttgagaagcattcaagacaatactgtcttgggtagacctcacattctcctctatatcatgttgtcccttaatgatttcttcaatcaccatcgagctcttagcaacagacttttgtttaaagatttcctcattcaccttctcactccccttatcttgtattttccacacatttatgttagaagaaccacaaatttccatgcctccaccaaaattttcttccccaaacatatcattgtttcttcagcttcactgtctgttatttgaaccttttcttcgttatccatatgatgttttccaagactccttcgtaatattgccttcctctatcaccttctttcctttgttagcctccacaattttagtgaaactagactaagttttcttcataatcttttgatcattgtattttccattgctaccttttccaagtttagggaattgttcacctctttcaaacttggtgcttagcagtatgatgcttgtttccctcactgctgactgcagttttcaatttctcctcatcttcatcagcttgaacttctctcttgaagaagaaatcataaatgtacatgcccaaagcactctcaacaacctcagggactgcactaacctctctacaagcaattcgagctctgacatattcattacgcaatccggatttttcatcaatctccaccactttacccaccaaaccaccaatttttgcaatagttttgatagacctttgttccatcggaatcccacggattctgaacaaacctctct

SEQ ID NO: 3844 - DNA, 1711 bp, Zea mays
  misc_feature (1)..(100): optimal_loci_94317_G1, chr3:11220476..11222186, Cluster 23
tagctgcaaaagtgagtcatgtcttttttagtcatttctctgaagcacctacaggatgcagctatcctggagaaactgattgacacaaaaaatagagaactaaaggtcacagcaaacaataaccaatgagccacaaaagtccgaatcaaattaaggccctgggatggagacataacagagcacaagctggtccaccagaccaccactgcgtactgcagcaccggttctactaccaccaaccaaacagacctgattttgaagaaagcagtgagcaagtgacagagaatgcatatacaagtccccttcaactgtaccttccggcacagaccaaatgacaggatccagagggtctaccgtcacatggcacagcagatcctccggaaagcttcccgtctgttaacaaactgtacctccgacagcagtccgcccatccggtgcacagctgtgatcgggctgtggaacggcgtattttaacaaagacagacagcccccaaagctaccgataccgccacagagaacaaatcacagggacacgccaaccgagccttctccccactctaaaaatatgatgagcagagcatgcttggagttggaatgcacacccctgtggatccagcttatggacttaccctcgaagaccccaactctacatagttatactaccattgcagttgcaggcccccagtacactccctaagaggcttaccactgtgctactctaattcttcattaagtagcacttttggtttttgtctaatttgattaggttggcacagtaagttcaacagcagcagcgcgctaagctgcttcgtgatgattggagtcctttcagcttttattgccctcaaatctgttaatcgataaatgacttcaatgctcttcccattaagttagctgcatccactgacatgcacagtgcaggaagcaaagcaagattggaacaagtttttcactatcataacttctagtggggcttgacccaacaacgtggtccaatctggaaaaggaacgcacaaataagacactgtatgtttggagatcccagatttgaagaaaagtaaacagatagctgctagcgttacatattctgcatattgctagcgtttgtacgatttgataaagagcaaatacatgtgctaatcatgaaacttccaatagttatccaaaaaaagttctgtatcctaaaattctcaagaagttcacagttaacacaagctaggctaataggataatgaatccaatgatcactggatagggacggggagagaaagaaaaaggcatgtttgatgctattgctaattcagtgaattcttatgtacttgctatttgctaaaaggtgtttatctttaatcagcatgtggtggaggagaatttgatgaattcgaacaaaattatatgctactagtacaacaccaaatatttcatttttagccaattaatgctaaatcaaatgaagatcatgcagtttaggcaaaggggaaaaaaattcaccacgttccagagggccttatagtttgatttttaatttagatggtaaaaggatcaagatggttaaggggggattgaattaagcttatctaaaaattctcgcagcaatttaattctatcatatagcacacttcacccctgtgtctaagtgttttttttattctatcacaaagttttgttcctcggtttcaactgtattttagcatggcaattatagtaaaga

SEQ ID NO: 3845 - DNA, 1659 bp, Zea mays
  misc_feature (1)..(100): optimal_loci_95111_G1, chr3:15880477..15882135, Cluster 23
gtagtattattgtaatctttatgtttaatgtatgcaattttcatgcttatttgttgagtgtcaaactttatatctatatatcaaattgtttaccaaatttactatgaaattatatgtatattagatagaattttacataaaaattttgttgtggcacaccctatgtaaaaatcctagatccgccactgctagtggatgccttgatatagtgaacgtgttagggactcagggttggcagaatccatcatcgttagaccattaacataatgacatccatgtgagatgagactgatgaactacttaggtgtgctactacgtaccggacttctcactggccattgcatgaactacttggtttcttttcacgtcgtatgtctcttcagagacctcactgactgagcagtgagcacaggtttatattgtctatctaacagatcctgaaactctctttgttgttcaggttatcaggattcaatatttacagttgataggaattctgacgataactctgtaggtagagctgccgctggaacttctcatgtgacagcttatttttgtctgattctgtataagacttgaatgttcgtgtagaattggtggcactgtaatagtctatttgtttttaaaaatgaaaccaaaaggcctggcgcagcatgctaccactcctattatatggcagcttattagcagtgaataatgccggtcaaaagtccacctatcaaaatagataattttcactactctgattttctttgctttggaaaggaacttcaagtttccttcatttcaaatagtatgatacatatgatccctttattttctttggtatgagctgttatagatggttgaaattgattgaaacgctaagaacacttgagaactttataaactatttgtcgaacaaattggaagaaggaatcatccaaacacttgtttgaactcggttggttatgtcgagattaaaaaaaggattgaaagacatggtcggtatcatgacaactaagacataaagaacaaatgggacaagtgaaagaataattcaaggtatgtaagaggttgatgatgaggcagaccgatacgtgttggaaaggcagggaagaattcatgttcgggaatctctttcacttgacgaacaagtgagatacattagaaaggcaaacattccaactcaaaatgttatggtcctctgcactcgtggatgtggcatcatacctacccctgtggcggatatgatagccaagtagtgaaggacatctcgaacactgccactattgaaggcatggcccttggtataaaactccaagaacaagataagaacagggcagtcaagcttagccaatggaatatgaggtttatgtaactgctctcctccattgcattataaaagggaggcgggagtaacattaggggatttagatcactcaaacggattttgataccagattcatagttcactcttacaatggacatacataaagatggactgggacaattagtctaaaactcaaaccacgaccaagaggtcagggagagttataaggtattgatgctcaatggatgtaggatattatgcacacaatggctcaaacctctctaactgctagtgtattggctcccacttatgcccaagtttagcatgactactgacatgtgtcgtgc

SEQ ID NO: 3846 - DNA, 1451 bp, Zea mays
  misc_feature (1)..(100): optimal_loci_96849_G1, chr3:25315353..25316803, Cluster 23
atcaaactacattcattttgttacttataatgctataacttataatttgttctctaatggtggactttgctctttattacatgatgaacaggttactgatttttatcaacaatatatttgcttctagagttagcagacacaactctaatgacactcaatttctgtgaacttggtttttgttagacttgctttattgttgtttttatgaatgagacttggtcattttaatatgatggttgaatgttgttaatgtgaagttgaatcgatgatatgtgtagacttagttatttgaatttaatggatgaatggcatttgatgaatattgaatgacataaatatgtgtatgtgatgttgaatcgtgaatggatgatatgtgatttgtatatggatatataacgggattttggaccctaaaagtgacttattttttgcagacctagttagccatcgtggttgtcccctagccaccaaaaataaattattttcagtgtctactataaaaaataagtgttattttcgattacaaacttccaactgtggcctaacaccaaaaataaacttatagccgacgaaaacaagttatcttttggtgggaaacacttatttttggctaccaaaagtttatagaattcttgtagttgtgttatctttgttagaagcttatgggttatacctatattagggaattacaaaacaaatatatactgattttaataatgagtttatctctaaggttttcatctattcaaacaaaatagaagagtttgattaaatcgctacatatacaatcaatctacataggacttttttctaataagccatactaggcccatgggtgatcctacttgatctgatagcagatctctaaagagatgaccgatctgtagcatacgtgccagctcttaggctatgtctcgcataatggcatggcctcacgcacgataggtatcgaccatcacgaacatagacatgcattacaatcggttgtcggtgggtctaccaatcggtcagcatggtcgataccgactgtgtcgggactatgctagtcagtatcgattgattggtattgaccctcacttttgagttcgagtcgataccgactaggtctggtcagtacatatagcctggttctaacatggtaggtttttattggttggtaccattttaatcgtttatatttcaaaaaaatctttaaaataaaaaattgtaaagccaccatgtaaatagagggtgtttagattcattcacacccatcactctccaaatcacaagccttattctctttctgtagcctttcactctttgtcttgatatggatatatccaaggtggagtctgaactttgatacgtccaccgacttactcaacgagcaatctccacaatatctcaagacccataccggtatgggacaagtcttctttgatggtatttctcattgaaggaaacatgtg

SEQ ID NO: 3847 - DNA, 2140 bp, Zea mays
  misc_feature (1)..(100): optimal_loci_97851_G1, chr3:30524212..30526351, Cluster 23
agactcacaagcaagtgctctcaagaaccactctgtgcccaagtacatctattaaaacctcaattgcacaaagacgatgacccatgtgcctggaatggctggcatctgcaacttgctgatgtatcgacaacaggaactgcaatagattaagaggacagatggaacttgatcataatcacaccacactctacaagattgtgtatatttacatatctaagtcatgctcgtttagtttatacgcaaaaacttatattatttgttttcacagaaagaagaccatttcgaccatttcgtgctattacaatactgtttgtagagagaaatgagatagaaaagtgaacaccttatgcccactaacaggacaagctacaaaaatattcagggaaactcattttttaatgaaggacaaaataagtaattattttaatcacaatgtaatcaaaccacaagtacagttttaaagttgctgtttagatgtatccagcaaaaacaaacaaattggatagtgatctctatgtaatcaaaccataaatatcaaaacaaattggataatgatgaatacgcaacttattgtttaaataaacatgcaaatgggtttcgtattgatgtagtgtattcttagtttgatgttgaaatattgtttgtttgtttttttcctgaattcttaatagttcatcatcaaagtatgatatatcctagatgacaaattccatatcacctttcttgtactacaagaataaatttaaagcacatatgggatactgcaaaaggatcctcagtttgttcatagagatatctgggagcatagagtgtgatttacttctctactttccttgtttgatgtgtgccccctggcctctctgtttgattagatgcacggcatctgcttgatgcatgtagatgtggatctggttgaagactaatcgcgactagtcgactggtcggtagctatacgactagggtcaactagacgacttgaaaacattgagccctacactaagctttgctcctgagagcatgtatatacagcataaaattttggacaagtgtcacgattatttaaagaaagtacaaattctttcaatcaagtttgccatatgtccaaataaactaatgtttgtctcgatttactacctccaactacttgagttggttcaatttagccattaacaagatatgttatttttggttctaaagcatacaagtttgagtttaatatcgtgaggttatatatgacatcatactttattttaaaaatgaacacatgttaaatttttcatcattattttgatagcttagcaaatttaataataaattaacactagagatataaaacagtacaaaacactatagagggggtgttaaggtataatagtcaagggtattagtgtaatctccaagtccagggtattagtccaatctccaagtttagggtttccctcttgtctctttcatgtatctatatatagtagtcgtattgggcctcaatattatcatccaattcagcctctatattactaacaactaactgccacctgctggttttccagtgcacactaaaaacatgaccagtgagcgaagaactgccaccacggctttgcactaaatcaaaccagccaaggaaaccccaaaccctggggtcaccctattgatccgcaccataatctggatggtggccactgccactacggacgccttgcataatctgagcggttaccacatattcacacgctgccactatttttggtgtgaagcacagcacggtttttttctttcttgcagacgaggatttgaaacccggtattaacagtattgtcatattataccacttcctcaactcaataactgcattctctagtccaggtaaggaaccctgatctataccaacaaagataaaggcattgcagcagctaggggctaggcagtgccctcaaaaaaacatgagggttagacaaatgcattatcctttgcagaatttgaattcataaaaatgataatcatgagacaaacagaataccttaaaaactctgtcagcacgaaatatattaactttatcactaacaactgtatcagccaagttatcatccctgaaatgtgaaaagtcagtcctgatactggaataatgattgaattataatgt

SEQ ID NO: 3848 - DNA, 2029 bp, Zea mays
  misc_feature (1)..(100): optimal_loci_99490_G1, chr3:41133334..41135362, Cluster 23
tacgacatctctgaaaatacttttggacatttttacgtaggaaaaggtctacttaataactccctcaaactattgaaaaacttctaaggaacctcctgagacgattttgatgttttttttcaaatgtatcatttttagaagtctatataaccacataccatatcaagggtctatataacccctacctataatattgtaaacaataaccaaaaaataaaataccagctcatcaggttttaactccttatttacagatgtctttttcttaattgttttctttgatatgtttgcctttagtatatgaatttaacagtatatccgcaacatcaatgaaaaaagtggaataaataaataataataagagatagaacaaattaaatatataagattgaaagatattaagacaaatgattatagcagaaaattatgcaatgacaaaagaacaagaaacatatgcaacttattctatcatagagcagacttggtgttgaaggctctaacaacatgagtgggggaagggatataaactgaggcaagctttctctcgtaaatgcggaaggctgcttcgagcctgtggccaataactgagtgagacagctcttacctgtacactagacatgccctatttgtaccaataataggagtaaaaaattcaaattttaatttggtattttgagttctaattcctagttcatgtcttaaaatttatgagaaatgcagacatatgatccctagtaggtgtgttaaatgtttgtgttctaattcctgatttttgtattttctgctattgtttgcaatattataggcaaagggttatatagactcttgatatgttagggggttatataaacttctaaagatgacacatcatcaaaatcacctttaaaattgactcaagaaattatttagacgattttcaatagtttgaggtttttttcgacggttttataggtgggagtgaaatagacaaccatccatagtcgagggtgctaaatagatttttttttcttttttacatacatagtccaagaaaataaaagcaagaagggttggatgagaacagtgctgtgctgacactataattctcggaccacagagttgttgccctgctactgccctgaatctttggtaaagaatcaacataggtggagatatataatgcaaaacaaaaaaaaaaagaaaaacagcagagtttaatgaaggctcagtgttcaagggacatgatctgtaactggcagagtagatttgcaccagcagcaaaaatgtatacacggttttatcaaaatcctccaaccatcgagagacttgatatatctggatagccttcagtaaaccaggcatctggagtttagtacaagcacataactgatggcttaaacttcgtgcagctctggtggcaacactgcaagtctgcagactactgcagcattagatgaacagatctgctttatactaaaaaaaatatgcagcacattgctgaggcttgtcatcttgtatctgagctgttatcatgtaaggttttcataccatactagcttgagcctgcaagacatgctcacgccctgttaatagaactggaagaattttgtaggagtagaataaaaagcatctgttcgtcattttcttcttcagacaacaaaattctttactcttaacaagaaaacttacaatgtgcatggttcatactcttgaagcactccgcacattagaagcatcacttgctttagacctgttcatgatattatagtgttccggcattccaattagcagagtggtggtgacctgtggaaattatttcacatattgggtcctggttcgtatcggtggccttagagcacatctttagtagtcatttttgtagaggaaaacccagattttatagaaagcttgtaacaatacaattggtagtcattttaggtgctgttacttttcgtgcctgctttccatcactttttttttcatgaacttctcatgctgagttgctggctacacccaactactgcaggtacagagccgtgacaagtgctta

SEQ ID NO: 3849 - DNA, 2606 bp, Zea mays
  misc_feature (1)..(100): optimal_loci_81941_G1, chr2:181418576..181421181, Cluster 24
cctgtgcggcctttttttcattagacttggtctcctacataatttgtctcgctagcgttggtgcagtgaatgcagcagccacgagtcagtgtaagtcagttgactcgctgtttatttatgcagcaacgacccaacattattcatggcgagctagccggctagcgtgataaatgaccgatgatccagctccggatcgattgatagtaccttggatgggcacaactgctgttcatgttcccggccgccgtagatttttattttttccgtgaggacagcggagctgctagcgatctgctgtgtatagatagcttcagtgcttttacagactgggagagagatcaaaaggaggcactgcaggacacacacgtcacacctcacacgcatatctgccgatgccgtcgacgtcgtcttcgatctcgtgctgttcttcagctttacagccggtggaagagctagtagtagtagtaaagaggagcgaagactggaagagagagagagagaggggtacagcatgcatgcagctgatgatgatcagctctgctactcctgagtgctggctagctagctacactaccataccaataagtcacctcacatgtgcagtgttgtaggggcatgcatttatgcctctttcgtttctcttttcatctgcagcattcaattccatcactctgagtgagtatgtgctcctatactgcacattgtttttttttccttctaatctatttccctctctctctcgtttgcattgaccatgtctcattgaagctaagatttctcaccattgcatgtgttccttctccatgcaccttcatgcactgaaatttttgagcggtttaagtagttgagcaatattttatcattcacatgcctcaactggagcactcatgcatgcagcggtcgatcgaaagtgctgaacctttccatcaaccatcatgaggtcatggcttgcatgagatggagcgccttggctgtttctttttttattacagcttcagctaggtgcgggtgcggctcatgtatgcacgccgggtgcagcagggcagggccgagaaagcagggaaaaggaagatgtcaatggcgccctacaaaatctgcaagcgcgagagccggacgcggcaattactcccgtcagtccctatactatacgtttccaaggccgcatcatccgcatggcattgcactgcgtccggggtcccttgttgccttgccctttactctgatggcctttttttttctttgtttcctatggctgccgctgcctggtgcatgcgtatccatgaggaggctggttagtatagtacatgcatgcaattcagagcagcatcgtcatggcggtcgtcccgttgtctcgcaccagtgctgcgcggccactcctgcagaatccaagcgatgcttggatatgtttttctgtgtgtttctgatcgggcttgaatgctgaaaggcaccactacaccactagtatgcatgcatgccatagcaaggggtcgttgacatcaagcaaaaacagacaccaaatccataagcagctgcagtagctagaggcaagagaagtgcatttactatttacctagggcgcgcgctatatatatccatgttcttggtgtgactgaaaatggaagttcgttaacaaaaatccgaggaccagaactggcagtggactgctgtataataaagctggtgcccttagttttggtggtgtgctcacttatactcttagttgtgtttttggctcagttttgcccttccactgctatagaacagaaagacaaaacagagaaaaaaaacacgactaaaggtataagtgaacacaccaccaaaattgagggcaccaacttttatggtagatagacaaaattgctccacttttgattaaaacacattcagtagtataaaataatgaaatatttgctccacttttgattaaaacacattcagtagtatgaaatatttactcaatgtgtgtccgagagtctccgtgacaaggcaaaaacaaagatcggctaatacaatcataacgcgaccatgcaataatatgatctatgtgcaagggtggatctagccctaggttgtccgggttgcagcagggcgtggcccaaagatccctttaatagctcctttatgtcaatattggtaatcttgagttacaaagaatgaaaaggcacagattatgtggttgatcaacgaaaatatatatttagcttaaactaacacggactaaaaatctcttacactattttttagctctttttaagatgttttcagatctggccactgaatatgtgtaacttagtatatgtagtgatcgatattcactgtaatagtctaaatttgtgcttatgaatgagtaaagctttgataaatactttaatatggataccatctttttgagcctagtgtatagtaagtgatcttattgaactattggtcacggtaaaaaaacctttttattagggcttgtttgggtccaattcccttgctcttaaacaagcctttagagtgtctaactgtcgccggtatgatataacttttatacatataccacttgtaataactaattaagacaaagagccagaatagagctataccgattgatgaatagtaac

SEQ ID NO: 3850 - DNA, 1682 bp, Zea mays
  misc_feature (1)..(100): optimal_loci_112169_G1, chr3:125709493..125711174, Cluster 24
tcttagaagccggaccttaaaatttaaacatcatgttcacatcttaaatttttcacaaaattaattgattttttaaatgagtaagaattatgatatgctaatttgtgtacaatgtgtagctagattcatgtgtggattccaccttagaagccgaaccttaaaattaaacgtcgcgttcacaccttaaaattttcataaaattaattgtttttttgaaatgagtaagaatgataatatgttaacttgtatgcaacaatatagctagattcatctatgggtcccacatatatgtctagtgtgtggtgagggttggaacgcattccaatcccacttcaccaacccacctaatttggctctaaaactcatttccacccatctaaacaacacttatatcaacatcttcctattaaatccattacaacccgatccattagaaggcctactatctgactgacttctgcgacccaacaccacgacaaaactcgctcgctatgcatgtatgtacaaatgaaatgagcgaggcatcgactcggacgaacgatagaataacgggcagccttgcttttaggcgccatttagtttataaaatataacgtaaataataataataatttatatttaaatatcaacggtaataaatataaatagattggtatccctttttggtgtgatatccgataacattaaatttaaataaatatgatttaactttatcggttaaccatcacttatcaatcgctgcacgtctccatttctccggacggatgcatgcaccccgagatgtccgccagataaagaatcggatggcacgtcgttttaagaggcaatgcaaatgtcgagagttgagacgacagagcaagcatgcatgcacggttgtcgtccattctctgattgtttgctttgaattaaaactagttatttgatgcagctttagtttatgaaaacaaaacggtgtactctctctgtccataatgcccgtaccatacaaaggctgctctgatttgtaataattaaatcttgatatcagagaagagaaggctaaaaaagctactaaaattagctagtccataacgagagtatacttatttaggataaaatctattttttttgtaaatatacttattttggaacataggagagtacatatgtatgtacgccatatgtctacctcgtcagtgtcgaaaagagtgaaggtggtgccacgagatggagaaggtctcaatagtctccaggaaggcgtctcgagcttatgggctagattgggtgaactaattctggcccaagtcatctgtagagcgatactgctgttcggtaacaatggaccaggatctggtgccccatcgctgtctcacgagacaacgattgatgacgatgatgacataggataggaggagcagttcgagatgattctcgctatgtcgggagagagaagaactcgaagcctggaagtgggtctttgagctcaagtgatcatgacaaaggtaaagacagcgaacgcgggcctcggcgcttggaaagccggtagtcgacaatcgggtggctggtttgtagtactatgtcgttaacagacttggcgagtgtgtcgaacaactcatcagtgacgatgtctctctagagaaaagggggagccaatcgagcctttcgcttcagattatgaggctcatcgcttcagattaaagtta

SEQ ID NO: 3851 - DNA, 1672 bp, Zea mays
  misc_feature (1)..(100): optimal_loci_112558_G1, chr3:127693228..127694899, Cluster 24
aagcagagggatggcctccatatcatcagtaagtaattaaaattttctcttgcgtgtgtcagctcctagggcgttcttcttatgcttagagacggtcctaacattattcttttgtaattacacatatggttgcataggagctcgactcctataaatagatacacatatgtgagcgtcgaaggggtcaaccattcgtggttttttactgacgtcatctctagtcggccgagagcttccgaaggtataattctacttctgaagatcttgtctctattgttatacgcctttcactactcttccacacctgaacttattatattttacagcatattggttttttctctttaattgctatttgccttaaaactatttctttatgtaatgatatatcttgcttatcaataacacggataaaagtcccacgcgccatcttctccctccttgacgaagtatacgaaacaccgacaaattcctgtaattattcttttgtgattattcttttagaccctagatattgtgtgatatcgtgacaagagcctggttttggttgcaagcgcatattgtcaaagcttgcctcacaaaaaaaaaaattcactctacgagttccagcagtcaacgtgtggaatatagcaggaaaaagaaaagacctggcgctctcgaagtctgaaaagcaagctcacttacgtcggatttctaaaagaaatattggttgatgggatattttgtgcgcaagtttctggtctcaattttgtagtgaggatgtttcttccgaaagcacgggattcatgctggatttacgtatccatcgacgagtggtggtgatggtgccatttcaaggcatggtggatttacatgatccgcaggtccttgttgaaattggtgggacgtgcagaaggatgagaatgtgaggttggtcatcgaaggcgtcttcaacaaatcatgtaaaacactgttttatttgcatgtatagtagggtttgaagacgtgatagagaatgcgatagaagagttgctggcgatttgccatatagataatgttgtttgcagagtagagttttaagtagagatgtgtaatagagaatgagataagagaagtaccatttaaaattagattattattttttgtacatatgtatttgtcgtagtctaaaatggtaaatacatatttaattatgtgtttcattcatagttagaatataagaagttttagagggagagagaatactctagatttggagacaagagtacctgctcctaaatttagggtttagggtttatagtgtgtggatgagtggaatatcagcagaaaaggatgcgctctgaaaagtctgaacagcaacctcacttgactattgaccggacttgcagtgcagtcagtactacggttggttcttcttcaggcatcacgtcagatttccgaaaacagttgtaatgtcggcaacttcaagagaaaattgttttggattgttgacccagtaggccagtatacgcgcgctctactctatagtccagacaaggtacactgaaaggattgatttgaaacgttgatgcagttagaaaaaaaaaagtgacgattgcaaccaactcgttcgataaattttctcatcgtgtcgtggttgtaaaagaaaaggaaaaatactgtagcttatttatttatttatttatttttgata

SEQ ID NO: 3852 - DNA, 1740 bp, Zea mays
  misc_feature (1)..(100): optimal_loci_11532_G1, chr1:62694623..62696362, Cluster 24
tgactttgcatcatacattggtactcactcccttccaaataataagctattttaattgtttactagaacgtacttgctatgatttttatttatgtttaagtatagagtataaaatataaaacttaaaaatatgtgtgttttactggctagttgggtgtgaacgtggtttagagtcagcaatcataattcaaatcctcatttatacataattttagcattgttcaatttaagtatgggagggtacgacgatgatagaaacaagcagaaaaattgatgctttaatatagtagagattacgggacaaagcatcttattttttgaaaaaagtcataaaaatttatgacacaaaataaatatactataaaattataactaataaaaaatctaatagtacataattagcattatatatataattaaatttaacatactttaaccctctagaaaaaccaaaattattttagcccctgccccggcctcgatgccaagcgtccccacctccccgcaaagaatccgggccgatcacatctggcccaatcactcttgccctccaaagcagcgttatccacgctctatcctcgccaccgccaaagcaaagcactattgccctgacataaacgaacaatcgtaccgtctactttgcttgtggcagtgtttgccaaacgaattggttgagtgatagatatttatatcattgaagcaactagtgtgaaagaaaagattaagggtctgtttgtttgaaagcccttaatttctaaggaactgatttatgaaaactaaggtggtttcaagcataccagtatatgtttcaatttatagaaactgaatttctagtcttttctagctaaaactaggttatagaaattgatatggttccaaacaccattagtttttttttcataaaccagtttttagaaactggattcctaaaagctatgttgctttcaaacagggtctaatttttaaaagaccttctatctgtactatactgcaaactagtaaaaaaagttcattttttattggcggggtagtttgatttcaccgagggtggtctgaactggctagagtgagggtgagtaaaaatggagaattcccactagaactaattttaaaattaccaggacaaacacatcttcattagcgatacctttataccaattgttagtgtaaatatatttgtatcgtcagattagttacaaacttacatatttgtatcgtcagattagttacatcaacaaaattgcaaatggtttcatgacaaataaaaaaataaaaaacaaggctaagcactggatctcgtactcgtactagtgatcaaaactaaacaacaagctaacaatagcacatacaactacagtagcaagagataaggcatgtaaagcgatagcgtagataatgcaagttacaaaagagagagagagagattgtattctctcaaggtctgttggcttaccaacagcctacttcacattgagactaaggatcgagatatcaactaaaggaatatgtgattaagagaaacttgaaattttaaccctcacaacatgttaaatgtcaagtataaataattatggtcctaatcaggctttctgacaatgatcaagaattctgatcttgcaaatacaaaacctaaactgtctatggattttctagtaaaatatagatatgtgtttactatatatatgtagggaagtatgatgagcaagtttcatgtgatggttttgcctaaatggttcacaa

SEQ ID NO: 3853 - DNA, 1527 bp, Zea mays
  misc_feature (1)..(100): optimal_loci_119631_G1, chr3:171026982..171028508, Cluster 24
aacgggcctacatattacatagcctaacagtctaaaagacagtgatgcagttttgacgttttccattgacttcagtacaattttgatatcaaaccaaaagaatcaatcatcttatggaactatatttatatccataggtggatcgtcaaaatagagatgaaaattgaataaatcatgagaaaagttagattaattcatgaacttgtgcatgacaacttattatatttgagattggatgagtaccatggcttcaacatcaaacattagattcttgttcatctttgtcattaagcaaaagagatagatttggccattttatagtttttccttgcaagaatcatagaaatgctattagagataagtccaacaaatctatgagatgactaggctatggatgatcttgatctttctcttgatatgatggagcaattataacgctttatcttgcatccatgcatagattaatcaagagttggggcttgagaaattattacaagaaaatgaggatagagagagagagagagctcttgagctcaccaagaatggagatggagatctccactttgatattgggatagtggtgttgatcacttcattttctttatctttttctcctctcctttctctccttagttcatcatgttcttcacttgacaagagggaggttttccaagtcacagagtaacatgtaactttttcatgcaggaggctagttttttcaagtgccaaaagattgggagcttaggttgagagttgttggagatgtgttgtttttaatcttgccaagttttgggaactcttgaggatgctcttaggagaatcataaatggaaactactccttctttccacatttatttttttgaaaataaatcaatactaaaatatcaagttttagcacggggtagatgtcttcttttaaaaagtctttcctaatgtattttcaagtatgatgtatgtatgaggggtgcaccaaagtgatagtgcagcatgaatattcctccatataaccttaccaaatctcgcatacatagagctatctaaatgtcacattagctagtcaatccatattctttaataaggtcattcaaatgccacttctgcatatttgtatattttattgtgcttaagctagtttgtttataaatttgacataataacatacatagttgggttaaaatatctagccataaatagcctcatcttgctttgcatcaaacctattgactctagcaaccccttaaccccaacccagcactaaacaaccttacctctgcactattatgatagccaaccatcacaaacctcctcccataaacttctatatataacaacatgccataatggagtacaacgccccaaaatacaggcatcacatagtttctcggggattttgacgaatatcgccacggtgccacctcacaaccctccaacgccacccctcaaccccacccactcacataccaccaacaaccacccccataaatctcattatataaatcaatatgcatcgttagatcaaaatgtcc

SEQ ID NO: 3854 - DNA, 2273 bp, Zea mays
  misc_feature (1)..(100): optimal_loci_121292_G1, chr3:180934169..180936441, Cluster 24
ctgtcatggttgattcaggcgacctagatgtggaatctttcgaaggatcccatctggtcttggttgccaccggatcagactcatttgaggtaatcacaagttcagtcaagtgcgccaatgccttctctatcttatgatgccccctcttgtaaattcaattttggcattatattcatgtcatgagacatgaaaacaatagattggagctaatggacacgggttattgacatattcgtaccggatgattttcttcccaataagtttctttttagttccattgctttccccatttccctttatataatttttctatggatccatattggcatttacacccctaactagcacctgttgtcaccctgatcaatacatcaactactttagcacaatgacacatatattacctgctacattttttcatttggtcaggtggtgtcttataaaagtaagtatataaataggtgaaacaaacagtgaggaaacagatggtctggactgtggagaattatatatacactcagatttgtttattttatgaatgtattcactacattggttgccattctcacttttttatactggcataatgatggttggttaaggaaatggtctgctttacaatggtttttctataaatatcaaattaacttggtagtcccaacacgagagcaagaagctctaaggctttgctagctgtttgtgccatgaaatttactttgatagaataatcgttcaactaagtttcggtctcgtattggtggttatcaaacctggagaggataaatcaattgctggcgttgtcactgagagaggtaatgaacaatttttgtactcttggcatttaacttgtggcctgtgggtatgatggaaaaaatgcaaaatcatgtaacactacctgcatttctatttgacaaacaatcttgagcataaatgcataatcaacagatgttaactgtctgaaacaagattcactcgacaaggtatgcactactgcaattcacctcccttgtagaaattcaaatttcaatccatcaattttcagagaatcatcgagtgagtgcctattgtcccaaaatttcccttcaagccattttgttgtctatgtgtgtcgattttccttttctgtgaaaataccgccattaaaagtaaattcttcacggtatatcatcaaacaactctaccattggcttccacgtcacccacaaaatgtcgcaccttcctgttctgttggtcgatcatacatttccagtacgggtactgctattcagagtattgccatcagctatggaactcttattcgtaggtggttactgaacagaacttatgttggacatgtctgacttagaaccaagattaaatgacctataattcggagcaaggagttcagtttgaaggtattcataagccattgtaccataatgcagaacactgtaaatgtttgcctaaacttatgcagagaatcaggaatgtttgagtgcactgaaacctcatcctccattatgtgccatgacaactgtcaaatatggtgaaacaaagttttccgtagtaatttaacttttggtcaatatattgtattggcaccataaactgttaaaatattttggctgttgttaagaaatggattgtattcatcaatctttttggtactcttggcctgtttgtttcataaccaatacacaaatttcatgtattatctaaaatttgtttactttgtcagggaatgggtgcctcaaatattatctgtcatgtatcaagcattaagcttttgagttcaatttgtcaaatacttgtgagccatgacctatacattcgactgtctcattgatctaaattctaaaattcatactattctctactttgatggtgtttctgcttattacatggactgtccaatttactatacattagcttctgtcttcaatcacggtagggcgccctttatataatttttctatggatccatattggcattgtataaatatagtgaggttcagcaacaacattgctaccatgaaggcaaccaaactgattctctctcaacatcctctatatgttaaatattacattagagacatattttattctatactttttaagttcatatttgttatatcttcgaatacctttttcctgaaaggttttctactttatatcatatgcctatctaagattatatttagctataacatgtatatttctcctctatataacttctttttaaaagtttgtgaaggttctcttctctatatccaatctattacattagagacata

SEQ ID NO: 3855 - DNA, 1581 bp, Zea mays
  misc_feature (1)..(100): optimal_loci_123429_G1, chr3:192045712..192047292, Cluster 24
gaaacttcaagatcaattagaaagaacgacaacaagacatattgttgcatgcgagcctcatggtatatatagtgcaggggggctcattgctaggaaacacaagctttgtgggtcactattttatgttgatattttttttaaaaaaagaaacttgagtaaattcagtgatctgattgtattatgactacatcaatcatcaacatgactggatttttttagtaggaaagctgaacactttttgtacagaagtcacataagctctgctatatataagaaagtaattagtcaccaaggcttggtcataatgggagcatgatttactacaatggctctatgctttacttagctagaacatgtttatttgcttactgccctgtcccctgtatattgagactagggacatcatgtttgcatttcttttcacttttttttgttactgttagatatacattttcattgaagatggaagttactgaagtgtcagcatcagacatggggcttggatgcatttacatatagcgcttacaacatatggttttgttcatgctaattatgtgatgagctgctacaaaactttgacatgatgtaacgagcacaattctgtgaaccaatcaagctttcggcgcatggtttggttttagtatgcctgtggacacatttgattcttccgaagtcatgctccctgtctcaaggatttttttttggaagcattatcatggcttgtttcgttgtttggctctaaagctggatccagttgagttggagggagacatgttgttatgtttttggtgtaatcatgatctacaactccctttctgctggtagcctgcttcacagacttttgaaggcccttctggtggtgttcccctttgtacagggtggaagttgttttccacctcatgctttcctaagaaaatgtgccgattatgcttttctctttgtttttactaacttagtgaatttgccattcggccacacggaatactacaatggcacgtgtactctgattctgagtttttgttttaaatatattttattatcatgaaaactacaaaaatatatacgctggttgaattccaaaaataatatatggacagtcgtccgatagtgtctttcaaaaatcgttttaccagagagtgactcgttataatgtaaaactatcccccccccctcccccctttccgctgttccgcaagttcaggactacaaaagcacgagacaagcacccggtttagcttaattttttaacaatactaggtatgtattcatacgttgccatgagagttaaaattagtataaaacatacatacgaaataacaaacattactataatatacataatttgtctgacaaaatctcacagtaacactaatattatattgatgatataaatacgtaatattattataaatacaccaactcaaataaaatgaattggtgtcgaacaaatattataatcgcacaaattatttctaaagaatcaaaatataattttgaatgatagggcatcacaagcgggcggccgcgcggcgtctgtaaaatctgaccatattgaatgttgttcggtctcacatgtaaaat

SEQ ID NO: 3856 - DNA, 1945 bp, Zea mays
  misc_feature (1)..(100): optimal_loci_124185_G1, chr3:195922245..195924189, Cluster 24
gacaaatcccggaacttaaacaaacgcagccgtatcgatgttaatccaaaagcttaaagaccaaaaagttgaatgggcatccatggacttttgactaaaaataagagcacatgcttggatgtggtggaaatgggatccgcgaacctagaaaaaagaaagaaatgctttattctaacaaaggagactagtttaagggcctctttgaatctatcgatttcaatagcgaacaactaaaattaatagtagtacttaagtaggcttgttaacatactaattaactattcgttagttccactagcagatttaagattgctaataagtaattgttgtttttttgctagctaatttctagctagaatccatatgctaagctgttaataggtggttgggttgtaagtttaaaatacatataaaatattagaacctagtagcaactttaaacgtaccaacacaactaatagttagcgtgcaatatatcagctaatatttagtagaattattattagatatatttagatccattgtggtgctaattttagctactaatattaacatgttcaacttctagaatgcatattttttatagatagttatgatattcaataagtattatgtaatttatgataagatgtattttataaaatatttatttaatatttgtatctatatatttagttaaactcgaatcatttttgacgtgtttagttcgccgtctaacttgccacaacttacataactttttctactaaagtgtgatgtggttattcgcaattgtttcttgttaggacgaagatgataaaagtgtgaaaaaagtttagtgcagatttagaacgtaaaaaaaactatgttgatttttacagaaaaagatcataaaccaggttatttttataagaaaaaaatatggaaatcgggaaaaatcgctccagtgccatgtgcggcactgtacacagtcacacagattagtggtcggattgaatgctggcaagaaatgctcgtggaggaggaggcttcagtgacgaaaagctgcaggcaggcctgtagctgcgcttcaccggaccggcgagtcaccgttcatgtgtggccgctgttgtagagaatctctctgcttcaactcactttccgagctaaaaggtgatatggccacagcctttttgaagctgggactttcactggagttgccttttttttgttccagaacgaggctttctctaaagtacttttcggatttgcttttttttccctgcactgtccccgcagtgcacaggtttttctaagccgagccgaggcctggccgcctttttgcaaatgatcaccactgcaacgcccagagcgacccaacgagagaggagtctttgttaaaggcaaggaagcagcatgtactcgcgcgcaggagtgcccaccatgggtgccttttgggttggttacacgtacgtttcctctcatgctttgggtgggggggagcgggttttaggctaggcgccggccggtgctggggaaatctgttgcagggcgatcagtaccatcatattagacacagacggttctgagagggtaaaagtccatcatattgttccatgtgcatttcaaaagcacatcactttcagcgtgtcttatagaccagctggtattgtaggtcgtctactgataaaggaagaggcagaccaacaaccaaagaaaagaagagaatgtgaggatggaagtgcctcccgcaaatagtatactgagtacagtatatagcacgaagcaggctatgaaacattatcgcgttgttttcttgtttcttttcttcctttttaaaatactaacggagctcctaaacaaaaataaaaaaagaggggctaggttccctatgctagatctgctacaagtgtcgagcattacttatgactgtattactatataaaaagaatccacagattgttttttttaccggtaaatattgtgt

SEQ ID NO: 3857 - DNA, 1900 bp, Zea mays
  misc_feature (1)..(100): optimal_loci_125431_G1, chr3:202761887..202763786, Cluster 24
atatcgtcaactcatttcttatagttagttagtactaacattaacacgaagaatgagatcatcccattaaattttggatgtgtttgttttgatgaatgaagtgtttcatcttcttctcactctttattttttttggaatagaatgagttgatttatcacaactttatttctcataagctaataattaatatatacatagggaataagttgattccaccaaaatttatgaaatgaacttatgatgtatcatctcatgagatatagaatgacttcagtaactaaacataccaattagtaatagactcatgaaacaccccctaataatttaagatgaggccatcgtaatggagtggtgtacctgctcaattgacgctgatcgctctatgtggatatggatgtcgatgcgaaaggaggcgatgatggttgtctgccctgtaccttgaaaagcccatcaagcccaccggctttggcccacaatctcgttgtcggaaaggaaaattccaaaacggtaccaaatcccttgctgcggagctgtttttcgggtgatgtggtggcctggtctgtggtctcacacggagctcagctccttgtattgtatacagaaaattttaccgcggattcttcgttctcaatcgctcgagcattcaaccacacgccagacgaagggatcgctgtcagtttttttaaaaaaatatatatatatctcttcctgggatcgctgtcaggaatcttcaaccacacggccaggaatcgctgtcatgaatcttcaaaccgcactgccagggatcgcaatcaggatgctgtcatcgctcacgcatcgatttcttcctgacatcgctcacgacctcacgtacgcttctcttccgggatccataattccaaaaaaccaaaagggtcaggcgtaaaactcgaagagacgggccggacagtggcacagtgctactgcgcttcgttgtgcatggcacggtcaattcgtagcgtttatatatatccaacaaattttcacctctctgtttctaatccttattcaccaacactagtttgtctaaaatcatgaaatataaggcatatccgatttcgagcactactggttttggtcgccgaaaacccgaaatggtttcgaatgaggtgtttatgggctaaagacttataggattcgattgaattccgcaagctttctatgaaatgctatctcatcatatgatttcgaacatatgttacatgaagaagtggataagttggcttcttttatccacactctacagttgcgtatcttcgaaaaaatcattagttttccatatgacgtggatgggtgcacgcattgtgtaatataaacatggcgagataggcagattcttggttgttggttcaccaacctttccatttaaacccatccgaaaataattaatagtacaacagctagataaaaaatgtttatttaaaaataaggctctctttggaactgcttcagcttcacaaaatttggtaaagttcataaaacatgtcattaggagcttcaaaaaatcgtgaagttgaagttacaaacttttaaaatacattttgataagttattttgtttcttatttaaattaaaattattttaaaaaaactatttaaatttatattatacactacaacttcacgctgaaactggaacgtcaaactgaatacacgaaagctacagagctgctttgttccaaagtataggttattttattcttttagagtaaaaaatcttaaatttaattaaagtataataaaacaataacatttatgatatcgaacaagtattattatcattttttactaattatatttcgatgatatgtctatttgatgtaataaatctctgtagttctctctataaccttagacaagcttatagatgtgttttggctca

SEQ ID NO: 3858 - DNA, 1947 bp, Zea mays
  misc_feature (1)..(100): optimal_loci_125813_G1, chr3:204666553..204668499, Cluster 24
ttatttcggtctctgacgtgaaatatagaagcaagcaacaattattttatttaattatgctaaccaggattcgaacttgagacctctggctctgataccatattaagttgcatgcaccaaccagtccaacccaaaatcttaagctgacagaaagtggtggacaattcacttatattatattctgacacttatgacttctaattggacatcattacatttatccatgtgcaagatcatgcagcacaactgcacaagctgggagcctcttttcagaaacaagcagtcctagagggctcagcatgttgtatacactctaccgttgggagaaatcaagaattctctgaagtatattgcgtcatcaaatgctcggaaaacctgaaatgtcagaggtgttgcaataacattttagtagatgtcaaatgtgttgaaatcaaagctccaatcatcattgtgaggggcttttgtgctcattttccatgagaggttcgcgaagagcaaatcaaattatagcttgttgaaatgcctctttagcgtggttgttatgttgtccttattgtgggcttgacatgtgatgccaattagcacgtgaagcacctagtttagactcaccacaacaaggacatatgtcatcggcaagcaatcaaactttagggatatatcttgtgccatttcttagactatgtggtatgcgctcctaacttatcattgtaaatacttcaatacttgtcgtacattcttactcaactagctttgtctcgattacaccttctattgttgtttggtatctcttacgggtagctcgcttcattcaatgtacactaaatatcaagttactagaaatgtttatgggggcttgcatataataaactagatccagagtaagtatatgcttctgtgccactctttatactaataaacttgggtctagtgataattttgaatttgtagaacaaaattcatagactattgaccccctctagtcatctaggttttaacaaacatggtagattgagtttcagtgaagcgcttatagtagtcatgtatactttcgtcatccttctgcttgcaattttgggaatcatgctaatcagttggacgagaccacacactttattaaaattattcacaaatcttttgcagagctagccagttgtcgatgaagctttcgagagttgcttaagccaagtcagtggggtatcttcaagtaccattgggaagtagattgccttggtgtctttgtttcctcccatgtgatctatgggagttgagtagcataaaatccattgatttttgggtctttcttatcataatagatgtggatggacttgaacttcttcggatatgtgagggagttaagtcttctagagaagtaggggaatccatccactttctcatcctcaacattgtacttgtttgtctcgtaagactccacatacttggatctcggtgtctaaaatttagttgctcgtgaagatcacggctatggaggatgtcacataggttgcatgatgttgatcaacttgagggtggactttgcctcccctatgctgattatcagtctctcgacattgggtccttagctaaagacatggtgtgttcaggtagacgcaacattcaatgatgtttgttgtccatggagcattaatgtattagcctccagcatcaccttataacgtttgaactcaagagcaagatttctctgctatgtacataatgttggccatggaagggttgtacactttgtgtcctttgatttctaggaagtcaaattcaagattacgcactatagagtttcctagattgtgtcggtgatggtggaggtgcggtgggggtcctcgggagtggaagaagagacagaagcgatgactggtgctgtagagggggtgaggaatggtgagtggtggccagcatagcaggatactaagggcatgtggaggggacagccat

SEQ ID NO: 3859 - DNA, 1543 bp, Zea mays
  misc_feature (1)..(100): optimal_loci_131802_G1, chr4:2921600..2923142, Cluster 24
gacatcaagaatggggtgtcagcgaactggcttgggcgatgttggcaagaatgagaccggacagatagatgcgaggactgggccaaggaggaggacgagagtcaggaggactggtcgatccgacgaggaggcccaggacaaggctattttggcccagccaaaactttattttcctgtggtgaacaatgaatgaacactaggtataagaggttttaaaaaactgaggggaccatggcccacattgccccatgtgcgtccgtccatggattatttcaccaatgagtatcgacatgagatttcttcatttcagaaggatataaacaattaaatactatgtcataatttttcttgtattcatagtgtgcatctacttcaatttaccactcatgactaatgaaatgcgacaacactaattaagatgttctacctatagggtagcatgccataattttgttagtgccacctagaggcctttggctcaaaaatttctccacgtgattctcccatatatgggatgcactaaggacctacaaactacatactcgctccattcctatttataattcatttgactctttttacctcaaatttgaccagctcatcttattcatttttttggaattattattaattttaatgtgatattgtttagtatataatatactttgagtatgtctatgaattttcaatttttcgcaaaaaaatgaataagacaagtcgggcaaacttggtgaaaaaaggcaaataaattataaattgagatagagtgagtatataatatgagggagacgcataaatgtcagatcgaacaaatgtgagaagctatgaaggcagtacgaagccaccagtgcacatagaactttagatcctatacaactttctaaagcaccttgatgctttcgacattgtggacctaatattgcattggtagctcctggtacctctcatacctaatgatttctctgttagctctgatggatcatgggaaaaagaagttatatttataggcaacattaataattgaagtcattgtccctgataaagtaagctactttcttaaatccttggcacatcactttcacttgtggtatattccaatgtaagaataaaatgagaccaaatgtatacaaggagctagttggagatatacaggcgtacacatggtgatttacatagcaccgacaaaggggatacacactactacattgatgggatcagattaggtatctttcccatcatagaccatgtttgactatactcgtacatatctacctcaatcgacatatgttgggggtgaattaaggtgaaaatttaactaatttttaacttaacctactctaactcaaatggattgaagtgaatacaattatatcaaaacaaacaattgaacggttctacaatggtagcctccataacctatgtatttttttctcagaactcactagaaacaactgacgtgtacggacatcagtttagtgtggtgcctcatcataacttgcaccatctcgaaaatcattatcccatgcttctggatcattttagt

SEQ ID NO: 3860 - DNA, 1862 bp, Zea mays
  misc_feature (1)..(100): optimal_loci_13557_G1, chr1:74609478..74611339, Cluster 24
ataatataactatagtatattttatatcggtccaatccaacacctgtttgaagacaaatttttagttgtagaatgaggggaggagaaatgatgagaatatgactgtaatttgtcgtgcgccaacaaaaagaactttggtccataccagatttttttagactttaaaaatattgtggtatcggtgaaaccatggtttaagttagagtttctagatggactcacaaacaccttttggcctaaaacactatggtatgtttaaatactatagtattatcttaggactagaaaaatattgtgttcataaacatgccctaagacactttagagtgaatataggtggtggtgtgtgtgtgtgttgaaggggtgttccaacgctgtttaatttgagagttgaagcgagatcgctctatcacatgactagctaactctcgattgggtttgaaggtgtaaagttgtatcattgagttggttttaagccaatggatgttgaagaagttgaattggtcaagattggatttgaaatgacctaaacaaattgtcggagcatgtacaagacaatggggttgacacctggcaggtgatactcaatgagttagcctagtaacacaatggttgttgtatgacccggtggaggacttcatgactttcatggatcatcatccagtgaagccaatctagaattagtgactaagttggtagactcaccagaccttgatggattatttggtgaaaatctaacttgacttagtgacttattggcatggatattggaatgcattgtgcaatccaatggatggttgtgtgacattggtggatcatctggcgagccaacaaatttaatgatgagtcgacaaagtgcatatacattttaggttttttgtaaactaccagtttattacaatgaggaatatttacgactaacatttaaagtaatccgaagcatagcgccactttataatctaacaatctcttcgctgtttatgtaagcgctaaccttggcttatttgcaactactctttgaccctattctgcttagcactggtagagatgtttgtgaagcatgtggggatttgattgttaacttagagtaatgtcgatgttcttgcttgggttgtcttgaggagaagcttgaaaacttattactcttggtgatggctgtgtgaaagacttagtgacatttctcaattgagctattgggagaatgcttcaaaaaacttgtagatggtattgaaactcgccatgttatggtggcaaacgggtattcccctaggggagtggagggtaaccaaactatcgtggcttaggtcctccaagccattttcactttaacttgctctttttattgactttactttcgttgtttccaggtctcttatgtgacaactaggatatatggtagagcatgcttagcataggttttatttatgcactctaaggacattgatctcatcatgactttactaaggacatggttagttcattggccacaagattcattagcctagattttagaagaacttaggagttaaaaacctttagggaaggtttgatgatcaggggtcacgaggggatccatgggggaggaatcctcttgctaggaatcctcccccatggatcccccgtgatccatggtcagcgaatcaacccttagggtttagattttgcataggttagtgtttgtactttattttttagtctaaatctgccctttcttaggccatttgatctttatacttgatatccaagctttgttgcttgtctagcaatcattggcttgagtaatggctctacgagggagtgctacacttaggttcaaggggaggaactttcattattggaagcctggacgaatctctagatcg

SEQ ID NO: 3861 - DNA, 2802 bp, Zea mays
  misc_feature (1)..(100): optimal_loci_135655_G1, chr4:19857179..19859980, Cluster 24
ctaacatatatgactctaacatatatgaattgaggttaatatatatacacgaccttacatgtattgttgtgctgctatatatatagtccatgatgccatatttacagctcttgatggcttcagctggtgcttagtagccatatttttattaaggtgtcattcgttcagccttctaaaccagattcgatgttaaaaatctagaatctcaactaaactgtacaaccatagaatctatagatttctctagtttaattcagaatcatcttctaccccaaattttctatattcatgtcattcatgctataagttattatacacctacaaaatctatagttaacagttgttttaactaaacatgttttagattttccataaccgttaactcacaacatgtttctctcacaactcatagttagaattagattttcaagaatctacagctgaataaaacagaccctaagaggacgtgacgtgtggcaaatcgactcgcattgttaccatcgccttgacctggtacgatgttattcgataagaactagtatatggttacacgaactatgccttgtattacttcatatagaaatgagctgtgagaatgatggttcgcttccatatgtatgtatgtagtttgtagtaacatagataaggtaatcaatttgcaactgacgggcataaaaaaaggcttgaacactgctgtactggcgtacatagtgtccttttccgaatgatatgccatatagaacgtgttctgtataggtcccattggctccagcttgtttgatacaattagtttatgtattgtttataatatatagttatataggttccgttagatttttttagtcctatgactaaggtccggtttggttcagctttaccagctagattcactaccaaaaatctaaaatctaaaccaaatggttacaaaggctaaatagatttctcagattcccactttaaaaactttaataaaattactcaccataccatcggttgctataacgaaacttttttctgttttgtattccccaagcagaacctatcttctggcgcgagcgaccacgccgccattgcttctgatacggtgtcgcccctgatcctgtccattgtgggcgataacgctgccgcttgatctaggttcgtcaccttctccttgatctctggactctcccatgggtgttgtagaactgcacgccgcatgggtgctgctagatcgagtctgcgccgcctacaagttgttcgagaaaaaaatcgaaccagtcagatagatgctgaatacaagaacaatagtgtcaaatagatgcctagtagtcctcgtcgactgctgccaccgttagcacgagtcctgcagcggtgtcctgggcggcgtcgcgcagactgcaacctgcaatgcaaggcgggccgcaagtggctatttgtggaatattttgcaattttgaattaggaacatttgcttttgctgctgtgattgacgtttatattgcaatttttttctgaatgaaaatagttaaacttacttgaaccacatttactagtgatgcaacggcaactaataatgcagacctatttgtttatatatcattcgttcatcctccattgtagatggcttctgttactacgattagcaagtgtacacctaacattcagttctaatgacaaggcagttgcataaggtgcaacaatggtagaaaatttcagagatgtagatgtgtttgtgtctacatttgctctaataactttagcagagttgcataagctagctgtgttctagaattttaacttatttttttgtattagtatggatgacaaagcagtctggaataaagaaaacgttaagcatttatgtgacatttgcaagaatgaggttcttgccggccatagacccttatggcatcttaataaagtaggatggaagaatgtcgaagataagtttgcagaaaaatatgtgaagaaactagaacatttgcaattgaagaataaatgggatagtttgaaaagaagttattcctgtttcatggatttgaaaaatatggccactagacttggatgggatgaagcaaggcaaactgtggattgtgatgatacatggtggaaggatcaccttgcagtaagtgtcacaaaacatgattgtttattgtttatggtgatttgtcgttagtatctaacttcatgtgtattttttccagagatgccatgatccagcaaatagtaggaaatgcaagcatgtacagttcagaaaatgtggaccaaccaacctagattcgttgcacatcatgtttggaagtgcacatgttactggggcttctgcttccattcctggagatttgtctgatgatggcagtgatgatgaggtgcatgagttagagaaaaagccccatgaatgtcaaattgtctactttgcatataccaaaacacaagaagcgtaaggtctcttcaactgctatggaagacaaggaagagaaaagtccattcttacgcttgtacaagcaaacttgcagcaagatagaaggagtggacaagataaccacaagtattgaagcttcatcggctcctcctatgaccaacccagttcctacaattgcagaggcaatgaggatggtgaaagaacatggagtgcaagaaaaaaactgcccttatgcattcatcaacattgctcattatgaaacctgaacttaggaaggtcctcagtttgttagggacaactgaagggagacttgattggttacaaagggaacatgagataaagaagctgccatgaatctttatctttgttttgaagcaaattattcttgtttgcatatc

SEQ ID NO: 3862 - DNA, 1508 bp, Zea mays
  misc_feature (1)..(100): optimal_loci_136884_G1, chr4:26680648..26682155, Cluster 24
gcaaatacactttttttttcttcgtggaacacgataggtatcaaaatgctcacatgatgtatgcatgcttacccttatttttaagtgcatttctgaaatactgaattaggtaattagcagctcttgaggtccacaaaactaccataaacatgtagtttttaataggcatattgcctataactcaaaatagctttgttaagttgaaaacttggacccatcataaaaatttaaacctaatccgctgctgacctagtctgcacacatacatacacactctgcctgattggacgagtgtccacccacgagggcaaacaaacaaaaactcagataaagtcaacatatacggtggtccaaatcgagatggtacggacaaccaatcactaagcgacatagatagcatttagatatataggaacatgattatacctcagggggacaagacagtttcaatcacgactattccctacgtacttactgtaacggtcgaaacagaaacttagtttccatcagcagttagttaagcaacagctaacgtgtggtttgtcatcgccgtaaagaaataaaaccagagattttagtgtagtatctagccagtgccttgtgtgacgatatatgcaactctccgtgtcaggtataattttatttatacacagtattatttatttaagccaccgttgatttttaaattcctgaaaaagtattcagatatctggtctatcgagatcacaaccgtaataagaggagtaaaataataatctacctcgggttaaccatatccgcttgcatcatgccaggcagggtctgtctgtacgtgttcaccttgtttttgcacatactgctaggtgctggtgatggtactttgttttctacagcgatgttagttggcttagcctgatcattgataaaaaataaaggaagaagtccaaattactacaatgaccatatgttccataaattattttttagttcaaatgtatcccactcccgcctatttaagttggttcaatctaccctttaataacattttaataaaattcttctttcttatttctttatatacaaactgagtttttagttcagtttttgttggttaattagtagttaatgtcatacttagcttacaaaaatatattatgctttttataattattttgatagtttagagctcaaataagatggcaactttaatggtacaaaactaaatataaaataatgatgaaaaaaatcttaacctatttttctaacacaagttatgatgtcctcaatcatcttaaaaatataaacttgaaatttaatttgtacacggataaacgaaagacagattttatattaatcaatacaaaccttcatgtttaaaaccatatataagtttttcaaaatattgaaattcaacttgtgcacggaaaaagacaaaatttatattaatcactacaaaccttcatgttcacaaccatatataagttttttgaaaaattataaatactccatgtacagggaaacattaaatt

SEQ ID NO: 3863 - DNA, 1460 bp, Zea mays
  misc_feature (1)..(100): optimal_loci_138952_G1, chr4:38953465..38954924, Cluster 24
ctcctatagtgatgtcccagcagtggacaactagcaaggtgccaatcaacaaggccaagcctactacaaaaggaatgatttagggtctacaaattaccttgggtacacaagagccagcattaataagatgctggcaaagaagtcacattaattgattaccctgtcgaggaagacatactacatcttgaccaaaacaggtggactattgtggtctggcataaacaatacatacaatttgttgaccaaccatcttcgagtgaggatgacgatcatgatgaattgacacctcataaggcaccatcactacctaggcctccacctccccctcaaccgcctaaaaagattattctcatcctccatcttcacccctagaagagagcagtctcctcttcccttttcacctcccaaaagagctcatatcctcctccactaaagtccaaacaagtaccatctagctaggatgaacatagactcgcaacaagaacaaggtcatcctcttagaaagtgtcatcgactttgataggtaatgttgccaaatatggttaaaaatcaaaggccaatgagcgggaacataacaagcaagatgaataaaccaaaatagtttgctcccccaagcttcaaacaaaatcgaaaactttggaacctatgatgtgcccgctaagccttggctctctgaatatcaaaggtaaatccaaaacaatgtgaataaagatgaagtccaacaagaacacacatttgatttgctgcataggcaacaactagatgaaacttttgatccaaaaaggatgttcttgttgattccataaaaggccaataagtgagtaatcatcaaaaacaactttacagatgttccaaccaaaggattgagggaatgattgtaattaacgatctaccaatctcgtttggaagaaatattagtgggagcatatttctctcactctccccgttaggagcatatttttgggctttgcgacatctaatagggttagtcatgatagagagttttataaagttgtttttaatactattatatcataagtaacaaaataaaatataaataaaacattcgctctagaaaagttttattcagtagtttgtagacacttaattttattattcataaatagacggatctaaggtcttatttgatttgctacataggcagcaaccggacgaaaccaatgataaatttttaatgatgttattagcttcctaaagctggaagctacaaaaatccacaaaactaggctttttagcttcacatataagggcatgtacaacctagatatactatattgtggttctccgaacactagatacttataaaaaattattcatgcaatgcaatatatcaaagtcttgtatcttatctactaaaactcctcaagacacatcttatttatgtgggttgtatgggtagaaccgtatcttaaactgaaagaaccgtgctagagatattt

SEQ ID NO: 3864 - DNA, 1590 bp, Zea mays
  misc_feature (1)..(100): optimal_loci_14823_G1, chr1:81574950..81576539, Cluster 24
ttaattgatatccatagttggaactttatgatgttaataaatttacaaagatgcctacttagttggaactattgatatccatagttggaattttataattaacaaagacaatcatcttatgatgtctgtcactattaataaagacagacttttgccaagaggtggtacaatcatttatagatgtcgtctctggatatgaccgcttctatttgtcatatatgttgtctcaacttttttcctcttgtagtacttcaacatagtcaacttctctttagtgatgactaatatcattatttgatgcatatgtattatagattattactagtgattagtgtgcaccccttgcacgaggattgacaacttagttgtttttttggaaacacataattgattacgaataatgacgtatgaaacaaaaccaaagaacagtgtacaacattgcagagatgttcaaagattacaatttgaacacacactaataacataggtcatggtagccaaaataaaaattcatagataaaacttaatatatgttgttaacatagtttctaagtgtcaaactccaaaatttcaacaattttaggctgcaaatagaaaacactaaatgaaatactttttgatattgataaagttttccaatatagtttaaatttacgtaaatctagttatataaatggtagatttttaaaattttctaaattaatttggtggcttaattgatgtgatgtttcatgttgttttgatctatgttgtgagtgtataaagttttcaaaacgtgtagtacaacaattctctcttttggcatgtcctgctttttctatattcaaatttaaggtttcttggtctatatattttatttagaattcccaaaatcttttcttcgtgctccaaatcattccattatgttcattgttcatcttctccctaaaagcttcccaagaatatttctagcttttttcttaaaacttttcacttttctataagtgcattctaattttagatactctcatatatcttttttgaactccaatactttactcatgttatccatgttccaaaatatctacgataaattttttccattatttttagagtttttagagtattttttgcagcctaaatactaattatgaacttttctataattactgtaatcctaggtataactaattctaaaaataattaaattctaagctcaaattcttagaaattcatgaagccattatataaaaatcataacatgccttatgaattaacgggctttaatgtctgtctaggcctattagtcgaggtggaggcacaaagtttttcttcttatatatgtactataatttttagaaaaggcacacaaactaacataagtagagcctctaaattaaagatccttgaggtagtaaattaaaaaattttactcttctttctattatgttatgttgtctttgacatcaaacccatgacactatcatcacgaggtttgtttcatcattttctatatcatagcatccttcttttagaagtctatcatgactttcacctctttgtttttatttttcgatgaacttcacaccccatcattgacgattctttggt

SEQ ID NO: 3865 - DNA, 3089 bp, Zea mays
  misc_feature (1)..(100): optimal_loci_15227_G1, chr1:84055702..84058790, Cluster 24
tggaagtaatacatgaatatatgtgggcattaaacatagaacatgatgcagccctagcaaagttggggacttagtcaaaagacaaagaaacttgaatacaacaagatcaagctaatcaataagattcaagataagagtcttatatgactaagccaatgactcgaccaaataagacttaggctactgttatagatatgactagtgggtccatgggtttcaattgagagcctagggactcgactagcacgactagagggaaatcctctttgtgaaattactctagaaagataaagatggtaagcatttaattagatcaagagatgagatcgatagactctgttatgattccttattaggctcagttgcaatccatatcttgtaactgacctaaataaatatcctataaacaccaccccttcttggactataaaacaagggttaggaagccacaagagggcaatcatcagatcacattgcatatcaatagtcaccaccacaaatagggcacaagtgtgtttcccatgcctttacctttatgtcttgattacacgactaacatgagctcatatacagggtgcccaaaaataaacatgaaaaaaccactcaaaggataaaaaaccttcatgggaacaaactctaggcatatcatcctcagctagttcacctcaacaaagttaggcccaaccatagcaacccaactaaaatcccccaacctagtccttctcactatgttggacccagctcaatcaccccaacctattagactcaacatgacaaagtagaacttgaccacgacatactgatcatagcaaacctggcatagtccctcgaccaaaccatactaactaggtcgggcccaagcaaacctacctaaaggttcctaaaaatgggtttcccaaccaaggcaccttaaacgagtcccgacccaagtctcctcagtcagtcgtcctaaacctcagttatgccaaacctggtcagcctagatcatgtgcctctgaaaggacattatagcctaggggtgtcatgagcctctgaaaaggtatagtacatttaggatccctttaccaatcgacacatgtccacctttaccaatggacgcatgtccatggccaaggaatgtaacgactaaggaaaggtatagtatgaaggacctagaagtctctcctactctgactaaaagcactgcaagtcatggagggcctcacttcaaggagtatggtgtcaatatggatgtatgggatgaaggcagagagtaagattttgaagcgaactactcgcacataagtgtaccaggtggtaaagcattagacacccatacgactcaaccaccctgatggtctgacaaaagatgacaactgatgcatgtgtggtgacatactagaaaggaccacatgtccaaagataggaatggtgtaccccatcaaaatcttcatgtaacaatggccactcgttcctccgactatataaaggaatgagggtcgaaccatagaggcaggcaaactcagattgtaatacttctcacacaagcacgagatctaagttctctgccctgtaacatgtgaaagccagcaacaaagacttcatccaagcgctctaccttataacacatgaaagccagcaacaaaggtttcatcgccatactatacgtaggagttttgtccgaaccagtctaaactctatcccataagctcgtcatgagtaaagccattgggccagcaacccactagccccatcataacctacaaatttacttgttgtggggttgaaaccatgacaatgacctacctcataaattcactatcgaataatcttcgacagtggcgaccatactgggttggtgcatccttagtcaaatgcttacaaggatggagaccctccttcgctcgtacttagatgtagtttttgttttaaaccctttggtcattttgtgacaagttatggttttgtaataaacatcgcattgtatcgctatattatcatcgtatgtgtgacttaaatagatcattgtcatgcatgcgatgtacatttgattttatctataaaccgatgtgaaagttatgtagtattttatcagaccccaacatcaaatttactatccaacaatgatctatttgtcattttattacttatttgggccatgctcaatgtagttcaactagaataattattgtatcctccaaaagattatatcctttatatctcgttccccttcagcagcgtcttctatatctcgtcctctatacataaataactatattagaggcatattttatttaaaatgtttttaggcatgtgtttgttatatcatttaatgttatatatatatatatatatcttaaactattgtttgaagtatcaacatggataaagaagagtgaagagaatctctatatacagagaacgaaggaacatcctccatattaagaggatgttgttagaggaattaggagagggaatctcccctatatttagaggagaggaggaaaaaaatctctatagtcgattgtatagaaatttctctctagcttatttcctattcatgacacatatgtatctactaatgattggcaattgttttttctagcccagcataattaaagaagatgagaaaagccgctaaagccagtggtggagacaagggggcgaggaggggccttgaccttcctaaccctcatgtgtgtctatatagagagaacatatggatagtagagtttttgttgattaaaataaaataatttgttaaaaacccatgtattttctaaaatatcaaattcgtcgctaataataaaatctatgaatttcaactgaagttgtcacctaatatttgtcgtgtacacgacgaatttgacatgtacctacacaagtgaaggattttaatggattctagaagctagtttgatttttttaattctcttaaatatttgttagctgtctcatgaatagacatgttcaaatatcaaatcgggccaggtcaaggtcagggtagtaggtcatttggcacggaatgcgcctaacccgtgtatagtgtcggtttaaggcgggttggcccgtgcctctctgttggatgtgtcgtgtcggtttttttcgag

SEQ ID NO: 3866 - DNA, 1454 bp, Zea mays
  misc_feature (1)..(100): optimal_loci_155124_G1, chr4:147581446..147582899, Cluster 24
atttgtggtgaattaccatgggacatggtctttgatcttgtggtgtttgtgcaagtccagaacatctacactagaacacctaaaaagaagtccgccaaagatttggttagttgcttcatgatttctctttttctctcttaatacttagctctatttgattgatctgtgctatactgctatgtgctatttttttgtatctcaaattagcaacgggagttgttcaggacagagggagttgttcaattcaatccatatctgtccttagttcaaaccatatctgttttgggaagtttagactctttcaaaaaaatattgtaaaaccttatagagttcgtatatgctaaattgccccaacagtggaatcccatttcttgatttaaattttaaatgatagatgccaatttataatattttaggagacaatactttttaaaagttgagtctgcatcatacaagtagagaatccatccaaaatcaaaccactgggaacccaactggcagggttgttttaacagatctacaacgtagggctgttattgatgctgctactattgcggtcacagggccattgtattgtggtaggtctagacaattgagtcattgttctggacaaagttgtattgcttaagtcaaatcatctaatggagctcattcaatattgtaaatattcttgtctgttcaacaaacttggttaaactttgttttttaaaatccactacacttcaggacagagggtagttgttcaagtcaatccatatctgtcctattctctatggtatgttactgaatagcctacacaaaagttaccataatggattagatcttaacggaaattgtttatgaatatctatctagcttctggagttctgttaagccttcatttatcttctaactaggcagaggatcgtctcgtttaccctttagctgagaacatgtccatttcaccttcatcgcttggagcatgtccatttcaccttcatcacattagtaatcatgtactatcaggacataatcccttctctgcaaaggaaaggcttggctttactttaccagtaagttaatataataacagtcagatactctaatccactagcatgtgtcacttgcctccatagcctatagtaatgttgtactgtctattgtacaagacacgcctaggtgtttcttttattactctgtactgaggggtgctatgcctctatttttgccttttgatgttggtcattgttcatattctccttcaggaacttgtagcactaaatcattctctatgatctgttaacttgatagaagttaattgcatttgaattttaagaaatgtaatcagatttcctcattgctcagaattgatacggtcttcattttgcaatgtccctaatcaatatttagttttttttgtgattttgcatgatattttgtgatcaacaatgtgcagggtacttctattgtaacta

SEQ ID NO: 3867 - DNA, 2404 bp, Zea mays
  misc_feature (1)..(100): optimal_loci_155222_G1, chr4:147921043..147923446, Cluster 24
gctgacttggagtgttggtagctaccactatcgctagctctataggaactggagtaggcatgactagcactataagttgctggttgacgggaggtgactactctgatgggggaactaaataagggagtaaatcagtggaaagtgttagatcaactggcacatataaagcaggtgtagggtatcaagtgatctcattaaaagtacccaacaagctttgagtgactgagactaacaaagtggtccaactaggcatggtatgcatgatagctttctactaagctaacactgtcctagatggttgccctcatcctagagtggtgaacaactaattcaactataggggtgaagccaatggaaaggtagacaaaccctaacttagataggtaggtgaggtggccggatatgatcacctccagcagccgctatgtcctctagtgggaaaaatccgtgtcgtaagggtgatgatgttgtgagtcataacaaagtggaatcctcatgtagcattgtatagacccacctgtgactctaggatagggatcttacgtgacattaagcctatttttcatatcatctaggatgaatatcttaagatttcaaagttaggggatttacaatatgggcttcgtggatccagtgatgattaatcaaaataacataacatgatattacaatgatgcattgaagagaatattgatgttcttgcagaagaaacattacatactgataccttacagcttcaaggtagtgcatattgtcatgttttcaatattgttttctatttaaatgtcccatatagcattctatccatggttataatcgtttagcttccactagatactccttataatcacaatggaacatggtattgtccatgtgctagactcaatgagtaagccggtcacaggttaccaagacaccatggatatttgatgagtaattgttgtcatttcatcttaactatctaaccattgcttttattcattaattgaccaaacaacactccttttcatgtgcatgacatagttgatcttatgtaaaaacaatctcatcctaaaataaaaagcttacacatctcttatgtatggatattcacatctcttatgttgtttgtcaataatacttcataacatttactttttagtgttaccaacaagggaaaggcaacaatatttgtggataatatatttgtgaattgtccacacattcgtaagtaacaagaaactaaaaagatgtcaaagtacgtatgagaacatacaccatatattttctaccagtaatattatgtccaaaggttctgatttaatatatcaattatttggcaaacgacaactaatcaaaatgaatgaagaactcatgttggatgcgatcgcgatattcaagacaacttatacgattctttttattaccggttgttatctagaatcggtactaaagtgtatctagaacatagctactttgcaaccacgtaacttctttagtaccggttaatgacatcaaccaattataaaggcattaattagtatcggactatataaacaggactaaagactgaagtttttagtttcagttgtatatagtacaggttaaaattcgatactcttgacagtttaggactgatactaaaaattatttcgtagcagtgtccccccactggcaagtcaagtcctgcatgcctgtcaaagcaaagccatgtaaggatggctttgaaaccaaacgtgcccttcgtggtagacccgagcaatatagatttggcccacgcctattaggctagagagcacgaaacaaacctacaaaaataatgttactagccaaaatttcagaccgaaaaataattgttttttttacccgatccaccctgcaaaaatggtcggatacttcgtatgtgtgtctaggccatatttggcataattcatcaccagcttcacaagctatttagacagttaactgtgtcggtgacccatagacttgtcaatggatgtcacataagtccacgaattttaaaaatatatttgtagattctttaaacttgttcaaaacagattcagcaaactgacagagatgctctcatacagttaaaagacaaaaatagaagggataattacattagtatccctgttttaaggtgtaactgttgatctgcctctgttttttaagacttcgtgtgtttgcccatgtgtttttaaagcaaaaggtattgtatgtttctactccgttagttgtatttgaataaaacaggttaaatataattaacgaagtagggatatacaaagttttatttgaataaaacagggacaaacacataaagtaaaaaacaagaacaaatctgcaccctataaaacatggacattatcgcaattacccccaaaataatagtaatactaagacgtcttacacagttaatcac

SEQ ID NO: 3868 - DNA, 1890 bp, Zea mays
  misc_feature (1)..(100): optimal_loci_155924_G1, chr4:152078728..152080617, Cluster 24
tctcaacgtcaccagttctagctacttatagcaaggcactagcagatgttctaggcatattaggagtttgatagggagtggagtaagaataaccaagacttgtggctgtgggagatggattagaaccatatatcttacctcaattgatacttttcttacatgtattgcttggttttggaggtctctgtagtgtcatagtgtggaagttccaccacaaggaacgatataataagccgagctccgcttagtttgtatattaaccttcttttagttcaatacacagattcaatttcacttagccaacatatacaagttattgttttagtagtgatggtatgcattggtaatagagaaatagataaaggtattcgtttggtcaattttgcataatggatagtttgtcatcatgtaggggtacttcaattttattttctctaattgacacgccttgagaattaacatgggtgtatttttgttgacaaaaggcctgcttggatggtttccagtttttgtctaaccaaaaccatggtaaggcaaagcttaggtttgtcaatatcaaggcttgcacaatttattatggtaaaaagtataggtgtgcatttggttcagggtcatgacaatagtagaaagcaccatttcgctcttatgcaatttaaaatttttatagagtgtcatcaaaactttgatcataaatattggcgtgccagttttttttagcaatgagccaattacttgatgattaaaagttttatttggcttgtcatgattttttgttaggcaagaattgaaagccaaccaagcaggtcctagatactaagacaatagatgctattctatatggtaataacaggatttggatttattgtgtggggtatgtgccaccttgctaatttatgtatgcccaatcatataggctaggatcttttcgcagtacaggctctctgcgcggtttattaggcaaggtttctcagtactctgttaatacagtgaaaattttctttttagtgatggtatgttttctttatctatttctagagaaatagttgaggaaaaattctccagtaatatatgttgtgtccttgagagagagaaaaaagaaaacatagctaccacgcttggatctgaaccagggtccatggggggttgggcggtaggtgggcaggacgcatgctaggatatgatcacaaggctgtttagtaggttcgtatcatgtctacaagatagggctggtacttacaagataaggttgcagatgaccactctcatcaacaagcttaggaggccctagcgcgtggtgtgtggactatatgagaatgagatgacgcgcggcatgcatgatgcaaggtttgtcctggaatatgataccccgtttgtgtcgtccaatcttaatttacatccgtttccaatctttaattaccatctgagccatccaaatgaagttcatgtatgaggaggcttgaattcagaaactacgttcagttcagtactactgcccttgcttcccggtccatgagatcccaagatggcaaagtctataacaaactctgcccacgccggcataaaagacaagatacacttctagacgtgagaggtcccccacagcagccgctacagaaagtaggtccggccgtatcctactggccactgtcgcaaacccccaaacatgtcatgactcatgagccatgcaagagagcatgaactacattccagaaacgatggagacgatgaccctgttcttgatgaagacaattaggcctagctagaggtatcagactaaatatgcacttttatagaatatatgtccctcatctcgtcccctgccccttcaaaaactggatcatttacgtcaattaagggcaattttgtatttatacatagtaaataatgatc

SEQ ID NO: 3869 - DNA, 1478 bp, Zea mays
  misc_feature (1)..(100): optimal_loci_156848_G1, chr4:156387222..156388699, Cluster 24
ctattgatatgttgtgttctagtctacgctatgcccatccctccttttatagttcaaggagacgggtgaatacgagtaggttacatgatatgtctaatctagtaacctagtcatacgagaatccaactctttacaattacatgtgtatattctttatcctttaggatctgccctatctgcttaggagactctgccttgtatgttggaattttgtcctatctatttaggacactcacttgtctctcctattctaataatatttttgtcatatttgtacttatagagtcctcgtattagaccttttaaaaatcatgacggctgagtccaaagactctaggtaggagacaactccgacgagtgagtccttaatttgtgtcagttgcagcgattgagagtccacgcgtgcggcttggatgaaccgaggttatatggattttaaaaatagtttaggttcctgataaacatttgttattaatttttttaaaaatggtcaaatctacttaaaccagcaatatgcataataatactaagtcaaatgaaaccgatttattaggtttctataaactagatctacagaatatagataataaaaaaacatgaaacatattttatattttctatgtaatattatttgtggatttcttaatatgttagtctaatctttgcgagtcacgtgtgtcatcacaagtgtggacgaaaatttatagcctaaacttagacataatctagtatattctgtaaaccttattataacaaagttagaaacgtttgacttatttagatcaaagacaaaatgaagtgtaatttggaaacgaggaagtaccttttagagatgtgtataaatggaaggacgacgtgcgcatgagcattggagattgggatgggatgggaggagcgtggaagcaaaactgatggctgtgccaaagagaagggtagcagccttttgttatcatagaacatgcatgcatgcaaacgaaaggcgctttcttttctcagagcgacagagggcaggctctttaatttcctccatcgatcccgcctcatgcatatttcgtctccgataaatcccttctcatcgcatcgcatgcatccatggtcctacactttccgaccagcagtcgaggagccgcgccagtccatcatcctttgcttggaagttggaatgacgtacagatatgatctgtgccaaacatgctgtgtaagcatcacatcagtcatcagataacctcatgcctgcatgcaggtaataaccatgtcagggctagggcaatcactccgtaatactcctattaatttctgctgatctgctgtaaattgcagcgaccaaaaatttaatcacggcgagactgcagttcgctggctgctcagtgctcaatttaggccttttttgtttgttataagaatgcaccagaaatcgttgcatcgatcaatccgactagaaatcatttcaagcaaacttccacacctccaactactta

SEQ ID NO: 3870 - DNA, 1597 bp, Zea mays
  misc_feature (1)..(100): optimal_loci_158084_G1, chr4:163647018..163648614, Cluster 24
tggaaaatccactgtggttttgtacaggatatgcactagacattctcagcttgctaggtatgtaacccttatgtttcttctgaattacactgtttagtagcttctctcgatcctttttatagtgcagattcaccggcagcactgtcatcaccccaatagataggcattagctgctagataaattagccctttatcccagaataataattgccaattattggtactccttttctcgattacaaataaataggtgccttcaatggaaggataactcatatcactctcaatcaccttcagagtccactgagtttcaggtctcttttcactcaaggaaggatgcaactctgctgctagtttatgcaaacatcgctatgctctttttcctgcaccaggatggggaaatccttatgttattgatcgtaacgttcttgaccttgcaaaggccaaggtgttgacttgagaggtgtggcggccggcttcttgaagtgacacatttttttttgttcagtgctggcccttctcatctcagattaatgtctgttcagtatgcagaccgcagtatatattagctttcgcatgtatagattgatcttttctatcgtgtgctggctggatgtgttgtgtttctttccagctggtagatccagcatggatgcctgaaataacatgcaatttacttctttaagaagttggtgccctgctgcattgttgccgtgtcgaattttctctgaaatgaagcttaaaaatcatttgccgccattgccctcgcatgctgcttgcactagacatgacgcaaagttaagtgttgctggccacttgggcggtgcaagtttgcagcttttctggaggctttttttttttgagcttaaaactttccggtgcggtgcaggttgctaaagtaagagacggcgtggaatgtcgatgcttcagtgagatattcatctgcttgtcttttggcgatagatctatattcgctttccattctttttgtaccagatggatctaagttggtttctccctccgtatttttttctctcgcatttgcagtgagatgaacagcgtcatctggtggttaaaattttcgtatgatttcaaaaggggggaaaaaaatctattttacctctcttaaaagttagtttttcgtcccttaactataaaatcgaacataactctttcctcgaacacatgacctctctgactgttttctcggtggttttcatttgtccggttttgtagttgagaaaagaaaacctaacagagacgacagtgcaaccatgtccgattttatagttgaggaaagaaaacctaacttttgtgacggttgatgaaagatgaaatggagtttttctcatttctaaatgttaaagcagtgtatttggggccatttggatcctctacccaacatttactaattgtacagtaattctggaggcaactgccatgttgcatgtgttaatttcgcaaccttttcggatgagtaaaatgagaaatttgattaacccttgacctcaggggcaacagtatcaacttgcaggggcattccttccgtcattctgtagtgtgtactaacgtcgtaggtaccatcattctaattaga

SEQ ID NO: 3871 - DNA, 1711 bp, Zea mays
  misc_feature (1)..(100): optimal_loci_159105_G1, chr4:170021793..170023503, Cluster 24
ataattgcatcactcgtttgataaagttttgtgtgtatcacctgctaatgaactatatatttaaggtttcatgtttcaatagctattatacttcattgtctgttacatatcagaatgtatagtgaactggtgtcaaacactatttctgaaggagagctttttgcttcaaagacatcatttataaaacttctgaggtatgaataatcattttatgatggttcctgttctaggtgattagtcacactagggaaaacagtttgttcctccagtgatggttcctgttctaggtgattagtcaggtgcattatatgtttctctggtttgatgacaattgagatgcttgattactcctcaactctggagaatttcaaggtaacatgtaactcttggttaatgccccgaactacctcgctatctttgtccaaagctgtgggaatctatccaaggtaagaatcatgaaatggttatcagatttggttggttcttgagctgattttgtaagtgcacccacgaattgctttattcagatgtgttttgtggcttatttatgtgtaaatcccttgaaggtagagggttgaggtaggattatgggaatctatatttaatctctactatatataattcactttacgattcatttttgatgagttattttatcttgcttgtgattctgaaataaagaccaatgttgcataatgttccccaatatcatcaggaagtattaacttgaatggtaaactcattgtcgaagttagaagacccggtggtgagactgtcatgtctaacatacttcacttagttgaagaagcctggctgacaaggtatagtatgtgaacggattcctacacttatgaaagttagaggtatgatattcaaagcattacatctttgtcatgttactatctcaacaatctttgtgtgattggaatagtacatttatcatggccaacaagaatcatgggttctgtagagttttttttacttctgtacttatttttttacagaccaagtgaacattggtgattggttactgcatctaattgtttttaccctttggtatggctaatatttaaaatggcttattttagttggagcacttcttcttgtcttcatacacttattttatgggcatcaccgatgaatcatgttagtgcattccattatatgttaatttcctattaatggaaatattggttttgttattattttggtactacttccatatattggtgcttgtggaatttatttgatcttgtactgtattatgggcatcaccgatggatcatggttgctttggtggtgtttctagatgagtttagtaacagtcttagagatccttgttttgccacatcattattgtggccttaattagtaataatttaactcttgatccaatgtcaattttattgttaacacaggttgcagggaactttattgttcctctacttgttcgctacaatgtacgtacatatttaatgcaaactaaacacattaaaatgataataaactacattcttatagtaaatctcgataaagctttagagacagatattttgaaatctagctatgcaattgtgcaagctacctatttttatctaagttattttgttggaccatgaggatacattcttataactatgaagcatttgcatttgcttctgttgtcccatgatttctctatgccatccctgaaagtaatttgcatcaacca

SEQ ID NO: 3872 - DNA, 1513 bp, Zea mays
  misc_feature (1)..(100): optimal_loci_165234_G1, chr4:203553305..203554817, Cluster 24
actggaatgtatttgaacaactatcaaatttaaacaaggtctaactatgtggtatatatagaaaccgtagcaacgcatgagcacctcactagtgggcatttaaatggcacttattacattcatagttcaaaagcaaatcattcatgagcagagaaataaaataaaaaatagacacacatctgttctggtttactctcctatctgctacaattctttgtaaagtacactttcatattccaactttgcctttcttggaaccactgggtgaattgataatttcactatcattttggaacgtgggtgatggaggaaaaaaaggtgtttgtcaatgagatgttatatttactgcagacccatgcaggaaaatagattcgaggaagcaatgcagatgaacattcttgtggttaaacatacctcttttttaaagagatcaaaggatgcttcagcttctagacatttcacattaaacacgacctcttcatcgtctgcacaatacgtggcaattttttcatctgttgtaatgacgatgataacactcttggaatgtctagatacaagtgcaggtcgtattaagtcccattcttccacagactgtagatcatcaataacaacaagacactgatgttcttttagaagcttatgacactcctgaatagggtctctgattcccacggcatctgagtgaaaatccaaaagtaagttccgagagaagtccctcaaattgaatggatgggacacgtggacccaaccatacttgtcaaacattgggtcctctttaagcatcctttcatagtacaaatttttgacaagatcagattttccaacaccagcaattccccacacagacatcacttgccaatctttgaaacgggccgtggtctgatacttacgaagttcattcatttgtgactcacgtccaacaagggtagactgatccatccaactgctggctaaagcctttctagaggtgggaatcctaccataagtaaggcctcccctgtggctcatttcatcttctaatatttcaccactgctagatattactcttccagtcttcttgctctgagaatattgataatatacagttagaagagaaaggaaaaaactgatgtttactatatgtgggtgctcccaaacccatcaaagttattataatctgattctgagcctagttctcatattgcctagagatttcatcaatcttcagtatatcaaagtgttccttgaatatcatgtaacagactgaaaaacatattaatatgaagtatccatgcaccactagtcacttgtaagtacattttctttactggcaaccattttaatgttgtacttgtggtataaatatatgtgagacctattaaaaccccaatttcatggttttatctaacatatcagaaaatataatgacagcatgtatcagagaatgtatttcacagtaaaaagttagataccattacagataaacagtaacattttgttcttaaaagtaatttgactctgttccaggctaacc

SEQ ID NO: 3873 - DNA, 2080 bp, Zea mays
  misc_feature (1)..(100): optimal_loci_167588_G1, chr4:215997272..215999351, Cluster 24
actgtagcgacggcgataaagatgaggacagtacgctggacgcatatgcagcagttgcagcttccgcgtcctgcgccatgcatgtgccctctctctctctttaagccatcaatacagtacgcgtgtgtcgaatcatatttctccaacaataaccatatatatgcggcgttgtaaaatatatatactggacacccaacacacgtactccttccgacatgcaatgtaagatcagtttaattaaccgtgctgctacctctaacacggagagggagagagacgcgcacaccaacagctttcaccctactggaaaaaggagatatgaatgaacagtgtgctgtgtgtctttcgctagcatccgtcgcatcccttcttgccctcctatgcttccctccttttagagcacagcggaacggcgtaaaaagggtgtgtggcgagagactccagtacaccatatcgatcgcaactattctgcatcatcccatcgacgacgacgacgacacacacacacacattattccggccgtcatgtctagcttgtacatatatagtggaccctgcatgtgttgttgtgacatgcatgtgggctcaatccacatgcttcgtccacgctcaaaaaaaaaacccccactactatacaaattcatgtattgtacacacaacacgtgccccatgcagatatgtatatataaaaagcacagattatttggggcgtctaacattttcaattcaggaatttgtggcgaacatctttttcgcgttcgtacaaatatcatgtaatgcttcttgtacaatttggttaaaaaaactaacaaataatcaccaaagcgtaatgcttgtacaaatatctactgtaaaaaaatagtttgtacgtgtaatgcttgtagagaagaagaaaaaataaaggcagaaaattaacctaaaaggatcgagcgaattagatgctaagctttacttattaaccatatatatgtatcaatgtccaaataagatgcggcgtgaagaaagaagccatatatacaataaaacactggttcatttgcggctttctaagatatgtgtgtgacgacgacagattagaacaagatacccgcgatgctacttacagataaacaatatataccattgtatatatattgttctaatatacaatggtcgtaggtccaatcagtctcagtagaagctatcaaaaggtttctatgaacagctaacactatatgcatgcatatgcaaagattacatatactacagcacaatattatatgaacagttaacaaacttttgacttatttagtatatacgcatgatccagaatcgaaaacgtacgcatgaaatttctctagcaaacttccaagggagttactgacgattattgttccagctagccttttcgattgaaaggaacagaccaaagccaaagagattaggccgaatcaccatgtgcctgattgtgacttctagttaattagctaaaaaatatggaatactttagttatttgatgaacaagagagtgcttactttttaagaaaccaatgaattcgcgtgccgtacgttttatctctttaaaaatgccactttgtgctcaccacacagcaaaatctcgcaacacgcataaatagtttggacaattctactgatgagaaactaaattacaggtaccgctggtagcttagccttaattagctcctctataatttcaagaggcaacacgcatgtataccaattagctgagagcatctgatccgtcaaacaagtacatatataatggggtgattatatctgactaactttagataaattttgcagatttagcattgttgtctgcgtaacaaatattaacaggatagcgaaataaaggtcggccaccatagtgtgcctggaggtcaaataatgtcttgtccaaactattgcttcatgttcctgtcagtgtttcttaaaattatagaccaccagcagtaaacacaatcgacgaccatcaatttgacagaaatgtaaacataagcacactacagtgtgtgtcacaaaacataaaacatctctaagtttttttagcattgaatatatatagaaggctcatcaaac

SEQ ID NO: 3874 - DNA, 1789 bp, Zea mays
  misc_feature (1)..(100): optimal_loci_16769_G1, chr1:93068685..93070473, Cluster 24
gaacgaggtcaggacgtcaatgattggggaaagttggcgctgtcggggccgcgcggggcaggcaggcgcgcgtggggtcgtgggtccctctgtctctgcttcgcttggtgcggtccgacgtggcgtgcggcggggccgacgaggcgggcgcgtccacgtgacctccctcccgctttcccgttccgatgcacgtgacgctgtcttccaagtcctattagggcttttattagggctgcggattaatgggatagaaatcatctccatttctacgtaaaaccctgtttggtttcattagtcactaaaatttaatgactaaagtttagtcgctaaagtatcctgtttgtttcaatggctaaaccaaactaaaaaacattaattactgtgaataatgattgtattacccctactaattagttgatgtttatagtaaataaggtaaaaatactactttagttccttttagtcacccttttggtgactaaagaactaaagtttggtcatcccactttaatcaccatatttgcttctttagagattaaaactgactaaactttagtcactaaactttagtcaccccaaaccaaataggatctaaatcaaaccagtccttagatatttgtatttccgtatcttgcaaaaataaatacaatacacttctacggattccattttagtaggtactttttacctctcaaaacaaaaatgcactttttaaaactctagtgaaatgattcatgctaataaaactatatatacctctacaaaggtgtaattactatcaaatagaaaacccaactctataagacaataactagagttaattcttctcgtatgggaagatataagataaatttttaaaatttaaaaatatacttatcatgaggcgaagatagtatactagcagtacggctaatgctcagcgtctatttattttcattagcactcaaaattaatagccaagattaatgctggtggattcaaggtttataaagttactaattggtaaccggagaactgctaactattaattttattaataattttcagttgctaataggaactaataatttaacttaatatccaaccatctattagtacattgataatccattgctaagaccctatttggattgactaggactagtgattagtctaaggccttgtttgatcctctggttaattttttgccagtaactaacaattagccaataaatatttagctagcaacaattagtcatggtatgtttaaagtcttgactaatagatgtattttctctcattatgatctattaacacttattagcaaggtcaaatgactaatgggtgaacaatttgtcagccacgtggctaacaattaaccaatttattagccaatctatttggagccatgtgctaaaattagccggcaaaactgtttgacagatgaatgcaaattgaccctaactcttttaatgtagtatataattataaagacaacattcaaaaggagtttcccacgcaaccatgtttggttcccacgccgtcgtgtgctagtgtttttttcgttttggattacaataataacgctgcagtgtagttgttttgttctaggacgcggcggcacgtggagcagtggagtgagcaagggcggcgacgtgtgggaggaacagtgcgtccgagaggagatagtgttcagcggcatgggcgacttatgcagcagtgagctaacaactagttagaaatttagttaaacttaatcgtacacattagtctctctatttagattttttaggactaaaatctagcaact

SEQ ID NO: 3875 - DNA, 2163 bp, Zea mays
  misc_feature (1)..(100): optimal_loci_167845_G1, chr4:217674210..217676372, Cluster 24
gaccacacacctagaaacgtatccataagtacagatcaattgtagtaattagctcatcctccattaaaaaggttatgtggtagcacgaaaaagttgctcaatccaacattaacaatggatagtccttaatcaactcaagtggtttatgtcatcgagactcctctcgtgaccctacaacctatttaagtttcacattctttttaccaacaacttccatttagcaacaaatgacactaccatcatgattaaaagactcttctagaaatgtggttgattagcttataaagattccatactataacccatatgaaactagactcactttaagcatgactaagcaataaactagtaatcattgacccaactacatgagggacaaggcataagttagtaaaacaaggaaggtaaaatgcatgaaatcatatctactacccaaatacagaaccataaaccacatgaaatccataatataaaataatatcaagttaacattgcaaaacttgggaatacaggacatttttagttggatgcctagtgcttttgtggattcctcaatttgattgccctctgactcatgttctttggtttcgggctccagaatttcactctttatcatgtaaacggatgcatgcattagaatgatggcatgattgtaggtgatcatgaaatgcttatgaacttggatgatgcaaaaaaaattaaacaaacacaacatttcaaaccattcaaacataaaggtggtggctaggaggtgcaaagtttaacttagtgaggtgaggagtacatatttcaacataatttccaactacagggggcattaacaactcgatttagttactaaaaactggatatgtaaacttcacaaagttatgtttaaatttacatagaacaggggaaataacttcatgaggtagattgtccattttaacaccattcaaacttatcttttgtttaacttcattttgaggttacaagtgttggggagaaggctttgccaaaggtcctcatgtaatgatacctattgttttaagtttgtctcataagttagtttctgaatactttgaacatctgcttcaagttacgaaggatgagattaagccccgttggtgaatgaatgtctgtgataagaagtgaagggcaaaacgaagcttcatttaccttgggtcatgaggagacgaatggagcacgacacatcttatctacaaaaagatggagataccatatagcaattgtataaatattgtatgtaggaactgaggcatttttgtatcatatgaagatgcacgccttagtatccctataattaggtgaacagtacctatgcaaatgggatgacattatttctactctcgagtctatgcgacccccggagagctttgcctttgaagagtggtcagtgtttacctctccaaacgccctatgggaccttcaaaggtagttgtactcaataatttgtaatccttcatgtatgcacattcatattcgataagaacacaagaaaagaaagaaaggaatatggaatgcaactggcatcattttatttactgacatacaattttgacaggttaatttctttgttgttttgtccttatcctcttatctgcacatcttcaaggataagggaaaaagattttgtccttcagttgtattgccctaatatggttagcttttaataggtgaccaacacatagagagcaagttaattcacaacaggtgttcataattttacaaatagcatcaagatgatttttaaagttctaagcaaggaaataaaaactaaaatagttggttttatatttttagcattttgtgccagtttctatgtcgttaaccatttctaggcaataaaaaggaataaatacataaacaataaatatacttgtttcatgagtatataaatataaatatgataaacataagttaaaaggggtcggtaaaaatggtctcagcgtttttattattataggcatttagttatgcatttaataaggtaatacattttaaatatatattagttaggtatccgatgcgtcgctacggtttttatatattacattgttagattttgtttaaatatgataattgtttaaacgcgttgcaaattattgcaataatactaaccacaaaaatccatatatttcagctttgcttgtctctgggctt

SEQ ID NO: 3876 - DNA, 1639 bp, Zea mays
  misc_feature (1)..(100): optimal_loci_168431_G1, chr4:220943754..220945392, Cluster 24
aagacaaattcaaggacaccctaagaaatcagcaacaataacacatcgtcagtaaataaatctctggaacctcacctagaaatagttcttgccttcgtccttcattttctcgcttcaggacagatcagggaggctaacaccactaccaacatcagcaattgtctggatatataaaagaataagtaggttataaaagaataagtaggttacatctttaagaacacaggaacctgatgtgcttggtagataaggtccaaatgtgaatgaaacacctcgatcattgatggcccagcctgttgcttcattggaaggataagaccaaagattatcacagagcaaaccagcatcaggcaacatgtcttacaaccactgtaacatgcagtgctaattaactttatattcaacataatcctatacttattctgatcacaatatttgcatacaaatgattttcatataattatacagtgaagtcgaatcgtattctgaataatgaaagtagctagatgtgtcattaacactatttttagcataatcctatacttattctgatccatcaaactgtaccctaggtagctcctctgaactcattgtcaagaaaacaatgaaggtcgatatcccagtagataaaaattatacatagatgacaacatgaatctgaacggtttagggcaagtagcatcagtacacacctgaaatgaaaaggttttcttgggcgggttctccttggcgggaatttctcctccttcctcggctccttcctcaacttctcctaaatgctcaaaatcatgtgtaggtagacagtgggaattttcttttcttcattacttgactactcaatgcatatccaaaaagtacagtgaagttgaatcttattctgaataatgaaagtagctagatgtgtcattaacactattttcagcatccggacaggtacaatttgaagtagcagagtgaagacggtaactaatgcaaatgcagcagcaacaaaccattctgagaccgctagaatttattatatgaagtcactcaacaacctttgcattgaatatatataatacactaatgaaatcatagatgcctaatagttaagcacaatatcgaaccactctcggcactaccaacaccactaaatgtacccaaattttttttgtcacctgtagtttcaggctgtaatgtctgcttgggtatccatcacaaaatttgttttgttgataaccaagagttgagcatagatgagatattaacaaaattctataatcatagacatatgagctctggcaatcatcttatcagctattagttgtagccgatttgtgatcttctcataccttttggctggtttaccacgaagatttcccttgaataagttggtaaatagaacttagctcttcgtggccattatacttgagacctttagtttatctgacaaaatgtcagattagagtaaagttaagcaatattctgtgagagcacttgtcttagtcagaccaagagcaaacttgcttagttaatccactacagccaatcaagcatttgtcgcaactacaacagtagctcaatcagttcacggagacataaaacaagactaacctcaagaccagcgccttgcctctggaacgtgcgaaactcgtcaacg

SEQ ID NO: 3877 - DNA, 1433 bp, Zea mays
  misc_feature (1)..(100): optimal_loci_172554_G1, chr5:1230728..1232160, Cluster 24
cttactaaatgttatggcacgacagtacgagtgttagctggaacctactaaaaaaacttgctcaaactcctacctatatatttagctttgaagatagattgacaacatgttttcaatgactctgatgtagacctgcactcctgcagatacacagtgttgatactgctactggtaattgctgcagtccttgagggcctccagggatttatgagaactaacttgtttgacttaaaaaaaagggttccactgacatccatgcctcatgcacattagttgagatgaagttgcccagcgtacattaggcaggaactgaaggataaggctcaattatatttctgaaaaaaaagaagtgactgcatgccacaattggtgttcagttaattgcatctgttgctgattactgtgaagcacacaataatttatatgctcatgcttcttttgactcttgagaatggaaatgccatgtgtttgctgttgtaattgccaattaaaaaaacatttgctagatgtacgctttgaacatttatctctcttacatatactaatctattcatctattgatgcgacttctgtccactaaaaatgcatgtactttgattaactgttaatcaaaacttacaaaatttgatccttccaaatcttaattagatagtacttttagctgctgttgagaaagaatgtgaagactgaagagagaatcagtatttgcaccccattttccttcatgtctgatcatataactgtataagtgacccctctagtagttttttatgaacttttttcttctgaaattatattatgaacttgctgataattattataatacacatattttcattacgtgcatatatagacatatgcttattctcagcctgtgccttcttatatgtttatagagtttgtatcacacttgaacacatttcccccattgccaggttctgaaagatggtctatcagctctccatgttccttattcatatggctttgcaatcattctcctcactgttcttgtcaaggcagctacatttcctctaacaaagaagcaggtgctgtatctatgctatgtttctaaagttgggatatgcccccccctcccccaaaaaaacactaggagaatgtacagtcaggattcattttgaggtagttgaatgtaggatgccataaatactcttcaaagtttaatagtgaagaatactttctttttctgggcatggctgctcttattgggcacttctcaactgcagctcagcaaaatttattgagatatttatcgattttttattacacgtgtggcctaaatatctggtggtgtcagtactcaatattttctttcttctgactacccgattattttcaaagatatcctagaaaatggtaccgttcgagacctcatttgatcaagtagttaaccgacttcattttttgtattgctg

SEQ ID NO: 3878 - DNA, 1784 bp, Zea mays
  misc_feature (1)..(100): optimal_loci_174393_G1, chr5:11955775..11957558, Cluster 24
acgacgtcggtagaggccgtacattttgcgcaactgtatgcacgacctgctggacatgtgaatagtacaattctgttacatatttgcgatcatatgtgtgagctattggaggccgtcttagttcaacttataaaataaaataattttctagctttaatagttcaatgagaaagcaaaaaaatcaggagacaatgaagtaattaaaattcatccatcacaagccattcggaggggtaaatatgttaacccgagctcttcatcaagataagtaattttaagttggaaaacgtcaaaattactcccctcacctataaatgatgttcatataaccccttaaactatttttagtttaatttatctctccgcataattgagttagttcaatatacctcctaacaaaatttgtcttttttatttctttacatacaaactaagttatttgtttaaatttgttggttatatctaatatcataacttagcctaaaaatatattatgatttttcataattattttgataagttaaaaccatataacataacaactttaatgatacaaaactaaatgtaaataaatgataaaattttaacatatttttctatccttagttatgatgtcctgaatcacctcagaaaatatgaacttgaattcaacttttacatagagaaaaaacaaatctttccctaatatgatttgtcttttttgtttctccatataaaattaaatttcaagttcatattttctaaggtggatgaggacatcataacttatgttataaaaatatgctatgattttttatcattattttatatttagttttatatcattaaagttattatattatcagatttttaacctattaaaataattaataaaaattacaatatatttttctaggctaagttagggcattagctactaaccaacataatttaaatcgaaaactcaacttgtatataaagaaataaaaagataaattttgttaaggggtagattaaacaccatgcttcaggtaacaaaccaacacaagtaatacaaaaccagcaacaataccgagtatatgctgttttgaataatatatttgcaggaaaaagcatagtaactgtttaaagaaaatgcaacacaattcaaaaggagcaaaataacataaagttattatagttgaaaactgatagtagacgaggcaagtgggttccaacacaaaaatgaacaacaagaagaaagtcttttactccatgcaagttgagtagggtagagttaaaaacccaataacatccacaagttaagggtttgtacatatatataattatttttcatgtacccctattcaaagctaaatctttagatgtattctatccttttaagtcttctttaactctctttctatatcaacttcatttttcttctttctgtcttctcattgatattgtgtaggatttcattatgcattgacacatttggaggtctatgttggatatgttcaaactatctcaaccgatattagataaacttttcttcaatcagtactgtgatcaagtcatacttcgctactgcgatcaatgcttcagctaacatgttcttttatccagagcgcaagtatgtgacctacattcaaaaactgcttggccataacacatcacaaagatctcacctacatgccacaaaagtagtatagcatatcgttcttagatgagaactctttgcttcataacaaagaaagtacatggcaacacgatttattcataccaagtatagggctagaaaaacaagtactatagctcggctg

SEQ ID NO: 3879 - DNA, 3035 bp, Zea mays
  misc_feature (1)..(100): optimal_loci_174735_G1, chr5:14023720..14026754, Cluster 24
caagctcacttcacaagttcacatgcgtcctcgtccttgggttcaactttaaaagatgttttcgaacataagcttgcgttggaaacaccaatttgtttgcgggtgaaaatgtatcgtgaaatcctagcaagcgaggagatactaactagtacattcatttgaggctggcagcagcagcaggatgggcaggctgcatcaatgctcgccatcacttgtccaatcggccggccggctctcgcggagctcgtagtgcgtgtccaatgtgccggtgccggagacgacgcatccggcatttcgggcactgaaatgtcactcgctgccgttggctcgtcaaaacaaaaggctcctacaggcaacagccaacaggccttggtgtttgatcccgtcggtggctggtggctgccttgtctggcgacgaaatgaactaccacacggcgggtctgggtatcgtatggtcgcgtccgctccagccctcaccggtcacgtcgtccccccggcccccccgggcctgtcatggcagcgtctctctccagtcagatcgacgcagataaacgcctggccgcacttgtcgctgtgctcatgcctggccatttctcggtgtgcgtttatcgatcggcttgccgcctgacgggatgctactactgtcctacactggtgctgtacctatatttaaaaaaatgattctcgatttcaattctgatattgtcatcgtgattcgtgaatcgtgatacgacatgacgtaccttagacagggcaagttagagacacgttgatcctgagcacaatctagttatcagcacacaaaaaagattatataggtgtttgcataaaaagattatacatcaattatcagttttttcacaaaacctttgaattcttctcgttttttgcttatctttgaggagaacttgaaattatttatccaatgggattattctgagggaggtaactactcgtatcattctctctctctctcaattttattttaaaattgaaaatataaaatcttggaaatacagtgattatagtttttgttttacatatgatatttgaagttatggttgtgctatagcatattcgcatttttatgtatgtgcgtatatggtatagtctttggcatgactttcaaacagaataacaacataaattaaatctagccctggttgaactttcttgattactttgagcttcaataaaagtactaactatgaattatgaaagttatatattgttagggaaaatagaaatatgcaagatcaaggaaatatgcattgtcacacttcttcttttcaacactgttaaattgcattttaattggaacttggataaagtcatgtatgattggggccttgttcttaaacttttgattgtcacaaaacatagtcttaactgggtcaaaaataaaagctacttatgcatagaatttcagtaatttattttattgtaataaacaatcaatcaaattcaagcacaaaaatgcatagcatattcgctttatccaaattttaaggtagttgagaaaaggataccttgtcttaaaattagttattaattacgctcatttttaagttatgttcggaataaattatgtgtgcatagatgtgaaagtgtgactatattttagcatgccttgtatacatatttgttacatgtgtggattaattattggatttaattataatgtctagtattacaaattacataaaaagaagtaagttcatttctttttgtattcttgatgaatttagtatcacaggaagagaattttttaaaacatacattgtacaacattacacatttatcgtttttagagggagattttggttttggatcctttacactgatcttttttactttgattttgaattttaattggttttgtaaatgaatgtcaatgtttaatgtctatgtggtgttgctaatattttcgttaaggagaatattgtaaaatcttgtgtgataatccattgttttatattagaattacctttgttaagtgattaacatgatatgatgttaggcatgtgtgctaatgtgtggttttgatattgatttaacacactcatgggcgtggagttgcatggattgacttcgagggtgcatttggttcagttttttgaaactatttccgttttaaaaagtagaagctaaaccaaaaggttcatcttttctagtactacttaaaaaacaaccttttgtagtacaaatttgaaaatgacttggacccgacttttgttccttatctaagtttgatatattaaaaaaagatacgataatttaaaactaaaattagatttaaaataattaaatgttataataaatgaaataaaaatatatttttaataaaaataataaaaaacgaaattttaaaattgaaaacataaaattttggaaatatagggactatagtttttgtttacatatgatatttgaagtcatggttgtgctatagcatattcgcatttttatgtatgtgcgtatatggtatagtctttggcatgactttcaaacggaataacaacataaattaaatcttgccctggttgaactttcttgattactttgagcttgaataaaaatactaactatgaattatgaaagttatatattgttagagagaaaaagaaatatgcattgtcacacttcttcttttcaacactgttaaattgcattttaattggaacttggataaagtcatgtatgattgggaccttgttcttaaacttttgattgtcacaaaacatagtcttaactaggtcaaaaataaaagctaattgtgcatataattttagttatttattttattgtaataaacaatcaatcaattttcaagcacaaaaatgcatagcatattcgctttatccaaattttaaggtagttgacaaaaggataccttgtcttcaaattaattattaattacgttcatttttaagttatgttctgaataaattatgtgtgcatagatgtgaaagtgtgactattttagcatgccttgtatgaatatttgttacatatgtggattaatgattggattt

SEQ ID NO: 3880 - DNA, 2176 bp, Zea mays
  misc_feature (1)..(100): optimal_loci_17536_G1, chr1:97507341..97509516, Cluster 24
cttatgagtgatcttcaccaaactgtgtagagtattgaattatgaaaccatatgttttggaactgctaaatattattattagactagtgataaccatactttcgtatctacgaaggtataagtattgtatcactcttatcgtaggagtataatgtatctatggaggtataggtattgtatcgctcttataggagtataatatagaacacaatcggtgaagtgcatactcatgtgagtgatcttcatcaaactgtgtagagtactgaattatgaaaccatatgttttggaactgctaaatattattattagactagagataacacatcatttttttgttgaattttcatgagtttaatggtttttatttgacaaaacaaggggctttgtttccccctttgctgccggtttatctgtttatgaccgattaatcggttgcattgactgtttaatcaattaaaagctaagctaatccaaaatttgttgtgttcaaatttagctgatttcaacaggtttccgtcgaataatcagtaatcggtggtgacctttttgtgggtgtgactaaggactacattttcgatttaattttttcagatagctttttgttgcacaaagttgacacttaaaattttaaattcactgaaaccggatcggtttttattttcctatcagtaacggcaatgggaaatattaccgaaaagcagtcaagaaactcatccctggggtgaccagcttggtgaaccctgtgcacgaccaatcagatgacatccatatcttcaagccacaattagtttgactaagtattatataaatcatcactgtcttgatctcatataagttgtttatgtgaccgcctaagtaacaaggtacatgttcagttacaatatacgttaattcatttgttagatttttatgctaagttattttattaccctttttacaatataaattactcctttaatcatggtaaattactgccagccgatttgcaatgtagactaggctgaaggctggtggagagctgagttctgttcccgaactgtgctcctattcaagagcttaagagttgtccagttatgcgatggaacggggcatgaccgcatgtaccattgaattagactcgtttttagaaatgaacagataattcaaaagattactatcaaattgcagagtaggtactaagaagatcgaaatccaatagagctagacgggtagagcggctgcagatgcgatcagagcctgtcgggatgtatgagaagtcatcactttatgacatcaggggattgacagactttcatacatgcatcatcacctcgcatcgaagatcaactaacaagaacaaatatccgacaagagaacggctacgaaaaccaactcacaaaagagactatgccaacgataaaaccgggtcagttggaagaacacgaggaatgaatctaagagaagaaaagaaataacaagtggctcagaacttcttagagggtttgtgcaaccaacaccggcgtccgagggatgcctccggcacacggatttctttcctcatcgccatcaaactgctcaaaacgatatagtaatcgacaaacagaaacaaagaaaaaatggagaaaacatgaaggcgaaagaaccatcggacacagagagctagcaacggcggcgatgggaaatctttcgctgtgctctgttttatagacgcacaaccctaacacctggacataaaaccctagatgtcatgggcttgattgctgggtccagcaggagcgccgcggtggaactagcccatgggcctcggatcaatcgggtgagaacctggtgcataggaaaaaaaaactcaacaaatcctcggagtgattccaactgccatccagtcgtctaggttttttttcaaatacacaagagagttacatatcatttcattacaagaaattaaaagaaggatgaagaaaagaaattatatacgcccagccaaaggctaaggcacacagacacgcactacccacaaggttggactacagagagccggttaccggttaggaaaaaccagcaacaacagccagcaacctgacgacactaagacaaaacacctacatcatccacatcctgcagcaactggagctgggggcctttagcaccaaccttgctccaccatcaggcctcctctccaacattggagagagcaat

SEQ ID NO: 3881 - DNA, 1544 bp, Zea mays
  misc_feature (1)..(100): optimal_loci_180774_G1, chr5:46766763..46768306, Cluster 24
tattatcagtaaatcataaaagagggtggagaaagtctatcttactatccacgctacaaaaattattttcgtctaaaacctgaacaaaattctgacttgatccaagagagaactttactgtcacaaaaaaacataggagacgaagggaggggcgtaggtggcactgttgcggtagagccgtggagcacttcattcgcgctccgtgagtcgataacccttggcaacggtttagcaaatgcgagaatgatcttcattatttttttgttcgtggtcaatggtaattgttttacttgtgtctggtgtcgctatagctcgttgtcattgcctttctattattatattcctcttctgggctatagattgcctatattttggagttattttttagctaccactaaacactaaacactcagtcccagtgtagtttagtcaaactaagttaggtgccccaactaatctgatttttatatttttaataattacttggcccgtgtttcatgagatgatttgttaatgttaacttttctgtttgtcttactgacggagtggtcaaatggcgtaccttgtgaaatcagttaggccctgttcgtttctcccagaatggccctggaatttttcaggttcatcaaaacttacataaattagaaaagcaatgtggctcggaattgttccgggtcaccgttcccacacaatcgaacgcccccttaaggtattctgtacgatgcagggaacatgtgtcagctgttaggctatctccaacaagcaacaactttactcatcttatctcttattttaaaattcattttataaacagtgtagactatagtgcaaaattgtacattcatatacctctgatggcaacagccttattgatggcgtggtggcgtagcttgtgaaatccgttaaggtattttataggatgcaggaaattagctgttactgatggagtggtaccacaaatgaccttgtgaaatcggttaagatattcgtaggatgtaggaaacatgtctcagctgttagggagcatctaattcctcattcaagatttttcttttctcaagtttgagcaccagaataaagtaaaatatataggtttattgggactgtttctttatttgaatcacaactagtttcctgtttgagttaaatgcataagcagccctgaagtcggtgccactttggtccatgaactttgaaaatatatttcaagattactaaagttgttaagtggtgcaccacaatggacggtatactccaaaaatagacttgctatgcaccatttcactagtttagacatatttcgtgcaccataaaacaaatttaaggacccaagtgacacccttttataagtttagacgtcgctgatggatttaactcttcccgtttttatctgaaaataaagtttgtgtggcatgcataaagttgaaggacaaaattagttggatctttatgggcacgagtagaataagctgtcatcttttcttggcttgaagggcttgtacttcaacggtgcatgaactgattcatagaaaccttggtttcag

SEQ ID NO: 3882 - DNA, 1473 bp, Zea mays
  misc_feature (1)..(100): optimal_loci_181950_G1, chr5:54482029..54483501, Cluster 24
catcacgaacgaacatgaccaaacatgtaagtacgaccacttgaattcaatgttgagtgaagtatccctagcattttgaatcctaaaactgaaatacacttctccgaattctgaaactgaaagaagtgtccctagttttctaaaacggaaacaagttcagccacttgccccctcaaattgaactaaaactaaaacatgcaagcaaacataaaatgtctataatatcaaacataacctacagatatctacatcaagactagaagcatgtgttcttctaatgttgtcaaaatgccatgcctagtcatgtcttagacgaggaacttgggctccaaaagaaaatgtcaccaattgaggagtctccaacaaccacacctagctggtcacacatgacctgcacaattgccacatgaaacaacactatattaattaatttacaatcaacagttgtagcttctgtgaaagacttaacaaaatgaaggcaagaaatacatatgagtgttggtgaatagactaattttctctttaggttactgcacagaaacccgatgacataatagaacttttgaaatgataaataagcagtaaattgtgctaaacgacaataaagtgtgctcattaaataaacatggctaaacaatagtaaatatgatatgttactaaattacagactttgaatatatcattagcaaaaggtcatgtacatgcacacggatgagtttgttttatgaagataagcagacttcgacaatagtttggtttcctaagtattcaagacacttgatgaggcaccacatgtttcaaaactacattcttcaaaggtgaacactgctgggcagtacacaacatactgctcattcaaaagaaacccgataatataataaaacattgaaataataaacaagcaataaagtgtgctaaaacaatagtaaagtgtgatcattaaataagcagtctaaacaaaatgttaaacaacattgaagtgtgatcattatgaaataaacaatagtaaagtgtgctcatttatttcatgtgtagttagccttaggtatgcttgctaagtcatctcgtccctcaaccacatcaatgcaacctctctatatgtatatgttcaagcaaatatgttgattgtcagggtccttgaacaccttataggctttggccttctcctcatttgtgacatctaaagtgtttagaacttctatgcaattcttaattgagaaatcatcacctcctcttcctccctttctcttgccaattgtgtcgcctcatcttcagctcgtttgcttctaatgtctaggtacatctccatcaatacttctatgttggaactcttcttcggcctctttagtcctttttcttctccattccttgaaaacagttgtagtcctttttggccttttatccttcctatcagcatttacatgaacccttcaacttcatacactctgtcttctgcttcattttgtccgtgcc

SEQ ID NO: 3883 - DNA, 1579 bp, Zea mays
  misc_feature (1)..(100): optimal_loci_182869_G1, chr5:60136635..60138213, Cluster 24
cacatattcatatatataataagcatgcagcatcagtctctgggtccagtcagaatattacctttcttcatttgatacacacatctcatcattcttctcagttaattaactagtcatatgcattttgaacaaaacaaacaaacaaacaaacaaacaaacaaaaggagcacctacttcatacactttggtatgtgatctcttgtcctagctagcttcaccatgccctgtaaaattttgatagctcggccggcctacagtctagtccggctctacatgcatgtagagtggtacagtgtgtactgtccccttgtgctatactactatacgtctagctagctagctcttgtagcgcctcatctctcctttgctagccttcttccttttcaccttctcactttcaattgtatatttcctttcgtttcaagaaaaccacacgtatagcttttacatttgtacgggtaccgttgttgctgcttaatggacaccagtaggattgttaatcaggacaagctagtttcaaaagttcatgcatgcacgccgctcctcctgtctactatgaatcaggattgttgctgcttggacaccagcaggattattcatatataatagtcatgtttcatgtttgttctagctaattaataagttcacctagtgatctgtttaatttgcactcatatgcatggcataaattctagccaatatggttgtactgtcacgtagaagcatgcacaatgtatatataagatgatctttatagcattacatctaactatagaccagtaaaagttactttgattagatagatgggaataaatggaattggagatacataaactaataatggtatagtggcatacagtagtatgtaggtagcctcaaattaaagcagctcccgtatgtgcatgcataaatctgagtaggagtgcttcaaatttttatcatttatacaccatatttggaagtgttttttggttatgagaattcacatcctgcttcagacactcaatggagaaccaatctttacatgcatatatatgtgcctatttttttttacgaagttagagtaagtaagatttgttagattctagagcaatagtgttgcataaacaactcaactctaccgtgcatttcaatgacagtacaatctttttcatatatatggcttacagtataaaatttgcagcagtatatggtgcatacaaattaaattaagaaacctagtatttctctatgagcactattttttttgttattttcatatcctctacagttttgaacggaagttttagaaacatattaacgactcttaggcctcctttgggagggctccgacttcttagaaaatggcttcggctctagctcttccgtagaagtcagtgtcttttacaaattatttggcaaaacgactcttttggaaatgactcctcgtgtgctttctactacactgcttcctactgcattcatcaaacataaagaaaacttcagtcaactgatgcactactttctattacactggttagccaaactatattcaagttttcacagtttgtctctgtgtgagtttggctaacaggaacag

SEQ ID NO: 3884 - DNA, 2323 bp, Zea mays
  misc_feature (1)..(100): optimal_loci_186110_G1, chr5:83855156..83857478, Cluster 24
aattgagtgattcgttgtctgctagcccacgtgcgctttctaggacgagaagcaggcgtttgaatgtcacccctaagcaccagaggggtcgggttgggtgaatcgctaaggagcgtttggtttaaaggattacttcatccaaaataaggtggtgcatcataaatttattctcaaaattggtggaatgactacattctttatgttagtactaactaattaactatgaggaatatgataataatgaattaacttattccattccacaaactaaataaaaaataagaaatgagaaaacaataaactagtttattcttcaaaccaaatgttgtataacattgtagcataaaggcttgttctgcaagggtgactgggtttctcagcccacccagagagtgagtaccttgggctcatgtctcgatacgccacgtgcatcaaagctgggcctgcattggaaatttgaaatagaatacataaattatagttatggtagtagtagtccagaggaaactcgtgagaagaatggaagaattcagatgaaagataagttttttttcgagtagcactacattttttttatcagctgcacgttggttggtgtgtcatcgcactgtaagccaaataaaagaaaaagagagagagagacaacgaatcagatagcaaattttaggacaagcttgcaggtgaaagattcttaattctacatcgttatgataccgtgtcacatgatttgagacaatttgtctggttgccattgccatggaattccacaaaaagcgcattttaatcaagtttagctattatcatgtagtatataatatgaagtaatttttacgaggctccaaagtacaacggaattgcagaagctaaacatggtagtagcaaaattatgtacattaaccttatatacacataaataaaatcgatctttgataaacatgtaaagatatcttgcctataaaatcataggccacaagtcacaagagtcgaccaaaagcatcctaagataacgatgatttatgggaaaacgataaaatttgtttgatgtttaagtcaacctgaatttacaaagatcggttcaaatttttgaagaattaccgagttcatttccgacggcaaaatagcgagtacatgcgatgattttcggaaacgaccggaatagactcaaaccgtttcatattccgtttctgatttttttaatatattctaccgattctatttcagtatcttcagcaaccggttccgtttagcactgaatttcggtaaaatttttataaacggttcccgatgacccgaaacgccggatgtgcttcgccccctacgttgaacaaacgttgccttcttggtgcatgttatatataatgcgagaaaaatggtggtgagcgatcaagagccaaacgggtggcgtaactttggatccagctaaaccctagatcgcacactgaacatttgtcttcggggatcttgtgaacgacagtcgccttgcagcgaatgcttgtagcagtagcagccattctagcgcagcgcaggtgacgcacaactgttaaaatcacaaaccctaaaaactgaggaaggcgaagcgggaagcgagctgggaaagatccagcctggtctgggcttcgtggacctcctcaacagatcgaagcggatgtgcttcatgggccccggaaagcgggaaggcggtccaccgttagcgattctatattttttttataagatgtttctcttgcatagagtgcccaacgctctgaataaacctaatatttctttcatcacactaataaatcgaatacttttttcccattacaattctatagattcgaatataacgtttctttcaccgtagctacactgtacatacgtgtcacgtgtgtgtacaatgtatggtacggtacgcctttttgcacatcctgccaatcttccgaccgtttcccgagtcggtcgttttttttttttggcacttgtgcagatgtgcatggtgactcagattacgtgcgcaaagagtacagaggttttttttgttttttgtttttgaaggcgaaacattaaggagagagagagagagacggtcaaacatggaactgtaccgtgtgcacttgcgcacagatcatcggatagatatcctctcgaggagtccagtcaagtgtgagccatccgttgcttatccagagttgcacaccgatcaacccttggatcccctacgtgtaccgtgatgtacagtaacggtgtggttcgttgctgtggcaggctagccaggcttcccgcagcagagccaggatacgcagcatggggttaaactttatgcaagacatacttgtttagtttt

SEQ ID NO: 3885 - DNA, 1521 bp, Zea mays
  misc_feature (1)..(100): optimal_loci_187687_G1, chr5:93833120..93834640, Cluster 24
  modified_base (645)..(645): a, c, g, or t
  misc_feature (645)..(744): n is a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
caagtgacatgctagaaacacccaacacatggtagaccaaaagatttgcatgtgttgtgtgccatacatttgttaagatctgttgccttatacccttgtttaaatctagttaaaggatacaccggagaatctcgaacaagaaacaggcgttcccttcaagttactgggtttacatgcctaagtagagcaattccataaaaacaatcttggataggtcactcaacgcaaacatagtgttggacaaactttttgctagtaaaagtgttgtcatggaacgattaagataggtcctaagcctaagtgcttcactcaaacaagaatattaccagactaaacttgatttaaaatgtacattctaaattacttgccaagagaatttacatgacataatatatatgttttgccaacattgaaagtgattatactgccaagaaaataaggtctggagattcagtacactggaacaccatcagagacaatactaaacagggaaacccagatgtcgatgagagtaaacatctgctctcaaagcgtgcaaccatgaatacaagcatagagcaagaggacccaaaggcaaacagtacaaagagtttctaaccaagctttgaataaagcacaacatcttattagtggatgttcaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctagtggatgttcaatccttcattttaacattaaagagaatataagcatgcttgatagctggaatcaagtagtggatttaatttccaagtagctctaagctatgagcatacaaatcagcaatagaaaaacacaagcatctaaatcttccctagcaagaaatatgccatgcacaacataaattgactcaacatttttgggcatcatgactcatgcatataccaattttgtccaaacaatagcctgacaagccatgatagttagagctaatagcataaaatctctctgtgattagaaggtagtaactaattcatcagcaattttttttcaaacaatatataccaaagcaaagtagttcaaaaaaaattcaataccaaagcatcagataccgagcaatgaagtatccaactatccatgttgcacaaagcattaagcaagaataaatgcaaatgcagattaatcccaacaaaggaacacattggtttagcttctcctatcaaatcaatgtaaggcctataacagtggtcaatcagggaaagctggtaaaccaggcacattacaaattagctccggatctcctctcaccaagaacaaacataaataggcaatgcaacagattgttctgctaaaacttatccacccaagcgaaatacttaggttcctctatctcagaagaaaaggtgcacaacaaaacattccgcccaaatttcgctcgaagggagaatatggaaatcctctagaacatatgtgtgatatttagctgatgtattgtccat

SEQ ID NO: 3886 - DNA, 1451 bp, Zea mays
  misc_feature (1)..(100): optimal_loci_196090_G1, chr5:151421094..151422544, Cluster 24
taagattctcttccacctaatgctcactgcactacgtctatgtgttcacggagaggtggcaacacaacctttaacctagaccaaacatagacacagacacaacagaaaaaagttgttctgtagaatgaaatctcatatcagtgtcacaatgacgcagaggccagtagttagcaccactcgatcgagctgaggatacccagggcgacatgcgtgatcatgccaaccaaccttttcttcctttttctctccctctccctttccttcctagaagcccaagatgcccgagtacctaaccaccatctccgccgtcgggagagtgacacacagcaagtcaaccacagtgcttgctctgcctactattctgttatgcctgtttttgttcgaatcgtttcagatcagtcgttggttacacttgtcgatcgacggctaggccggcctactgttttagggtaggcttggtacacttgcaagctatatattgtttcgttgcaagatcaactggcactactagcagtttggctgatgtgcggtctctcctgctctttatttgtcctattgttctgtattttcaacactattcacatttctccagagaaccaaaagagagatgccactgcgatcgcgctttccacattgactttcggagagatgtccgagtgtatcatgttgctgatccatatatatggcatgcgaatggtagtacgagtaactcacagtcacaacgattggttcaaagttgtagaagaagagagagagacactactcggcgtggtcatcagcacttcagcagcaagtagggtgtgactgtgagtgtgagtggctttcgtcacatcatgtcgtcgtcgatggagctcgagcatgtgccttttcttggcttgatttctgcaccggagctcaccgctcaggtgagcagttcagggggccatggggagacccgtgggtggatattgaaacacgatccgaacctgcaataatttgggtctctaaacccgaaaactcctggagaaaaataggacccgaccttgaatccgataggtcccaaactcgtgggtcttcgacctaaacccaccccactgtcatccctagttgtgtgtctttaaaaaaggatttttttcctgtttgagcttaagcctctctgataaggcatacatttgttgccctgattcttaaactagaacaaaataatatctttaaaataacttggtatcaatatccataaaattctcaaattaaatatccatgttggttttagtttaatggagaataaaatatttatttgtagaaaaaatatctaaaacttttaaacttaaacttaaagctagaaaaatactaaattaatttttcatgctcaagattaatattcagatatttgtacaattaatgctcgtaagaaattgcaataaataaaataaaaaagagaaatttactatgtttcattgttcttgtaccga

SEQ ID NO: 3887 - DNA, 1459 bp, Zea mays
  misc_feature (1)..(100): optimal_loci_196360_G1, chr5:152839921..152841379, Cluster 24
tatctagctgttctcttgtgctttgcctgccttgaagggaagaggaatgttctcttgtgagctcgacttgtcaactcctatatactaatccattgattttccgtaaaagaatggtgtcaaggttagatatggcccgcaaagaagcatatatatatatatatatatatatcttaagataatggggttgcaattctgtcttgttgatgtctccttcccgtaactgtaagcatatatatgcagctggtacaaggtttggatgatgagtggcagcaacatattctctcaacgtggtgtatctgggagtccagatggcactacactacattgttctggctgcccatgttctggaccagagccagcccatcacaaattcacaagttcaaaagataaggtgatggctgacgcgatgtatcttctataactacaggcttattttgaattattagatgttttgacttttctagatatattatctttgttttatatatctagatatagtgtatatctaaatgtgcagtaaaaactgtgccaaaactttttatagttttagaacagactgaaggcgcaagtgctgttgtaaccataaccacgggaaggatgacgaatcgtttctgttgccggctcctgtcgcgtatcagcttcagctctgctcaatctctttctgtgaagcccaccatcccgtcccccacccaacccaaccctaggtgcaggcgcggcctcgtgcgttttggttgtttcttcacaaccagaaaggtggtttggtttgttagcctgttgctcgtgcaccgtgctgccaagtctagtagttgtatggcaatgaatggcaacacagttagatgccatagtgcattgcagaagctaaatgagtcattgttcacttgcactacactgaatagacaaaacagcagcatcgcactgcactgaagactcattgggtttttttaacctcctctttcttgtaaaaaaaaagaactcttgattattttggtactactgtggtaattctaagattgaaacttactctcttttaatgcaaaaaaacgtaccccaaaatacagtcgcgaaaaagagttatctgacaaatatctatgtaggtttcacgtcgtaaaccttcgcgcgagctgtacttctcagggcagcagaagatgcaactggtttcaggctttcagcccatatgctgacgaaaggcccatcaatggttctaagatgggctactcgttcagtcttcagtggctttgctggatgccacacgttttcgctactgtgtatgaattgtgaatttttcatatgttaattcctttggaccggaattcgtataaaaagagcgaatgattatctcgtatacaccggtttctctgatggtctgatcgttgtcccttttgccaaaaaaaatattcttatacttattctctatttttataaagcacccgtttccgctgtcgtacattgtcaagtgata

SEQ ID NO: 3888 - DNA, 2061 bp, Zea mays
  misc_feature (1)..(100): optimal_loci_198727_G1, chr5:166496397..166498457, Cluster 24
agctgtcacaacttttataccatcaccgaataagtgtactaatttttaacttacgtagcgaagcacgggcacatacctagtatatatataatcgtgtttcaataaatgtcttatttaaacaaggtctacatatatgatatacagaaaccttagcaatgtacgtgaaactaactatccattgttaatatagaaaaactaattatgaataatacgcgtcactattcacacaatgtattcataagtatattgattagaaatgatcatgtcttatttccgcgtcaaacatagttctaactatgtttcactaaacgcaagctaagcatgctttatgcttagaggtgcaatgtgaaaggaataactgtgaatatgaacgaaaaagtatatatagtaattagtaactagtctattacaaccaaaaggaaaatattatccatacgagtaggatgttaaaatatgaactaactagatagaccaaacatattgttcatatatttgcaatgatccctaacccatgaatacttaataactatcactttttaaatcaacacatctcaactgtactcgtcgacaatgatacaaatttggtgattccgctgatctcaatatatgttggttcaattttttgaaggtgttcacagttgctaacaatgaaatgaatgtgatgaatcttctatgtaagaaaatgtcaaatagctatggccattaggtgattttggtgattaagtgttattatggattggactaatgatatgtgctaacatataaggttttagtcatatagatgcaaggaccgacttaggtgagacgatgttggcgatcatgtgctcaagacctcaagcaaatgatcgaggaactaatttgaagatcctagaggacaaacaaaaagttaaatcatcaagtaaaagaatttgggatgcaaagacaaaaataaacactcacgcaacaccaaagttgtaaggatctagatggccagaggagggtaaatagcctataaaaaatttcttctataaggcataaattgtcggcgcaaagtgtttagtataaaaagtgtcccaaatagcaactacaaacactagctctagttcacttcaagcaaaccccttacactagtctagtagtagttgatttctattctaatcagtttaccacaagcaactagctacacaactaagcaaaagagatgaagtagagagtgactacaatctagttactactaaacaagaacaactagctaatcttggctactactaaatacgagagctatcactacacaactatacaagcaataagcattacacaagcaattgaacgaataagatacaagcaataagcaataatgtcgaaaacaacctatcaagattgtcactctaatgtgcactttgatgtggcactagaggtatccactgagcgttagctcctaaggtcataaaaccatgctctctagaattaacatatggtggccactataatgaccacaatggaactatctggtggcttctttgagtttttttaccgttgttgaatgcgctaaacacaagatctagtgctccttttgatcgaaacagggatttattgcatatgcattatttttcaacaagaaaatgatcacaattgtaagcttcgaggtctctagtgaggcagtgaccccatcagacatctccagtgagtatagagaaacattgaatgaacaacacttctcaccccctacataggcatgttaacatcaagtgggtttgtcctttgaatacacaaagttgagcatgtttagtcataattgttgcctttttcttgaagggatccttgaacaacctctagaaaacattttttgggtgatctaaaaggaaaattatttggaaaccacatttttagggataattatgccaaccatctttagactttagaaatacaacatttgagggggtgattcacaaacatgggcccatcacaactttttttacgagacttgcaacaattcaacttgccataaaaaacaagacacttctattaatcattttgtactagtgatgcaacaacatgatctaaagtatatataatctagct

SEQ ID NO: 3889 - DNA, 2332 bp, Zea mays
  misc_feature (1)..(100): optimal_loci_204028_G1, chr5:196673919..196676250, Cluster 24
ctctataccacttcagatagtgaagcttgttgacaaattacttttactgataaaattaatagaagagcacatgttacgttatacacatatacaagataactaatatgaaatatatatcgaattgcctatatatattaataaataagtattggtgtttgttgcattaagaatttgcaccaaagaaaagtctaatatttcataccatgtgtgtaataaaataaaaactccctcttatttcaaatatttcaaatgtgtcaagatgttggcgaatatgaagctcctacctgcattatttttgtaaacaatctttaattaagaatgtagtatatcatatgaaaatattttccatgatgaatccaacataacattgaacacatgttgtcgatacatgtagcttttcataaattgatggtccaaataattggaaaggtttacctaactagaatcctaaaactgatctatttagaaaccgagggattaataccttatacatatatttgagctataaatatataccttactagtaacatatattctggttaccgtcattacccaaagaaaaagtaaagagtactctccacagcgttgaaggttgtgccactctacaggattcctactgtgtaaactcggcaaaagggatcggagcaagtaggtgggaaaaaaaagagcacacgcattgtcctttttcacttttaccaataaagatgtttaatctgaagatttagctaaataccatgcatgtcactagctccatacattattatatgataaactagaacccagtacagtttagcagattgatgcaccagaagtgaatttaaaaactttcaaaaatattgttcagaattttagtatccagagtcatattcaagtccatctttcagctattactttgacacatgaaaaattatcaccaccagtgtaggtagattgagcatataacatggttcgtttgttatttcaatgagatcgaggacagtgatatattggaacaatgtcacattttgatctgataatattaactcataattacaagcccaaaattaaagagttgatagtgctttattagatattaggcaggcaaatacttgtcacttgcagtaataagaaacacacatctgaagcagtaaattttctgatggatggagtaaaatctattacacacaaggctatatatgagcagcaatacacgcatcagatattaaaaggcgaggtacgtataaacgtacatattgacgaggttactaacaaagccattaactacacttgatcaatgcaataagcaaattcgtatgtaaaaaacaaataacaaccccttttaccctttaaagtgaaggaaacaatgtgatgaggtacatcagtataaaaacgaccaataaggaacagtatgccgtagactgtggagtataagtgtaatataatgtactgacaaagaaattaatctgtctaacgtatacatgcacggagttacagatcgatatttttattaataagctagcttggttccaaaaacaggacctataagcatgtctacgtttcaagggcctagtcaaaaaatcatgacctggagttttcagcttcctgttttgatgtaggatccagttttcggtcatggtctaagcctatacatagggattctaaatttctactaagctatactagtacccgatatagagaagaacgtaaaagaggacaggttctctagaaggaaggcatttatctatctatctctaaatcaagctctagccctactagagaacagtggatcataaggttgcagttgcagacatctatatgcatgcatgcatagcatggagccatggactgagtttggactatggaaagacatttcatacatgctgaacacaacaaagagggatggtgtgagcaggacctcagtaagttcacatatatatgagaggcttccaatccatcctttgtgaagcaggttacatcaacatgaccttccccttttcaccttaccaaacccatacatatccctcaatcatcccctcttgcccccctttcccatcattcagtaagaacaaaggcacttttcttgcaaggttcagtgcccatcccttcgtctaagtttccgacccattccattgcaaaaagaattgcacccatgccctacagtttgctaggtagttaggaaaatccagccaaagccggccggctgagcagatgacgatgagaggccgccggccggtacgtacgtggcttctttcctcccacaccacgccccagcgcagtactcgcatcgcaggccggtgcagtaaaaagggagaaggccggacgagcaggcgagctcagctagcagtagcatcga

SEQ ID NO: 3890 - DNA, 1575 bp, Zea mays
  misc_feature (1)..(100): optimal_loci_204029_G1, chr5:196681275..196682849, Cluster 24
acccgttttactagtttttttagttcgatgatccaattgacacaatatatcaagtttgaggaccgctactgcattttattcttttagaatggaacactgaggagagcgcagttagttgccaaaacttccgagggatgtatataacgatgatgggcggccatcaattttactgacttatttgtactccgtactcgttgataaacatacggctggccagttgtttgttcctcgtattagactagtataattaagttcgttcactttcaggtagatatatataattccagtttgtgaattggagttagatactgctaaactgggctactttgtgccacgttgcaaataaattgctgatgtatagcacgtactgggacatcattattgcccacattctcatatcctgtttaagctgactgaaggccagcaaattggagctagctagctagcatcaaggcccgtcttgcattggtccctgcaggtgactattgaagggagatcatgtggtttgcttctgcatatatcatgcatatataagggccggggcatgctttacatctctccagaaatagtgtgatgggccggtggattttgcttctgtacgaaaagatagcaaaatcttttgctttactgtaataataacaacattattattagaagctagaggctcagacgctcagattcaaggagagatcggtgtattttgtcttttgcgctgtccttagatgcatcgttcgatagttggcctctagtagttacctgttgctacaattaatatatcttcagagaaacagttggtacgtacgtgtaggaataggatgtgtgcgccttatggcctgtagaataatacaggaagccaaaatgtatatctttattgtgtccgtactactgggtccgcactagtagcgagctagctatatatacaacagggttcgaatcccatgaagataagtggggcaaattcatcaagcgtagtttagttctgcataactttcctactacgtacatatatatacagagaaactacaagtgggtagcaacttcatagttattgctgatgatagaccctaattgtctaggaaacagtaaacatcggctactatagctacttggtcattgtatactgtgaaagacacatagataatgataattaattacgtcagtacgtactagtacaataaattaccattatctatatatattttagtttgaatatagtatttttacaatgttattagacaagtatttgcaaaagctagcacgctggtcaagtattagcaaaagtcactctgttttacccaaagtagctaagctgcagggacattctccctcccctcgctcgtacttagctttttagctgtcttcttttttgagatgggtctttgtttcctagcattttaattaaacatgcaaattaaaggttttatagtaagttgaacgcggttgatactagatctatggtggtggtgggtctcttttgaagctctaccggagacattcgtctccaattcctggggatacatattgtattgatctcatgtgaaaatcaagtagtaagcctcatgcttactaagcact

SEQ ID NO: 3891 - DNA, 2057 bp, Zea mays
  misc_feature (1)..(100): optimal_loci_204304_G1, chr5:198301540..198303596, Cluster 24
tagtctagtataaaggttaccaataactcgatggagcaggtccaaatcgcggaccaaacgggcgagctgctgggcaaggcgcgcgtctctactctccaggcagttttggcccctagttttctgctgaacgcgaaccatgtccatgccgaacccccgcgcacaccacgccagcgggggtggagacgaaggcggcgctggccgcggcaagtgactcggcataagcagcgcaggatcgccgtcgtccatccccaccgcagaatcggtaacgtctctctcacacactcctcgctatttgcgcattctagctcggctcgatctgacgggccttaggactcgagtcatctactgtaggtgctaattacttgcgttgcgtttgagaggatcgcaccgaagggcccgaaattagggcgaagtgttattgctatgttgcagcgtactacgtaggggtgtttggtttgaataatcaaaccaagatgagtacatcataagctcattactaaaatttggtggaatgatcttattcttcgtgttagtactaattatgggaatgagatggtgatgcattaactcatttcattatacaaaccgaacaaaaaaaagtaaagagtgagaagataatgaactagctcgttcctaaaaccaaactacctatttttggattgatcaactgaaagataggtttaactttagataccatttgactttttggaagaagtcggcttacttacatgatgaaacagaatttgtaagtgggattccaagggctttctctagtacgatgaacgcacatgtgatattcggcaatgttctgtttctgatggctatctatgcagatacattgattcagtgcgcgcttgcaaatgcatattgacgttcatacgactcgtgaattttgtctgcttggatcttgaatccagagatagtggaaatgtggaattatccacaatgtagcacttcccttccatgcatgggaacaactaagtctctttttgtgtgattcaagcacataggggtttgcatacataatttttgcagcgagacagggattcaataagaatgtacagtcgaatcatgttgtgagatctatggatcctctaacttgtaaaatacgctccttttttatttgaattgcagactggcgattacaaaatagtggacaagagttatatggtttgagtgcattaatttagaagattcgtcatgttcaagcactaggagtattttcaggatgtccggtgcgattgaaatgatgacttcttgcaggtagtgcagagagactgatagttgatgtggcatgacagctcagtagttcactgcccatagacataatgtgataatgctcatgttttcacacctcactatgacagaacttggtgcattaagactctgtctggtaagattctaaatggtagcaactgcttttattcaaattactcacattacattatcctgcattccaatgtactacagaattacaactacctttcaaataggttcgcaagtgctcagcaatcttgactgttaaatagattttagtgtcttagaatgctctcaaaactctaaatgccaataactgtatggagatctctgaatcatttcacacatacacttctgtccttccaacttctcttgacaacggtcaagtatccttgattgtacatggttgagcttgatgttgtattttcctccttggtggttcttaccagatgtgttgcacaaggttgaatccccaacacaaatgataaactgacacttcccctctttatctagaatcaaatttcgactgtgcatacagttgagccaattcatatgcgtgcttggtgcattgcatgttctgcgcatgcctggttgataagagctcggcaagtgttggaaactatgttgccatacaccatatctttgagtaaaggataccttgtactgtggtattaagaaactctggcaattaatttactttgtcatgtcaaatttacttttgcaaatggctaatctatcacgcagctattgatccatcatccatccacagcacttcttatctgttctgaataaccttgtgt

SEQ ID NO: 3892 - DNA, 2974 bp, Zea mays
  misc_feature (1)..(100): optimal_loci_20568_G1, chr1:117708829..117711802, Cluster 24
gctttgttgatgaaattgcttcctcggtcgaagggcagtagcttatattgagaagtgaacactaaaaattcagtcaacaagacagacagtttgcttaggttagtctcttgaaggataacacatgagaaacttagaaaatttatacggagttaatatagcacagaacagtaggtgttaatattgcacaaaacgaaaatagtaggtgttatatgacaaaaaaatcaacataaaaatcaatcattaagagagacagtttttgtcattttgacaagaaaatataatgtccatagggaaaaatatggaagacgcatgatatctgaaagaacacaccagaaataaagaggacacattttctaacctgactaaattttacaacagaggatccacatgtcccgttggagctggtcagacaagccagagcggtgtttacacctttttcaacctgaacgaacgacaacacttcttcagcaaacacaggggcattgtaactgaaaaaaccttttgagcaagggaagaaattgcggaacctttgctgctcccagcgcaagccgtttcgcgtagtcatcagtcgtgtgctgtttcgcagtacctgagactgcatcgtgatgctgggcaatccccatcgcatcttccaagctggaagtgaacaatcccaaggagctcctaccgcccaccaaaaactctatctgacgtgcagcctgtcaggagacacaactttctccaaggttattagagaactcaatacatggtttagaatttagatggaagcatgattcatgcagtgcagcatgtgaatgttttaccaagtagtatccgctgtgtactcgaacatatcgcttgaaagttggacggctcgtaaagtacccagtccagtatgcattcgttgaatcagcgtagctgcgattaattcattcgatgcatcatggatattttctttagcatgaacattccatgttgtacctgtagttcgagaactcacgggaaatagtcgtcatattttactggccaagattcattcgatgcatgcttagcatctgtgtagatagacggagtagaatacaacgcatgcactctgccgtcctgcagggttcaggaagttattattatcttgcttttcaaacataatttagtagagattccaaaaaaaaactagtgctaaacatgaaaactctgtcgaaacttgacacggaaggataaaatttgcaataccttgttcacatgttggataagtttgtccatattccggaaccaggattcagcgtactggtagttaaaatcatcccccatggtccacattatgtggtctgtacgtgtaacatttgcctgatccccaaaacatttcagaagtgggttacgtgtttcagttagaaacacaactacttggaaccgctggtatcgtaaacagctggagatttacctgtgctaaggctgcagcaacaaaatcatctacacgttcttggacattgtagtcaaaaagtgacaggtcatcctagaaatagttgtgcatgatttaaatgaatgtaaggttgggtgaaaaaaaaatcactgtggttcggtaggatgaaattggttatgtatggatttaattacctgaacaggtatgatattttcatccaaaacttcgaagccaaagccatctggtgggctataatggacaggaaaggcattcgtgaagatctgcagtttaattatacaattaattacatgagtcgaaaaaaatgtgagagttaataatgaatagtatatgatggtatacaaaaatatttgtaaggaaaggacaaaagaaacctgtgaagatgagccgaaagttcttgagccacgccatataacctctaggcctttgtctgctttccgtgttgccctatcttggtaatcaattcttgcgaaatgtacagaatcaaaaccaagctacaagtgcagtaaacaaacgttacatgcagtgttttcagagatttatgtctctattcagtgagcctaggaaacaggaatttatactactatagtagtttcttgaggaactttaacatcattgcaaatgtgatgaccacagtacctctgctccaagcaaataagcttgcactgcagagtgaccaaaaggatcaatttgccagccagctcttggagtcttattgaactgtttcttgatcatccggtgaccaagcgtggtctgatcaatcatgtcaatgtaatgcacggcagcttcatcgtgcatacaccacccaccatttctgggaaaaagatcatcaacaagattttttttaaaaaaagtatgatgccaagatcaaagcggatagggacaatcacgttccatacatgaactctagctgtccggaatcaaccagtttgtggactatgtcctggattgtggggcttttctcggcccaccacctttggaagaaagcctgaaagcaaaaaaaggactaggtaattacctgggaaacaacacatacagaaaaaggttatttttctgattttgaaaagaaccatctggttcgctccccatttttgcagaaactttggttcggtaaaaaaaaaactgctgcttttacgcggaatttgacacaaggagaacatgaaacaggtatgggcatccatatataggagcagagtccacatgcaacatgttgtatcgcttgtacatgatagcaacccatgacttaggtagatatgggcgtgggccctctatttcaacttgtcagtttgaacatcatccgatcggtacgcaataatccacacaccttgcattgaaagttatattttgttcagtactagcttcaatggtaaaatggcgtaggaatactttgtgcataaaatccatttattttttatgtgacccgatgtttatattactaaaaaatttgacgaaaatatttgtagtattcaaatatttgtagcattcactaagaggaacagaggaaagccgccctaacaagttcagtgctccgcgttattctagacatgataggcttaacaa

SEQ ID NO: 3893 - DNA, 1515 bp, Zea mays
  misc_feature (1)..(100): optimal_loci_205684_G1, chr5:206048132..206049646, Cluster 24
aaccaccgaatcggaacaagtatatggcacaaagatttggcaccaccagccatgcatgtcaacatgccgtttatgtacaggataggataccagcaccgaggacaacgcaacagacgaagccatcggatcatgtgagtgagaggatacgtataattaagaaaacagcctgccatgatccagaggatcacagatgctagctctctctctctctacctgcaacaacagttcgcttcttggcagcgtctggcccaaggcaaggggaatgaatatattatttgttccgacaaccggccaagatctcaagctagcgccgggcttcaacggccggaagatcgctgagaatcgcaaacggtagggtttatgcgaggtctccgaggctaggtaatgttcgcagcgtgccgaaactaaacatgtgtgcctgaatgtgaaacacaagaacaaaaccatcatagcctcgacgcgttttgttttcctcttgttaaaattaatacgtttatgtctgttctgctgctgtacatctgacatctcatcttggatcgacaagggaagcaagtaaaatctgccggatagagccgctcaatccccggaaccaaacacggcgtttgtgggattactgcaatatattagcatagtgtactacaatggcaatggcattccgttaaccctgtttgaactaacatgctattcccataggagtataggacaaacgggtaactaaaattccctacttggcaccaaactagagtataaaatatacaacagcatcttaacacatagaagacaattgcagcgcgccactgattttttttattgtttgtgccgtaggatcttccatccttttgaagcataactaaaacatggggcgccctatcatccacacaaaatttcctaagttacatccatagtttctgcagagcgtttgaactgagctctgcacacacgcacaattacttgtaacaataagcacattactaacacaaaacacaaggaaaatgggaatgcaatactgacacaacaattagatataaatcaaaatgcagtaacattagagtcgcttcatattccatcaaggcctggaaaataattacatagtttgtttcacgcataattaattcttgaggggcataccagatcctggtgcaaccttttcccttcttgtgacttgttcatagtatctttttgccaagcagacatatcacactcagaaaatttgcctttgttttatgtgtctcaacttatttaattttggtccaatgcaaacattattccggccagtagtaagaaaattgacgcgacatgaccataaaatattgtaaaattgcagtcagaaaacagaaatttgaaaacaaaatagtttgacatactcagtgggcggcgaggaagcaataacaacttagtgataaaaataaaattgtcattgcagaataaaatctgcctgctaattcacgtgttaatggattattgctttcagatgagtaagatggcttacttttactagttaatctacctctgaag

SEQ ID NO: 3894 - DNA, 1881 bp, Zea mays
  misc_feature (1)..(100): optimal_loci_2059_G1, chr1:10822555..10824435, Cluster 24
ttattcacatgtaaaaccatggatccaaactagttataaggggttgtttgtttgaagaatcaatctatttttagatagtctatcaaatttagtcgaatgaactcattcatcatattattactaattattagttcatgtagaatgatatgatgatagatcaattcaatctatttcacaaaccaaacaagaaagtgggaggactactccattccacatactaaacatttgtgtgacgagcggaacatttgtgtgtgtccatttgcaaaaatcacaaggccatatatatttgcgacagagacgaaggtgaataatatccaggacgttttcacttcatttcagtttgcatcggccccgggcgcgtttccaaaacatgctcacaaaatatttatcaaggagacattcagatccgattggaacgatatatcatccgtatacatttttacgttagaccattttcaagattcgaattcagcactaccgcatgtggttctctttatatgcccaactttattttgaagatatggtgatactcatccgatcgatcccaatcgatcactccaacagccaaatcgcttcaagacatatatgcagtgctcatctttatatatatgtatgtcaagttaatttgcattcggtagggtctggaatctagataagtccgtcatctggtatttgtagatagttttcctgagaatcaacaattatttagaatgggagaaaatttattttttggcattcatttttctgacatgacagatatatgtatgtagtgctgttcattgtatcatatatctatatagatatatttcattaacctgtatataaaatatatatattgagcagagggaagcatatatgaaaaagagcttgtgtccttcttcactttaaacacgacaatgattgatgccttcatctcctgtatggtatgatatcgtattaagtctcctttgatgcatgtgctattgattaggatgcaaagtgatatcgtccttagctttttcttgtattttttgctttccatgctgtatacacggtgttaattccacacccccgcaaaaaaaaaatcaacaacctgtgaatcatgtaccgatttacaaaaatacactttgtgcaacatgtataaacctatttaattattagcatttctggaaacaagtttctgccaccactttagttgaactgtttctgattttattttaatccactaaggaaaacacaattggagacttcatccctccacctaataagacagtatgtaaatctaccagtggtcttgagtcatatacaatacagtcattcatcaagaagtcaaatgaattatgtctgcgtttaagtgagtaatgactataaggtccattttacgctagctttttgggattatattaaaaaaattcaaagaattagttttggatctgttccacaaaacatggattttttttacaaataatgcacttcaaattatcaaccattacagggggtcaggcttttgtctgccaagcggtaaccgtaccaaacagcccctcttcataatcaatatatcctagctaatgcaagcatgcaactagtacattttatggatggcgattcacccttattacttatgctcaatacgttcaagtgtatttgtatataatccttaccctaggcaactatatgtttctatacatgcaacattatcatttgacctgctccatatatatttacacacgcaagttgaggttgagacccatggttctatctatctcccatataactatgagctgcttgttccatcctgctgtccatgtaacacgttcaggactgacctgtttttaaaagatttttttggccttaagattatatatgttcatagttacacttacactagccacaacttttgtt

SEQ ID NO: 3895 - DNA, 1444 bp, Zea mays
  misc_feature (1)..(100): optimal_loci_206383_G1, chr5:209756937..209758380, Cluster 24
agcccttttaaccattggcttatcatcaaagccttgacaaaagaagggtatatagtaatgttatcgactgtaaagtcttccccaatctgggcatgtacaacaaaggtttacaagttagaagtagctttataatacagtggtcagtaatcaaatgaaggtcaaagaaaacatgtagtattatgcattacatgaaagtataataatggaaaacagagggagggatttggtcagcttattaccccatatcatcagctaaaatgcaaccagaaataccatcagcactcagtgacccagagacacaatcaaacataaactgaactccttccctgcattatagaacataaaaatgtaaaaagatgcatgctaaactaaattataattattacacaaaggataagctaattagtagttcaaaaacaaactaattaacttttcctaagtgacatgctttcaaaaaggagggtgtaatgtatagcataactacttttacaacagagaacaaatcaagtgtgtaagaatactcaaagtgaaaacaacaacataagagcataatacctttgatggggtcggaggtaacgcacgagcaagtggtcaacttcgatagaagcagaattgcaattttccttctcacactcatcgcgttgccacaaaatcaatggctcaataccaggtggaagaggttcctccttttctgatgaactatcagaagcaacaactggtgactgtggaagatggtgtataatattaattgcaaatgtctgtgttgaaccccacgggacaaatctcttacgagctgaaaggcgtcgagcaagctgctcattactgtcactatatccattttggcatggaggtttgaatggcttacgaactattgctgctgcatcagaaactgaaagaatacgtggaatgagtggttgcctccttacaaccaggttgcccctgacagaaaccaaaaatatatataagtgaagtcaaagacaatgatgttaatgtgaagtcagattagttgccaattgtctgtttcctgagcaaattgtgctactgacttaaaccacaaacttctcagccagaaatgcagcattgtcagtaacttaagttaacatttgatctcatttttatttcatatgtacgttgtctcataaaattgcagaaactcttaggattacatgctatctggtagttaaggtttcataggttcataaaaaattgagaccttattcataatatttctgaaaaggttagataactataactcgtcacacgtgtttggcattcttattatcatagcacgcatcatgtatagtggacagggctcaaaccaattaattgacattcaaggcttcatacactggatattgtagaacagattccttcaggaattgaacttatcaaatacttgacgaaatgatcaatcctcaacaggatcaagccatgtaacattatt

SEQ ID NO: 3896 - DNA, 2091 bp, Zea mays
  misc_feature (1)..(100): optimal_loci_206673_G1, chr5:211295759..211297849, Cluster 24
tttctataaagccatagaatgaaacaatccatatgaaatgggtgtttcattcatgtttcattttattctatataatatggaaatcatgaaaacaatgccataaactcctcattgagattgacctaactaactatgagtaaacctaccttcctacactttagaaggttttcttcaaatctcttatagttttgctttatcgacttttgtggaaataagagtcattttgtgttggtgatgctaaataaatggtagatatcttgtaactaaattttaagggaagcatggtgaatttttttgtaattcttgtgtcatatatggagcattcaacatgcataacatgtctttgaccaatacatgtgaagcagatttcacggtaaagttaagttctcctaaactccaaaagattagaatttatgaggcttggccaatcattgaagtcacacttagttccaccatttatgcgttcatcagtgcaatgaaatctcttttaaagcactacaacataatttggaagtacttgcaaagactcataaataataatgtaatatggtctattacgctctcaaattattgggagtattgcgacataagatggaagtactcacaacatattatattggactactgaaatatatgatggcaacaattgaaacaatatatttgtttggattctaagcaattcaacatacgatgtaagtacttgcaacatgaaactaatactagttcaacatggccgaatacataaaagaaatgtcatagttctcttggttcccagacagcatgtctccttatcacaattatgtgaccatagtgagaaccccatttataataactagagtatgactagattaatatactataattgatgagatgatctggaaaaatcaacaatgcttcttgatgaagtcaaatgtgaagaactttttccttggtggtagaagaaagacccatctgataaggttcttgggttcctggcatcgtatcatgcaatatcaaaattaaaatagtatgaaatagaaatggaacatagcatctagaaaggggaaaggaaaaaaatgttagcacaaacacaagtgggctcaaatgtagggtccatcttcatctcaatcaagactttagagaaagcaatacatgcacaacattggtggctcctcaatatatattctgagtgatagtgcatttagacgatagatcaccaacgtaaccactccaacatggcatatacaacccttccctgcatcacaaagcaaaacactacatcaatggtcgatggagcaccattgcacccgcatggtgccactaacatgtgaccgagaaatagggagactgggagataaactaaaacatcaaaagtaattactcttgatcataaaactaaactactcatatttttccattacaacatgaaagatgatataatctccacaatacaatctaatgtatggaacataaacaaaaaaattgtaacattcaattgttgaaccatctaagtttaagctcatctttgcaacattatattcaaatttgttgtattgtatcatgtcaaattctctattttaaacacccaaattcaccaaatgaaacattgtatttttgtagatacatgaataatttaaaaaatggaactacacttactgtatcatatgatgatagttaccaaataaataaaaaatagttaattcaaaagcacaaacattgacatgttgtatcattgtacctttcatcaaaagataaggtaaacagctcctacaacatataaaaatgttatcaaaacatttttcaaaaatatttataacttgcgtggtgataatttcctcacttttgttggcatttgtcatctctatgctgcccttaccacatgtgtgggctagaggatcatacacttagtaacctgattctcaaatcgacggggtcaacgaactgaaacttagtacgtggtatgttactaaaacaagatttgaacattatgggaacaagattgtttccatgttcccagaatgaaacgaatgttcccgaaacaagtaatgtggccaagttcaatgttcctggattataagatcaaacaccctttgctatttgcttcacgtgtga

SEQ ID NO: 3897 - DNA, 1421 bp, Zea mays
  misc_feature (1)..(100): optimal_loci_207280_G1, chr5:214064517..214065937, Cluster 24
gctcgcatccccgctgagatgaatgaaacgttagctaagtacaggaacatacgcatataaacgacgacatcagtttttctcttcttaggttatctcccgcagatttcatattttaagcttctgtctacaaacagtgttatctacaatttcattacatacactttattgggggacaatcttatattgtatgtagcattgcgtgtggaacaatcataaaagagtgttatttacgtttaaaaaacaaagtactagtacatgatataatggcagataggtacttcgatttatgtgtgttgttctgatttgatatagattttaatttaaattttatactaaatcacttcaacccacatgtattgcacacggacatgcatacgagtatttaaacaaggtctagatgttgtaccatttgctatgacaatatggcatctcgtaaaggactcagagatgtcatatttcatcgacaaataaactagctagaaaccacctttgcttgagcaaggataccatatgcaaatataataacgcagatcagcacaatttcatacaatcgatattgtcgtgcatgcatgcctatttgtgtagaccggggtacagacatacattatcatccatttttatttaatgagacagtgagagaaattatttatatttaggtcatgtttagataactttagctctaaaaatttagtagagttgacggaccagatctataggtgctccagaaaatcatgaatttagagttgtaagcctttagaagacatttagataagtcatttcgtttattatctagactgaacatatttttaaaactatttaaattgatgttataaactacagtttcatgttagagttcaaacctggagccatctcaaacaccccttattcgagtgaaagtggagtagtttgttgtttttagaaaaaaacatagtggggtagtgtggttagtgcaggctaggatagcggaagcgacgggctggaaatttgtgtgtgggaggtctgtttacataactttggtcattagcctagtgataactagtaacaatttagctccatatttttagaaaaaaaatcaatgactcctaaattgttctagcttcacgagctctagatccaccaaatttgtagaccaccctctcaaaattgtatgttcagagagtcagtaaaaaatatacatcactatcatctgttccgcgaacattttgggttcgttttttcttttgtgttgccccctatttagcatgtatattaattgagctaataccactaaaattagatttctggaatttgcctaaatgatcacaagtggttaaaatgtttagacagactactcgaatttaaatatagttagtaactcacacttgtttatagtaccatctttgaatttaaagtttaagtttctatctttgtatggttttcat

SEQ ID NO: 3898 - DNA, 1974 bp, Zea mays
  misc_feature (1)..(100): optimal_loci_224334_G1, chr6:105336397..105338370, Cluster 24
atcaattaggcagctatatacaacatgataattgataggtttgcttagttctaaaataatagagtagtgtagagagttcaacacttcatcaacaaggtagcaacacaatagcattattcagtatataacaaaaaaactcattattagtgcaagtgaacgactattagtgtaatctattcatcaaacatgaagttatctaaatcaaaagaatgagcagttatggactgctgatccatgtcagtatcatatgcatcatcttcttctctatcaaaggatgaagcaggctcaaattgatcttcattccattcattaatatcaatgagcttcatcatcctctttctacttcttggctaaacttctctcttccttttcccttgttctgttgctgacgtgtttgcaccttcaacagcttcagtgtcttttattgttcagttgatgcaactccagcgttccactcgttgccattgtcttctaggatattagcaacatacttctcaattgggtctctccatttgttcttttttggcccgccatgcaaactagaagtagcctacgctattcagcgctaaatctacgacatttcgcgtgcagcgctaaatcagactatagcacttgtagctgacgtaacgtctgaaagtgaaatatcatagctttagatcctccaaaacgttgtagttggactgtagcgcgccactatagccgctattttaaaccttggctctatcatcccacctttgctcgactgtggtgatgcattcgtgctataggcggcctctagtggtggtgctcgacatcttgttgaaatgcatcgttggagttttagttgttgacctagttgagatcccagttaggtctttttaggcaagttgaggtgctagcttgttgacttggtttgactaggttgtgttgatgtagtttatttgagcttgcagtggtatgacatccttgggtattaatgtgcattagcttgtacggaatgagtgaagcacttttttattacgtggtttttggatccggtttttatattaaaaaaagtggatgaacaattttatatttttcatcatcatataaatattgcggcagagattttccatctcctccgcaaaaaaaaaaaaaaagaaatagatagacctgatcctgaattaaagtgagcagaatgtgattattgccatgccatgcatgatcactacggcctcagagtatctcctgattgcgaggtactcagctggcctttccaaactgtttgctctataccaatgcttggaagctcacatggctcttgtcccacgcaaaatcatgggtgtgggcaagtacgagctaaccggcacatcgacgatcctattccacccagcttcttcagtctgtccgatagtggcagtactcttctcttctgcatacattcatctcacatggcatccccagttccccactgcaatttaccctcgcaaaagttcgatacaatttctttcccttttatatcatcgttagtgacatagaagcgattaggccatgtcatctttttacccttctatatcgctagtgatggcatgagggttaagaaattgtatccgagtgacatagtggggattaggacatttgcgatgagaaaaaaaaagggtagaattttctcttgttttaatacgtacgtcgccattccatgaccactgtggtgtacggtgaaatctcgatcgggtgtttcgttactgcatggagactcaatatccatggatatggattataagacactcattttgacctagctaggtagagtgcaagtcagcgtagatcgatgggccagacagacagacacggcgtttgctttgcaatgtactccaaactaaaggaccggtgagacgatcagaaagaaggatcagacagaaggatcagacagaaggtaaatgggaaccaataaaattttgctgtacaacactaaaaatatgcacttcacttcaattgaaataaaacaatatagct

SEQ ID NO: 3899 - DNA, 2238 bp, Zea mays
  misc_feature (1)..(100): optimal_loci_226563_G1, chr6:117374479..117376716, Cluster 24
tgctagctaagtgaattgtaatgtttggttggacagttaggaggtattttttgcctatgtttcagagcttatgtcatctggtcgtctttttacacatgaagaatattcttgttgttttacttttggtttgccaaacacatattgtacctccaaagaacatatgtgcaagtcatacatgtgaatcatagtattgattggatttaatttgggtatattgggacttcattttttaggacatgaaaggaaatataaatttcaaattggaaatttttggtgactcagatggaaccctagccccacccgagcgcccctcctgtctctacctcgagtctgttctctgttgccacccaagcacaccaccgaaagttcaagcaattgggggtctcttcctttggtctttacataccatgcgaacttagtccaacatcaattaatcacataaatgttatgcatgcaacttcctaagggcatgagtgattatttccactaaaacgttcattttttggatctagagctaaactccagccaaattggtgtattagctcggtgattagagactatctccaaagtggagctacttcttgttggtagagttggtgctttggagctattttttaagagttgtagctctcgtaaatagacttttacttgaggactatataacaatgtgctgcagccaagaactattgacattacctcacaacttagtggttggaatctatttcaaatgtactattatagctctctaggaatttggatgttatagatgagttctttgtctctactacatgccattcaagcatatttatgtccacctctagatccatgttgttccttgttgcatgtcatgtttcttagaattaacaaaacataaaataagcttaagggcacgattggttggttggatttggcccaataaggctaacaatatttaagaacatgttgtttgattgcctgaccgatgagttgggtctggctatgctgatgcaaaagaggtgtgcgagccttgctccgtatatttctcacgagcatggcttaggcatggccacgagtgtgtaagtagccatgcatgagaaaagatagggttactggttgtttgaccctcccatgactgatgtctagtgttgttgtctctccctctcctttgttcactgccctctggcactagtgagttcatccttttgctcctctctcgcttagtcccatcacctccctacaatcagtcccctttcttagcttcaaataatataatctctcctttgttcttgcaatcaatgtttgatttgtgcatagcatagaaaataggcaacaaatttccctaatcgtcttcaacctctcatagttttgtatagtattggatgtaaatgtcttgtgaatcagtggtgttttgtagtggtgtctagattacagtagttgtttgggggtcaaaaggcaattagtttttccaaagttgtcacattttctttgtaaaatatgcacaagattataggcttggttctggtttcttatagccattgatgggttttgcttaacaaatggaattctaccacatgggttgttggtgaataattgaaaagctgacatgcattaatcaatgtctactcctagctataatctctaaaggtatctggaaaacaagggaatgtgtttgtgctccaaagttgtacaagagttcttgatattgatgatctgttattcaaaagggtatgtagaggattttcatatgcctgaacaagttgatttcctctgtttcggttgacctgtgattctccttaagtgagctataaattatcttaacctcgcctcatgtagtgaaatgaacaacgacatgtgttcttgtttagtcgagagtgatttgttattgttgtgtactaaagtaatttagtttgttgagatttttacatgtgtctcaactctcaattcatagtttttctttatttagtcacttggaggtaacatcaccaaactaacaaacggtgaccaaacacaaatgagtgtagcattcaaagccagaaggctagcactagcccaaacaattcaagccacaatataggcaaccaatcacaagcacaatgcagactgatccaaacaatgttacctaacaaaacatgcttgcctacatacacataagctagccacgcttgatgtagtgtagtccaagtataagtgtgaactgcatagtcatcctcgcctaagtgagcaggcgatcatttgaatgacgaacattttggaggctct

SEQ ID NO: 3900 - DNA, 1948 bp, Zea mays
  misc_feature (1)..(100): optimal_loci_226613_G1, chr6:117602673..117604620, Cluster 24
attctaggttcagtcaaatggtatccagtaatatttatgtctttgtattagaaatgaaaaaagcgttccatgaataatgggaacaattaattcacatcattgaagatcatatggatatatagatacaggacaaacaaatttatatgcatgctagaatatctaattaatagtgtgcaagtaaacaaaaatatatcgtagaacatcctatacatagtccacgaacaatccaaaatatataatagaatatctcacgagcactgtaggaagattgaaatatagaacatgtatggaacacgaatgctttggaaagaagtctagaatatattaaggaacatctaaaaaatgctataaaaacaatcaatagaatatcacagaacatttgatgaatacgcatcagaaatagtaaaaaccaattatattatatgaggaataattcagaaaaacatcatgaatactggaaaagcatacagcaaagtaaaaacaacgtaaactaaactgaatagctaagtaaataaaaacaaattataaaggatagagaaaaactcaacagaaaaagggggaaaacatgtcatgaaggaaaaaagaaaataacataccaaggatattgtggacaagctaagatataagtactaagtaaaaaatcaaaagtacatcgtaagacatctcatggatactatacaaacagtctagagtacttacaccatccatcaaacatctcaaaaatgttatatgaaaattacaaagacaatttgatgtttccgttcttgctccatactttaatggtggtttcatttttattgtcttaacgtgaatttggaataaagttgtcgttaatctctactttttcatagtttagatagtctcatattcacgtcaattcatgtgtattgagattgattgggtataaattagtttaaattataccacaatccattttaatacatgtggactgagatggacacgagagtatcgaaaccgggtctttgtttggatggattaaattttaaaaataagaaaaagaaaagacatccacacaaaacgacaaccatctctcagtaacaagttttgatcgagcacgggcaccctctccctccttcgctcgaccgcacggctccacggcctgctccctcgctcaaccgcgagtgtgaggaggcgcctcgatccggccagcggccatgcgcatggccgcctcaccgtcttatgccttcggcgagactttccttcgcttatattgtctacgcatgccacctatattctggcttttgcactggattgcaaatatggaatggaatggaattgcgtccatagatctcgcctccttgtttccgttttgcttgcgtgcaaatccaatatgctgctcgttttctgtcagtgccatgtttatctgatttgggataattacagtacatgatcaagtccacacaaggaatccctctaacgcatcatctgtttgttcattagcatcgcctttgttctcttgaagatgaccattttctttgttggttgttaactttaagaactattcttgtgaggatatgttatcttgttggttgctctcccatgcagtggtgttgtacgaattttgttcttctgctatgatagaaacattggtgttttcatatttgtaaagtaccacatggtcataggcttcattatcgttttttgcttccactacaacgctctaatcctgctggttgctatctgatggattagtgttggtggaattttcttgttctgctgcaggcatggatcactggagttttcaaatttgagtaccaaggtttcagaagttgaatttttggcactacaatgctctcatcattggttttcaattctgccctctaaatacttaggacagatgttttggcttccagttcgtccactttcctcgtccctttattaatttatttttctttctgccaaaaaacaggcttgataggtaatccat

SEQ ID NO: 3901 - DNA, 1513 bp, Zea mays
  misc_feature (1)..(100): optimal_loci_228499_G1, chr6:127764041..127765553, Cluster 24
taattgtattcgaaccttaacttatgagttcaattgagttttaactgtattctatctaaatttggttagaactaaaatactttgttattgatattgtaagtttcttatatgacttaggacctatatgttttcccttgttaaagtttagcactacatttttttttgttaaaatttaactactaaagaaataaacaggatggctaaacgtgttgtgctaaagtttagtatccattagcactttagctccaccaaacatgctaaactgtgataaaagtggtccctcaatcttattgctctctccactagtatttaggtcgatacatatgaatttatgtgactcatgtatcaaggtaaatacagaattctgctttccctctactcccacagacggtagcttctgctgccatggggtaaagacgtcgtgtacttattgacgctagcttccacgttaattaggaataatatgctaaggtttagcagttacatccacacttccctcaagtgctaacccttagcaggtgctaaactttaacaagtatttagtattatgtaaacaaacaggcccttacgagatactcggagctcagttctctgagtctgtggtgctgcagacgctgataacatagaaaatcgttatgccgaacattaacaagaaacacagatgactgaagagtcagactatatatactcacatatccccatcgatgccacacatgacgtctcaagcatgcattttttcagttctgccgcaactaaccgacaaatacagatgatttcaccaaacattaacaagaaacacaggtcagagttagtggcaacgcaacgcaacaaaatttcgtgcccaacaaaatctgacgggtaccaaattggcatccagtatctgttgacaaactgtacatgagcaactccgtttaataaaaaaaggtaaaacagttccgtttatgaagaccagttcctcgggcgttgagtctgaatccacagtaaggctagctatgagcaacagggacacagggttgattttatattctttaatacccaaggtgaaggcgttcgaactgaaatttcggcacttgtgactttatttgtgaaggtacaaatgagagcttagttgttctaggagtccgatgggttcagactaatagcttaagaagagggtgacaacatttctcatgttgtctctaggcatggaaaggaaaaaaaaaggcaggcatacaatgactcacttacggagaaaaggaacttcagatatgagtacataaagtagctagttaaggcttgtgagatgaaggctcacacaagttagaagacaatgaacttgaccgaactggattatgtcgtccgtgatgagattgctaatcagctgcagatagctagtaatcgacaacaatgctaatgaagttaagacaacgacaaacgctactatgacacgcatctgcgtattcaaaaacagtattgcgatgtttttgtcgcactgaaaacctaaaactgggagctcagctggctacgctcacta

SEQ ID NO: 3902 - DNA, 3109 bp, Zea mays
  misc_feature (1)..(100): optimal_loci_230421_G1, chr6:135992102..135995210, Cluster 24
gatgtgaagagcaaaacgattagggcaagatctaattgcacatgttgatcaggatcccacggctgacacggtctccctctcctccctctcctcatgtttctccttccttgcgatgatccctaccattagacctcttgttgagttgatctactccatgtatgatatcaccgtaaaaaacaaagaagagaaaatacatagaacagatgagtcaattctagcacagataggcttatctaaaatagagttagatgagttgtgctaggagttaatatgtttgttacaatatgtggagttcggttgctatatttacacaaattattctcaaaagaacagaacaaccatacacacacatatatatatatatatataacatgcaaaatacatattccaaaactcaaaagacttgtgatgatatgagggaatcttcgggtattggaagacttgttgtttgtttcttcgttgatccggagggatcctttctaaaacctatagatgaaatataaaaatcattaatgagttgttctatgcaccttcatgcatggagtgagttgtgtttgtatccttttcttcacatattacaaaaaaaatagcgagttatttctatatatttttgcttattgagtgatttctactgagtgttatgtgtttgcatcctttttggttacagatgaagatatatgaagaattctagacagaatcataaattgaatttttcacccttcccagttgattctattcaacattacttaataattgtattcccttcatttcggagttgtttttttaataaaaaggccattaattgtaatggaaaatatattgtcctaggaatggctgaaaatatgggtaaagttctataatgatgatgtcatcggtgttgtcaacattgggcctttttaaaaaaataacgtacgaaagtcagtggataatatagttcagttatttgtgaggaaataataagtatgattagtgttgtcgtattttgttagttgacattacctctcctagcaagtctattttgtttaatcaacactctttaggttctctgtgcttctgcaacacttgttggaactggtgtatctaaagtcaaagagtttggaaagagaggtcatatgtcggtgttaatatctcaatattttgtgccttttctgttgtaaacgtctacaataagaacgtattgcgcttccttttccttacgggtgtgttgctactggttgatgcatttgttgatgagggattcattgttctaatgatgttctcataacctgtttttaaatgaccttcagttaattagttagtggataggccaagggaaacaaagagagggagaagtatacttcacttcatggttagttattcatcacgaaggagagagagaatagatggttttgttaggcacacacatcacacatgtgcatattatacatgcatatatgtgcataagatgtatttatgaatgtatgtgcccacaaaggaggttaatcatctatgcttgtatagttaatgtagaaatatacatgaatatgtgtgaatgttataagttttttttaaaaatagttgggtatcacatcacagtaaactatagcagggtattttttaaagaaagctaaacattcacatgtacaattgtttttttctatgtgcatatggtaagtcgtatatggcagcatgttatattatttagtctatgtatgtgtacatctattataaacatgtatgtgtacatgtgtgcaaatgtaaattaccactttgtgcatctcttatgtttgtgtgtgtggatatgtatgtatgcaaaactttatgtttgtgtaataaaacataagtgttgcattctagttttcaatctttaattgaatggcacatttgaaaagcataaagatgagtgtgttgtcataaactggaaagtcatacctgatctagtaggaactccatcacgttaaaaggaattttgtgatagttccaagcatgtgggcaacttgtaatatttaggaataaactggtcaaaatttgttgtagccatgttaaggaattttttgagaaaaaaggctaaaaaaagtaacactatgtatgtatcacacatatgtggtaaaacaaagtatattttttaatgcatcactgatgtttttgtgtgtagatatatatgtatgcaaaaaattatatttgtgtgaggacatgtatgtatgcaaacatgtacacaacagcatgcatggatacacactacgcaaaaaactatatttatgtgtgaggatatgtatgtatgcaaacatgtacacaacagcatgcatagatacacacctgtgtaaaaaaacatgtgttggatttctattttttaattaaacggtacatttgaaaaccataaagttgtgtgcattcccgcaaattggatagccatatctagggctagatatcgagctgacttgttaagctaacgaatttgtaatggttccaagcattgggggcaacttgtattatttaagagtaaccagattaatttttttgtatcacataaacgtagtaaaacaaagtactttttttataatcatacttggtctggtattcaattgattagtggataggcaaagggaaatatagagagggagaagtagacttcacttgatgattggccattcataatgaaagcgagatagaatagatggttttgttgcatgaatagcgcgcacacacatgtgtgcgtattatacatgcctatatgtgcataggatgcatttatgtacgtatatatgcacggatgaggttaatcatctatatgcttgcatagttaatataatgtagcatcatacatgaatacatgtgaatgttattatagtttttaaaaatagtggggtatcacatcacagtaaaatataactgagtatttttttaaagaaagctaaacattcacatttctatgtgcacatagtaagttgtatatggcagcatgttatattatatagtctatgtacgagtacatctattacaaacatgtgtgcgttatgtgtgcatatgttttttaatgtacattatatgaacactcatgttacattatcacatgagtttggttgttcggttggcagctacggctgaaagctattagtaatgctgcatcctg

SEQ ID NO: 3903 - DNA, 3404 bp, Zea mays
  misc_feature (1)..(100): optimal_loci_234266_G1, chr6:153837706..153841109, Cluster 24
cctgctagccgctgaccaaccaaaaggtaactcaacttgtttatcatttctctgaggtattagcgtttttctagtatagtctgagagttacttgatgttttgtatttcctgacattgaggtcttgtgtaatgccaagaccatcacattagatattaaatacaataatctcatggtgaagtttgctcaacatttgttgtccaagcttgacctttctaaagttcggtgtccattggaaaaagcaataccttttgtcgctgacctccacaagcttcactaggtacgcacttgatgtctttatctaccttgttgagtgtattgtctaacaccttatttggtaggaaattttttaagagtcggaagaaaaatccatctgcttatgttgtcgcataagaaacttcaaactcttgaggtcattcggtaggacctagggcaagaaaggagagccaacattactaacttcattcaaacgctatgtgaccagcttaggaccctctcagctaagctcaaaagtatcactaggcatttttactcgcatattccatattacatttttcatttaaacactatgtgaccagcttacagtttactctcatattccatattacatttttattttcataatcatttggcattactctgtagcttataaatccactgtcctggcgtcaatcacaatttagggtctataagtagagcaggctaagatgaaggaaaagatcaccgacttgaagcatattccaggggacttcaagaagaccgtggatggtgaaaaggtgtccaatgaggtgttgacaaaaaagcttgattccatgtctgaaaaaatgaacttagcatcccaagcttggggtcagccctcgccgataggtagagtaaacattatgttgtcccattctcgaatagctctgtatgtcgatcatggccatagtccatagtgttttgcagaaattcataaatttccttttcttcagattcttttgctaaggtcgacaatgaaccatgtatatggttctaattattcatagggctccagtaacctctaaagacaagctagtctttacaacaagatcaaggaaatctatcgggctcacatggaggaagtcagtgccctaactctaggcattaccacatctcattatttgaggatgaaattgtccaagattcaagaagggtttccaaccaacttccctaaggaaaagattgaatacatatagaaggatgtcaagtcgattgctactaagttcatgtcttcgctaggcattagcttgtagttatattgtgatataaatattgaagaacactgaccaactctctgtaatatatagtatttttatatgggcctagtcgtagagattatgttgctttcgatgtgcaagggtaactttgtggttgaactttcgtgttgaattgaatgttatgttaattataactaagcttattttaattctttcaagatgcataagtgttaagttttgtgtttttaagtgaactctttatgtgtctttggatacaacattgagtttttattagattattgtaaaggtgatagcattgcgtttggcaaaactaaaaattccatcatcacattattgaccttagtaagacttctcggtctagtgagtggctttatttttatgatgaatgataattaccaatttggttgatttacttatttcctttgcagttagcgagatagaatactcctattgctatgtttgaagagtttcttcatgttaaagtcaacatgatcttggaaagtttcattattgatttgattaacaagattgttggtcttgtaattctagtggatgattaattgtgttgtaacgtatttattaatagaatctattttagagttggtgacatcatgttgtatgttgtttgtgatgtcaaatgtaaaacttgtctggtggcagtaaagtcaagtcttcatgagcttgaatgatgtattttgttttgatgagcattgcaaaaaggtcagtatttttaatattagtgattatgagtttagtttatatctcacttgtggcctttagttccatttgttgtaaaatgttttgcctctctttttagcgaaggtatcgcaccgacttctgttagaatatcgtccctccttttttagctgagccaatgcattgttttcacttagaaacctttttcatcttttgtgaaaacatcatccctctattttttagcgaagggggcatattggcttcacttagaaaccttgtttcacttattgggactatgttgtacctcactttttagcaaagttgacatgttggttttgcttagaaaccttgttttactttttgggaaatatttccttttcgatttagacaaattatcattaatctttaaggttattgttaactattttgtttttaaattcatcaataacttagtatgcttttggttcgtaactttaccgaaggctccatggaatattaagaacatttatgtttgttttcttttatgttctaaaggtctatctgccaaagccccaaaggttgccacctgcttttcaccaaagctttgtctgaaggaaaggatgtattagtggtgctatccaaaagacttcatagtttattttcacaataaagtttccaagcatatacttacattagtgatgactctataagttagtaagggaaatgtgtaatgtgtataatggttgagtagctccttagattgatttttatagttattttgctcctcagagttatgcttgcttctcaatgtatatatttgctccttagatctttgctttctacttattatagatctttgctcctcattgcttctctttctgcttattacaaatctttgttccttagagctttgatttgtacgttttgatatctttgctttttagttatttatacctttgctttcttcttattgtagatctttgctccttagagtttttttctttttctaattgcatatctttgctccttagatatttgctttctgcttattatagatctttgtttctctcaattattgtgcaaatgtcattccttcatgttagcgaaggtaggatgtatgcttcgctagaagctttggttcacttattatgaaattgtcgtttcttcaccttggtgaaggtaacacatgtgctatgcttataagctttgggtcacctattgtaaaaattacattacttcatcttagtgaaggtaatgcgtaagaatctttaggaaccttgtttcacttgttgtgaaaacatcattccttcactttttagcaaagttaacatgtatgattctctttgaaacttcggttcacttattgtgaaaaaagtgtatgctttctttttggggttttagatagtttagcagtaatctttgttgtaacaaaggttatctgtatctattattgttttctatttttgttgataatt

SEQ ID NO: 3904 - DNA, 1756 bp, Zea mays
  misc_feature (1)..(100): optimal_loci_235935_G1, chr6:162146470..162148225, Cluster 24
cttataagtaacaataccacacattcaatcccacaggttgtacaaaacatcgttggttatctaatgaatcatgtttaaggacgtgtttggatagcaatgataagcatcacaatccttgtccgtcttcaagacggctagcaagagacctgccaagctggtatgggaagagggtattattagcatcaaaatctttttgggtgttttcatacctataaaaatatctcttaatattttttcccaacatagagtcccaagatgaaagattattagagagaaaaaatgcagtatgcaattaaagaggacatgtagttcattacatgtgcgtggtgaagttatccagagtttgttagcattgaagctacaactaatatgactagattgtgccaaaggtgttggtggtagatagaaatactggtgaattcatagcaagaatataaatatgtaaaataagatttgttgtcaacacattagatacgtggtggcaaaagaaatatttgaaaacttgtagtcctcgatagtatttagtattaccagtttattttagcaaaatgaatttcgatgatgtgcaaaatacccataggaaaaataatgtcatagccttattttccttatagtgagcatgaaatgacaacaaagtgttgatgctaacatataagattttgtgatggtgggaaagtaaaagactcgatagaagtattgtattgcttaactaataaaaaaggttgtataacatgcacaatagtcatgtatagcaaaaatatgataattttatttttttttccctaataatgtgcattcttgtgatacgatgaataagtggatagttctagctacaaggtcaatcgaccactcataaacaaatgacgctcattatctaatagcgtctgttaacgatgtgtttggatagcaatgatagagaacagaaatctctttctttttcatgatggctagcaagagagtgttggtattaaaatccttttggatattcctggaaaactatctagatagacttaaagaaatatatcttcccttaatgtcttttcaacactacgactcatcgtcaggcatcgaagcaaaaaaacacatgcaaggtgcagccaaagaggatagtacacataattctagttcaatgaatatgcatagaaaaaacttatgtagagcttgtcagacatcaaggcgtagatatccgagcaccataaatgtgtatcaaaggtgttggttgtagatttttttattggacgtgttggttgtagatatgaatgtgtaggtgcattaacagaaaggatagaaatctataaaataagtattgttgggcatatatcagaagaactcttagagcaatatatcttgtttttcaattaagtcccagtatgagttgtttaagaaaaaaccatgaaagatcaagacaaaatagattactaggacatttggtacttcaatcaatgcgcatgacaaacttatgtagagtttttttggcatcggagccacactaacaaagacaccataaaagtgcaccaaaggcgtttttagatgggacaatagatgtttttaggtttatgctgtggaagggcagatgatatttaggtttgtcgttttgtttcactaaaaggggtttttgtgacatccaaaatattcataggaaaagtaatgtcctagttatattttgcttatatggagcataaaacgctaaaataaattttaagtaataacactacacattcaatcccataggttctacaaaacattacttgttata

SEQ ID NO: 3905 - DNA, 1497 bp, Zea mays
  misc_feature (1)..(100): optimal_loci_240729_G1, chr7:19356467..19357963, Cluster 24
tcttacatagtcatatggatgttttcagcgtgttgcaagttcccacctagcttgttagtataaacccaagtccaaagggtgactatccaacctttcaccgcacttggcacctgacggtctataccctggaccccctacaccatgtcgagtaagcatccactcatccaagatcttaagtctactttggccaagcatagagcacactaaaatcttggtgtttactcgacgagccattccttatggtgaggtactttgcatatggctactctatgcacaagcctccattccatgttgctaaaaagaaagatttaattatcattgttgcatataagagataatcaagattaattataaccatcattaatatattattattaaaggtagagtactaacaaaagactaacatatcaatcgaaggttttgtataaaggtaaaacttggttagtcatccttagtaggagtgaccaaaattaatgcactacaataactgaattcaatttatgggtctgctcaaatactaattgccttgctcctcaaaagcagggtcttgtccttcccaagattgctctttgtccgacacgttccactcgtcgcctatacgttacacacatcaagcaataagaacaagagaggacaaaacaatacaccaaacataaatgacaaagattcaaaagaaatttaaaaacaatctaggatttgcgacatggttacaacaagattgtcgagaatggaattaaaacaaaacatacatactgatttgaagaagaccacacagtgcacacacagattaaattaatcggtttttaaggtggtgtctttagttttgttggtgtcctcatttttacacttagtcgtgttttttttgctttgttttgtccttccagtactatatagtagaagggcaaaactaagaaaaaaattcaactaagggtaaaaatgagaaaaatggcaaaactaagggtatgaatttaaatagcccattaatccatagaactaagattgagggcagataaagatctaaacaaatatacaaaagttgatgggaaagaagcaaagcaaatataatttctttccggttgcataaagtttattggttcattaaatagatgaggtagcagtggaaaaggaaaggaaataagatgtgcatagaaatatattttctcctgtatgccactgttttctttacccgcatggcactctacgcagataggttggcaccaagggagggaagaggaacacatgtggctggaaaaaaattggcgtgcgacgacagcatgactgacggtttgtttcagcttacagattatataatataaaatacataagattaaataatctaaattatataatttatatttaatagctacctagcatattgaaactttgattagttatgtgttacgtgcgtcgtgggagcaaagaaaaatagataaatatttttggtcaagagtgacaatggtggataatttctcttgaaggtgccatgaatagtgggtt

SEQ ID NO: 3906 - DNA, 1970 bp, Zea mays
  misc_feature (1)..(100): optimal_loci_241284_G1, chr7:22000402..22002371, Cluster 24
gcccatgaattttgtttttatctttcttctttactgttttgagcgcttgatcatcatttgtgattgccatcatcacctccatgagtgtcacccttgctcaaccttagtgtgggtttaacctgtcctaatcacaacactagagtagaggttagtccactagttgtctaaactactaaaaccaaatataaatcttttgacttgtgatagtgattgcctttcttgtagctcaacacccctttatatagtgtttaggggacatgtagatacttttaggatatggagggaagttggtggatcactaggggtgtcgaccgacccagggggcatcaaccaactctttgttccactccatcccatggctatggagtggctcctagaggaggtcaatcctatcctaaggcagttggagggtcgatgtagctcttttggtgtatgatagtgggccatcaatttaagtgaagctcatctgaagcccttggagcaaaccatcatcaaaccaacatgccaagatgcttcaaggtgtgtttattcactctccctcaaattagtggcatgaaaaaggcttagggggcatcaacaaatgtctaggtggcgatggtctcaactaaactgagttcccctagacgccttaccacatccacacctgcttagctatgtgttagttgaaaatgagaaaaatgacacatgaataacatgttttatatttaccattaagaatagttaagaataatcatcttagataacatgctcccatgaatagaattttttgtatgtcccataaaaattgaagctaaagttggtgcactttaggtatgaagattgaagttctcatttacagtatgtttcagccattaatatgcatctaatcgtggggaaggtgtcatggttcatttgtggattgaccaatgggtgcacaacttctcctttgaacacttgacattgtgtttgtttagtgcaatcctcatttcctccaatcaaagtccattattgaagccctcaattttcaaccttgggttcttaacattagaggcacattgatgggttaattttttgtcaagtacaacatcatttgtgagccttaaaaatgtagattcacatgctaaagtttgaataaatttgattggttgtgttggtcaagtgatggcaactactcaactatactaatcgagccttctttgttggtgatgttggttttgcaagcagagaactttggaaagcaaggatgctaccaaaaatgaagttattttaaattgctccttaaacatattcttgtcagcttcatcatcatagggttatttaaactacgacctagcatgatgtttacgaccatccaatgttttatttcacaagtagatcaccatttgttttttgtaatagacatatacttgtaacttggtctggttcttcataactaggtgtcttctcactagttgatattgtattttcccctcatcttaatgaaaaaaatgcatgccaaggaatgcttgtggaaatcccaataagcatgacgtgatgctctaagtgtccatgcaagaataacatagagcttaacaacaaaatggaagggttatgtaattgaaaagggtaagctaacatatttactcgttatgtcccaaaatatttgaaatataaggtatgaaaacattcataatttatttcaaattataaggtattctaggtgaactaactctttcaaaacaacaattacatgtgtatataccataaatgttgaccatatagcttaaaatatggtaagcacaatatttctataggtaagtaagatctatatgtgtcatttggtttacctaataagttgtcttagaatcttattataccttatattctaggatggagggggtatctataataagtttaaatatgcgatgaaggattgctgcctaatcaacaccactctaacatgatgtgtaactatgtcttgttttaggaaaagggagtaaaaaaggatacat

SEQ ID NO: 3907 - DNA, 2619 bp, Zea mays
  misc_feature (1)..(100): optimal_loci_243398_G1, chr7:35096958..35099576, Cluster 24
ttgcaaggtctgttctctctttctgcacaatataggcccgtgtgtgtttgcatgaatctgttgctcaattaattatcctcgacttgcaagaccttcgatttccattatcgcgttgtgcagtaatcttcactcagcttttttggtttgcctttgtaccaaaaaaacatgttttagagatagcctactaaaatctaaatatattagatcatttttcggtctgtatggttaatgactcattcaatatgaaaactacatactttgtgtgcaggacttaccatagttgacaacattatatttcacatagtttatgttagtgtttggaatagagcacaaattattttaaaagtttggaaacttgtttgaacaactattacatttaaacaatgtcaacttatgtgatatatagaaatcgtaggtcaacttattgtaaaagtaattctgtttatttttaaaaatgtttattgatggcatgttattgtaactagaaaacttttttcattgcattgcatgtttatttcagtttatcaaaaacagagcccttttttatcacaccaataaaaaataaaggtagtccagtccagtcaattgtgtttatcatatcaagaaaacattttttcattgtcatgtaaaaaatataaaataattatatttatttttgttgtgttcattcttaaactacaatttagtagttcgaccccaatgctcatgccttaattgcatttttttcatttttactttcgctcaattttgtgcagcagtattctttagtaaaagacgaaggaagagtttgctctgctaataaattgatgacttattattagccatctgtctgtacaggtcataatcgaagggtttaagagctacaaggtggagatcaaatagtgtccttcagtcccaaagttaacatcgttggtaaaccccttctgtcgttacctcacaaatatcacttaagtcatagggtggttagttttcacgtcttctgcttgactgcttcctaattgatgcacagataacagccaacctctatctagagatttatgatgagctgtggttgcatttttatcaatttatgattgaatttttttacgggtgctaggatttatgttgtcaaggggctattgttttgcgagacaactttcatagttggtgggtagaaacagtattttatatttagcataaaccaatcacattatcttagatccaaatgaagttatgctacaatcttccatgccatatgtaccattatcagactgcttccgctcaatgctatgtgcaatatcttctgtcctttcttatgtatgattgttttttatgaaaacaatgtgtgcaatatcttagcctttttatgtatgcatgattatgaaagaagttttgtatatagtttgcaagcagcaatttagtcacaatttcatactcgaggtgttctcattacatatagttgttaaaagtcaaactcttgctactggccgagggctgcaaacttttaaaaccggactacaaggtagtgtctatattgttaagctgaggacaccgaaatgattgcaagtaagtgtgtactatatagcaagtacttaaattcattatgtattgttggcatattgtgtcctgacgaaggaaaacaagttataacagttcttcctaaaatttcttggatttcttgtctatcaactgttactattcgtgataatgatacttatttgtcattccaatctgcattccctagtttgattaaagccaaaaaatttaaatgagaaaacattgaacgcttattttactttctacacacgtgatgaataagcacatactgaattttcgttctcatacactaaatttattttgaattgtccagtgctgaaagtcgctaccatgaagcgtgcaggagtactttcttgtttaactaagtggatctgtattaggaatattgctcagtggatagatcattgtgttcacacatttattgcaaaatttaacatggttttttcattgtgattggttgattggtttcatgtgggttattccttccaggttaggttctgctattaggttctacaagtcggtcatgtttcgtgtatgtattttaattgttgaataagtaaataccaaatagtaaacgatgattcctctgatctttcaataatagcgtagaacctacacctttcagaccatttccttgataggtttatattttttggcctaaaaatgatgcagcttccgtctagaaattttgtgttgattttctgtcatatttgtttacatttactggttacccagttccttgataggtttacattttctttgtcaaggcgcttagcccagttccttgataggtttacatttactggttggtgtgctatgtaactgatcacttaatgttcacctagaaactggtttaattgttttgtgttgagtgttactgcattcattatcataggctcaagtaacctatttctatttgggtggcacacaataaatcagacttgttccatttttacttcggaagtcattgtatgatgtttcagaagaaaagtgaaaattgtagagcttcaaaattgtacaattttttagcattataagaaacaaagattcaatttttttgcacctatcgttatcctaataatt

SEQ ID NO: 3908 - DNA, 1707 bp, Zea mays
  misc_feature (1)..(100): optimal_loci_25653_G1, chr1:155639451..155641157, Cluster 24
attttgtcgcttgtgaatgtgtacatgtttggcagctagcttcctgcattatatattggcatcgtgctgcttttttttcccccctcccatcttccggtcgtaggctctggattgttctacatgaacgaactgtacagggatttgtttctgcgttaaaaataaagtgaagacgagagtggtttaaacctagccctgatcccacatcgattcgcgggcgttgtcactgtcgtcgtctcgtcgatcggagtcgtcgtagcaccccgcgcgcgctactagcctactagtacaaacagttccgttgaatgcggcatgcaggcttccagtaccaattggacatactagctatagtccatgtcgaagcttccttcaggtattagagcatcactaatagactctatattttggaaaacaacaccccatctatattttgcatgcttttattgcttacaccatatatagatacaccaaattactcccattcatttcgcatcccatttttatctcttctgtccataagaaaaacataaatagataaacgagtgttatttcctaataaagactgtcttaaagtagtgctgttttgtagattctcccccggatttgtatgcacacaaaacatttgttttgagaattgttgtctggagcgttcaataactccaaccgcgcgcgtggatcgtggtaaccagtaaccttacggtgctgacggaagctaagtttgggcatgcctatgctaatagctagcagtagtatggattactcttatcatgtggattaatcaatttctttggtgccacctcgcaatcacacgacgatcttttacggtcgtgaaataatattctacgcggcagtagcagccgcctcccgtgtcggcactcggcgcctaaagtttgcagccgaacgctttgggcacacggacaaaagcagtggccatcgatctgaccctttttcttggaggtgcacgtacctctcgacccctaccgccttctaacagcttcaataacatatttctctccaattcacagaccgtacacaattaagattcaataaataaactatataaacacacatgtcatctcaacatggtaacatggaaggtgtagggagccgaggatcgcttgggaagtggcgggagaaggtgaccggcgcaaagaaaagaaaacaaaaaaaaatattgtttgcatccgagcgttttgcgtacggacaaaagagttgccatcacagcatgaccctttttcttggaaaaggcgcaggtacgtatcctctcgacccctgccgtgccatctcggaagctcagcgtcttctcgacacgctcacgccgatcgccgcgcacttggaacagggaagcgaaaaggctagcatgttcgtcctttagtatactgtatacacatatatgtttagtgatatcctttcgcgcccaattgtagcgctattctctagcaaatatagaactttcgaccagtttttagctctagcgtgagctaccattctctaccttttaatttataattcatttaaattttttattctaaatttgatcaactttttttattcaaaacaaattataattattattagtttttattgtaatatcatttaacatacaatatatttaaagtataaatttatttttttcattttttcgaaaaattgagtaagatgagcaaacttggtaaaataaattaaataaattataaattaggacggagt

SEQ ID NO: 3909 - DNA, 2074 bp, Zea mays
  misc_feature (1)..(100): optimal_loci_262218_G1, chr7:152809744..152811817, Cluster 24
atcagaatttaagaccgaaagaagagacaaaatgagggtagagtggataaataatagcatgctatgctatattacgcgggatatgtttgcatacatgtttcttaaagatttgaatcatatccggctaatttgtcatgttaaacatcgactatatcatttaagtgtaggctgaaaatatttagccttatcttggtatctctttgattcactcctgaatccccactggatgaaagtatcagcagcaaagcaagccaagccatggacataacacaagtggagtggatatatggataaggaaggaaggtgacaagacgggggatgcggagtccggcgattgggcggcaggctgctctgctcgagggctgggcagggagattcgcctgcgacgattgatgccgtgccgccgcgcgtcgggcagccggatgcgggatgcccttgcctgcaggaagccgacatgccggtcgaaatgtgatgcagagctattctttacttcttttgatggtggtcagggttaatggcgatggcgcgcgctacgtgccacccatcgacgtgatcgatgggaggtccggcaggcggcagtggcagcgacctgcccagccagaagtgagctgctgatttgagatccagcagtggcattatctggcgctcagggtctaagtgtacacgtgtactacaagtactacctttccgtgccaacttcgctcaagcaggtctcgagtgccctggcagtggcacaggcagaagcagcctagtgctgctgtggtgtggccctgctctgtttaggctttacctgccgcatcaagggggtgtttgtgtcttatcaaatatttaaatgtttttataagtattaaatataagattaattatgtttaataaatttgccttttcaagtcttcgctcctatttggaactatagagctaatagttagtcaactaataaactaattgttagctgtgaggtagctaacaattagctgtggtattagctgatgttgtttgaaatccaacaactaatttttagtagttaactattagttttagaggttctaaacaaagccttcatctatataattagtttataattaaattgtatttaatactcgtaattatcattcaaatatctaatgccatagagactaaactttagttaagtgaatactatagaaagagctctatcgatcacagacctaccgaaccaaagtgacttggatagttggatccactaactcggattcaaaagtaccaacatccactaaatcctccttggatccgatcgagatcacaaaaagaagctcctcaataccagacatcttcgcaaaaccaaacaaacgacgttcgagcaaccaaacttcccacaaacattcatttcgctaaaaccaaatcacaagacttttcatttatggttaacaaagcatgatccacaaatgtggtatatatagatggcctcgatcggtcaaaagtaactgttttcacctttagtttatacatggctatagttaaacaatttcatgggataccaaagtaggccttcgtccatgagaggctactgtgaaggatttgaccaaagataaatgtactcaacggtatttcaaagttgattaacaatttcttcctttttgttttgacacctgctttcagaattgactttgtattgagaaaaaacaacgagaataagacagatatctcgattcacctaagtgcaaaaacaaaaagtaaagaccgaagacatttgaccatcttcgtctttcgctcaaagaacaaagtctactgcattatttctacaaaaaaacatggacgagacacgaaatcatttcattctttttgccaaaaggcagactaagcctcattgacaaagaatctaatcttcataagtcaagcaaagccatcatatgaacttcactatgagacgaagagaaatgatatgaagcttcatttacaaagattggcagttgacaagagctatagcctaaggtagagaacaaatgatcgaactgacgaacaattgtagtctaataagtttagggcatcatagattttatatagacaattacgaaagcgagaacatctataaata

SEQ ID NO: 3910 - DNA, 1753 bp, Zea mays
  misc_feature (1)..(100): optimal_loci_262370_G1, chr7:153696346..153698098, Cluster 24
aaaacgaaacgatttagacctcttttaaccattttcgaaattaccttatttatttagtattttataacaaattcgttaattttccaggaaaatattaaatctgaatggatctttataaatttatattaaattcactttaacttagaaaaatatgaaactaattttattgtttttctaaaatcaagatgtatataatggtatagtttagagttgtttggaacttttatagatcaaacttatttatagttcctctcccattactactcttggtaccgattatgttgactttctaactatatgcatgtgtgcacagtgtttgccatttatatttgtaagatatttctttaatgctttatgagatatgctttaatccttcaaaaatttatgaatatttatattattaataatttttatgtagatgtatgactcgtgagaatttttaatgtaaattgtgggtacatgttatgattgttaccggtgtattttagttttcgaccgtaagcggtgtgttttccgtgtcaaattttcgttctcgatgtttttaaattagcgatgtcgttttcgttttaaaaaataaaaataaaagtagttttagtgcttaaggaccgttttcacccccggcctagattcacggccaaggctacgctgatgtcagatcgagatgatctgaaacgaaaaaggggtacgtcccggccgaactgtgacgtgatcaactaacttttcgcgcgggacgaacgctttccacggtcaagctttccagcgttaacgatcgatctggcttttttcttgggcatcagaaaacagccacacagcggccacggcaagtcggaggaattgcctcaaaagccttatagaattccagaagcacatgttttgaattccagaaggcacgtagctaactgatgacccagaacaactttttgattattggacggaagaatcagttacgtaccgaccgtgacagaatggagggaagcatgcatgcggcgcggtgagtgaggtgcgtacgtagctttcatcagtggaaacgtgatagtggcatagtgctgactacctgatggaaaaccacgaatcaacagctagctcaggaaagaaaaaaaaaaacaggtggaaatgtcagaaaaaccaggctgctgatgcaaattacctggcttgcttaaataaccaacaaaggtctacctaaagccattctagaaggtcaaaagggaagatatatagctgacgccgtgttatgtttatactaggcgcgcgctcgtatgcatgtgggatcaggatcacggggagtgtggagtcatatatgctcatgccattatatcaaatgttcagggtcatgatcggaagggggaggtgaaaagcgtgatattcttggttaggtcaattgtggacctaacatgggtagtggtatttttagtcagcctcacagagaaactattcattcgttagaccacacgggtgcgttaaagttgtcataagtaaactatgtactaccatgtgattcaaacatggcctcacttttttttaaggctctcctactatttgtgggtatgacgttttttatctattccatcaggagacatcaaatcaagaccctgaaactcattctagtcgacactgacatataagatctctagtcttcattcatccacatccatcatcaggatgggcgggttgacagggagggagatggtagggttgggggtttatgtcgcaggagccatacccagggagagagaataaggctggctcaacgcct

SEQ ID NO: 3911 - DNA, 1688 bp, Zea mays
  misc_feature (1)..(100): optimal_loci_262575_G1, chr7:154603547..154605234, Cluster 24
cgacaacggattgaaccaaagctccaaaaagcaaaaaagacccaaactataatttagttcagattttatgcacgcatacaccttcacatgaaagtttttgtgggccaaccgcgctccgattattttcggctgtttcattgcgatcgctgaaaataacttatttttgacaccgaactttcgataacatgtgaccttcaaaaataacactgaaatcatggaaaatatattatttctagcgaaaactgtttattttcggtggttttgcccattgaaagttagttggtttcttgtagtgtctgcaactctaatagttaaactaacaactgataataagcatgggagtcaacaatgtctactttctcttttctagtctactagtccccccccccccccccccacaactgacttgataaaatctttactgccaacatttttttttcaacaaccatggttaggtaggacaagtaagaactacgagagcttatttgtcagaaacgcctacgtgacagagctttacggggtaagtagagtcattgtaaattgtttttttgatgccgcatgcaggtcgagcccaaacaaaagtattggctctatgtgaaacaggcttatttcggcgcaaaagtaggagtatttctcaagagttaataagtaacgttaggttaacttttctacacaggagaacagaagacgttgaagatgtcaaagaaggaatagataaaaagtgaagcacatggacaatgaaaaatactgtcaactgtttatatgatgatgagcagcttgatcgaatcatcaatatcaggcagcagccagcagatccagcctgcggatttcttttcgccgtggtcggtcacaccgaccggtggcaatcaagtcgggcagtaggagtatttaactgtagagaacggaatccagacaaccatttttttcttcaagtttttatctttacacgaggtgaattcagagggtggggcagaggggcggtcgtcccggcctccgggcctccgaattcatagagcctaattttagttatgtgatcaaatagtccatcaataaagtaataaatatctaaacatgttagaagaaaatttcaaagtgatactataatatatatccttttatttacgtattatttgatataaatatttttagatgtattttaagtgtttaattagtaacatttatatattaaaaataattcgaaaggcctttatttgaaacaatgaaatcttgttccgggtccctaaaatgttaggaccgcagttgggtgaatttgtcaaacctccgagataaatatacaaactatttctttcagctgaaagagacacgggaaatacctgcagcccttgcattattgccaagaaataaaagggaaatcagagctcaaatagaacaatgattgaatactcgtagatcttggttggcatgaaatttaacactagctagatgaaggatatatatcaataatttataaaataatcaacaaaatacaggtcatgtaatcatataaaagggttttctttgccaggagaatgtcatcatcctaagctcatagcccactcatgccaaaccagttgctagctcttgcctactatcgtggtcgataaaatttcgattttatcctacaattccacatctaaggactaagcaggtctaaattgattggacaaagtctagattttacacacaac

SEQ ID NO: 3912 - DNA, 2243 bp, Zea mays
  misc_feature (1)..(100): optimal_loci_26347_G1, chr1:160520032..160522274, Cluster 24
atgcttggatgagcttgatggcaccaaagcttggtcgaaacggtactacatttgtactagtcgaactactcaacaatagaagatcacgtcctaggtggaaagatggaccctatgggttggattgtaaatagataataggttagatggaaaggttggctaagaagtgtttatcgctttaggtccatgggacaatttaatgtaatagtttacaatcataataatatgaaggcatccgttcaccaaggagtgtgtgcttctcatctccttgatgcatcatcacccctttccttagggttttctgaggtaagtttcatgtttccatgaggtgatctctagtagataacaccagggtatcatggtgtcactaccttaccctagtacatgttgtactaatcattgttgttagcaagatctactagttatcatgtgtaatttcaacctttttctacttttaagcttcatgttattagattgattttacactgatagatgtgtattccttaatcagttgctacactctactacatccaagctacagcatgtgcatgtggcaacacgagaggtcaatacacatctggcaccctaccttacatgcttagtataattgtttactacagatggacttatttggaggttctaatcaatgttcacgtgcatgatgattggctcccaatgaaggatgttgctaggattgccaacatgatacatattgtagatatatgtaggatgttcctatagttggtttactgtttatctgaccctagatttgactaatagtatgataatcttttggcctattgttgtgcctttagccatgcacgtaacttgcctcgcttaagagtaaacaatcaactcaaatatgctttagataggcttactcccttcattagtcactttcaatgcatgtttacttccatttattatgatcattactaactcgaaaaaattacaaatagctcaagggagacaattagtgcaagcagctcaggctgatccgcgtaatctagctagaatttaacatttaatttattgttgtacatttgcagagcaattcaccaaaatcatcacatccttcctggctacaagtcaagctaggtggcatgcctagaaccctcatatctggagtcacaattaggagggacaaccataatagttacacacctcttagctccacgtgtatcggttgtcggacaactcccaagcaggtttcccgtgacgacacatttctacatgccatgtgggaccaacgaatcaactttcacatcagctcatcaacataaactcgaccacgactccacgtcaactcttcactaccaccttgaatcgcacgggtaaagaaatcatcatcaatgatgatagcaagcactatccatcaggcaagacaacactgtcgtagctcaacgacttcaatcccgagatgtaggagtgttatgaccgggtcctcaaaaccttaactgataaactcttcacatgtttcacctagacatggtctagtgttgtctggctcactaggaaaccaaagacgcttctggaggaggttgatctttcgacaccattagaggagcgcactgtcgctctttaccaagaaatgaactacatcatccaccattccatggtacaacagtcagagatcccaatcaactccatggagggagttattgcacgagtggctagatcgattctagacatgaactacactaccctagggccaacttttgggtccaattagggcaagaaataattctatgcttggccaatagagccaacacatattagtgctccttagggcactacgatcaaattccttgcccaccaccctaatttgccacacaagataccctccattatctatgttcatccttcaacatatatcctggaggtcaattttccagtagtgttgcatccttggtacaaataaggtaagatgattgttcatgatcctatcacacaagactgatatccttataaatgtagcatatcccaaattataagtgagtccacatgtaaagagatagagataagtatctccatttgtaggagggggtctgttaggccaatcttgatccttgtctagctagcggctagataggctttctataaccaaccacaccttttgggactataaaaggggcggtagtgctcaccaaaggaaaatcatcttatcatattacataggcaatatacaccatactacatagaatgtaggttattatctcacactgagatcccaaatttgtctaaat

SEQ ID NO: 3913 - DNA, 1423 bp, Zea mays
  misc_feature (1)..(100): optimal_loci_264575_G1, chr7:164697459..164698881, Cluster 24
gataatttagactagatacaagttatatggtatctatttgggtatattgggtttagaaaacaaaacaaagagagataacatgaagatataaataatttgagttggttgtaggtacatggtcatctaaactctttatgtcttctcagattctagcttgtgtaaaaacatcggttgatgaattagcaataaaaatgtgtattaacattgcaaaaaacagagagaagtttcttagtgaagtgagaaatgaagcttgaatcttcatattaatctatcagttgatctctaattcatagtgcatcgtttgtggcacttttataacgttataaagggagaaacttgtttagatgcactcatatacatcttaatccgcgtatattagaatggattaagataaaactaagcttaattttcaccatgatatactccaataaatataagctacgatttctatatatcatatgggtagactttattttaataaaatacaaaaatgtatgtattctgttttttaagtgtagtgaatgtggagtcaacaacaaaggtttaaacttccacttatacacaattttattttatttttgtctcataaagcgtgagtagatagattaatctgaatatgaatatatctaaacaagctctcagttgtggtaaaataacacttcacgtgaaagctgaacttgtggcgagcagaaaaacaaatctcattagctgaaagctatttctttggaggcaacagggctcctgtttatatgaaaatattggccagatggacacgtcccaatccaaaatgatgccacatcacccccacgccactcaacaagcatagatccaaaaattaaaaccttagcctttgtccactgacggccaaccacttcgaaaagaggcgaactttctaagatgcaaatgcagtatgcagctgccgaagctgctactcgacatatatctaggtcaaagcgtctacgactcctgccaagtggcatccatcgagtgaagtactcaagtttttgcaccgccccttttgcatattttctaggttccacttggattttgtacgtactagtgtcggcaaataattgctttgaaaatactccaactatgtgcaagcgtctgaggaaagtcatatctccggatactagcaaaacatattttttgaactccgtcagcagaaaatggacctatagcgctacgtcgcagggaccaagtctcgtgccagcctaacaccatagaatacgcaaacaccagggatgctaaaactaagaaatataaattcggaagcatctatgttgtatttgtaaacatcacagaagtaaaatagacataatcaattataatgtgtgatgtgtcgcactaacatgcaacacaggagagacccagtccccgcgccgccggcgcgccggttccttcggctcccggccttcaccgg

SEQ ID NO: 3914 - DNA, 2443 bp, Zea mays
  misc_feature (1)..(100): optimal_loci_266135_G1, chr7:173034202..173036644, Cluster 24
catgcattcttttaaatatttcacctttttgcatgatatatacatcttaaggagaaatatctctaattttgagaaagcaatgtaacgatagcatactggggataccattcaccgaacaaaacattaaagcaactacaagatcaaatttcaaagtcgcggcacacgtaagctcagtttaaacttcatctaacaaattatgatatactagcaaggtgctcatacattgttatggtttccatttatgtgtgtgtttattggtgtgaatatgggtttagagccaacaacaatggtctgaatcctcatttatgcataattttagcagttttaaggtttaaatgttggggcataacgatagtggaaaccgtgaatccatggaaaccgatgctttaatatagcatagaaatcgttcatgtatatcagcttctccctatctgtcccctttagtagaatactccatttccgcaaccaatataatgttgcatacatcacatgagttggcgctttagttttgaggggatttcttctctatagtcgtcttgtttatagaagtccacaaagcccaagcaaaatatgcagaggtacacattatcaatcctagtcgtaaggtccccttgccttgcagccaagttatagtgatatgcattaaggatttaggaaatttttcaatggaacaactcttgtaaagtactccatgtcaacctagccaggaagcattggaagaaggtatggtctacagtttctaactttcacacaagaagtaattttcactcccttttcaacacatcttaagcaaagaatgtgccacatgaagcttattattaaagacctaccacaagaaaaaattgatcttcaaagggattctaaataaacacttcgaaatgatatctgccatctactagttactcatctgtttgttaagaatatgtacaacgatttagtattgaactgacaattcttctctaaagtccatatgactatatcatgggaatcctcatgtaacacaatggtaagcaactcgctatatagagccttccatcacttaaattctagaatagaatgggatcttctaaagtcaacaaaccagtccccctcaacccaacactctgaaactctacaacctagtgacattaccattttgtaaagctcttcatagttgatcatgagaggaacctcatgaagcaacaatattaccaaaatttgtaggtcttaccatcccctatcttgaagataactccctgtttgaacatatgcttaactttgtatgggccttgccaaaacttcactatagccaaaaataagttgcatccatccatatacttagccttaaggattctaaatcataactcgtcgggttgttgtaaaattttacaaatccatttgactaacaaacattcattcattgttgtagtgttgatgatgctcaacccagtttggtctttgctcctactcatcatttctcacttagtcgtgtggtatctaaacttattttctattccttgacacaaaaaattacctcggaagttatcgttcttatgccccatcttgtaaccaatagaagtccatacaataaagaggaatactcctccaaagtggagatgcgttcgcggagatgctaattatgactatgacacatgcaatatctttggttagatgatgtcgaatagtgtacatctatcttaattataaaatatttccactataaagtgagtctcatatgagaccttggcataaatttatatactcgacacatacatagatacattaaagtcagccttatcccacaaatttggagctaccccatataatggagaacatttaaatgctctaaattatactaacaaaattcaccaaggtactcttatacttctgagagtgcaaatccaggacagagaaagcatagtcacatcctctgtatcgttactaagtatatgtcttctcaggattatattttacaagagaacttttaaatgatcaatctagcgttgttttgagcataataaggtaaactacatgaaacccagaaacaatgagagaagcgattggatttatttttcatccttacaactcatgaacacacacatagggagagaatgcaatttaaactcttcattcattgaagatgacttcaacattattccaagagaagtttggtttcatatatcaaaattattgaaaattactatctaatcaagaaatttaaacaacctactcctaaatatatattaaataaaaaattggaaaaatttgtggtaccatttcatatgtactatgaaacaaagcacagaagacataccacttctttgcaaagatatttcaaacatggtataaaaggtgttaaaccgcctcacaaaacaactttacatatctacttaacatgaataagacctctttgaatggaaggtaacaaatgtcaagtggcacatttccaacaactcccgtgtgg

SEQ ID NO: 3915 - DNA, 1429 bp, Zea mays
  misc_feature (1)..(100): optimal_loci_268578_G1, chr8:9259442..9260870, Cluster 24
tagtatgataaagttgttaacattggcgttgttagcgtgacaatgagttctatacatcactatagcaaataaggttcacgattcagagaactacatgtcaatgaatggcaactcggaaagatgagtagcaccaagaccaagagtagcatagcaacttcactatttgagcaagaaaaccgcacttcaattggccctacatgattgtgaattgtgatgtcgctgacttggtagtctatcttcttgtctcttttttgtttgtttgtatgagccttccatgtcaccgttatttgagcaagagaatcgcacttcaactggtcctacatgattgtgatgccacatacttggtagtctttcttcttttgtgtctttttttttgttcgcatgggcctcactagaaggacaaataggcacaacgcacactcatggtcacggtctcacgaataccgaataaaaacatgacaaaataggaaaaactctatataatccctgatctttagaggatggtgtagttcactttatcaccttcaaaattggttgtttaacccgatcatctttataaaaacagacaaataaccactagaccgttttaattgactgctttgatgacgtgattttgatttaagcgataccggttttatcttttttaattctacattctagtagtatccaaaattgaaattatttttcacaaagatcgataattataaattataatttccctaatttcctaaaattttaggagcatcaccttaattactaaaaataaaaaactaaataaaaacttaatatttttgtcctgggtttatttattaccttctaagccaaaaaattacactagagctaaataacattattactaaactactgaaatgtttgttgattttattaagcaggtcgagtggtctttctattaattttaactacattaattttatattggcttttatagaaacacttaacaaacaataataaaataatctctaatttttacatagaccatctcttagctaaactaacatatataaatattctcatatttttttgagaatttaaatctagatctatataaaggtatcagaaataattatgtaaattataggtctagagttaaagttgtcagaaaattctaaaaattatttgtgtatgttcatttagctaagggaaaatctttgtaaaagttagagatcattttattattgtttgataagtttttcaaaaaaaataaatgtaaatttgatttaatttataattagaagaaagaacacttcacttgcttaataaaattaagaaatgttttagtagattagtaaaagtattatttggctcacgtaaaaaatttagccttagaagataaaagtgaatcagagaaaaaatattaagtttttttatatagtttttatttttaataattaaggtgctactcgaaaat

SEQ ID NO: 3916 - DNA, 1918 bp, Zea mays
  misc_feature (1)..(100): optimal_loci_270093_G1, chr8:17666923..17668840, Cluster 24
aatatgtgccaacttagagtacagtaccgtcatgatcgtgaccatgaatcggcttagatcaagtataatactaggctataaaactttcatcattataacgagaagaggaactttaaaagtgcttccaaacagaatgctaggtacaaagaaacaaaacagatgggtgtgtggatatccagcttggccttctcaagcaattagctcactgagagtatgcagggaagtcaacaggtcggttgcataagaattcactgcaaaaggcatatcggcctagtgatatggtaacaagtcgcatcatggactaaatttctcagatgggcattattacattttaggaaataagtcacatcgaatcttgataattacatgtgttaagtataatctatttataaaactaattatacatatgaagactaaaaacaagagaaatttattaaatgtagttactatatttaacacttataactgatattcaaatatttaatgtaacacgaaataaactagggaagcaaataccccctaagtctctcataattctagagagctgcacaacacatcataaaccaaaattggattaattaaacagtaacatggtccactggataatgtaaatctgatgtgtttagctataatataagcttcttcagtaggtgccgcccgtacagattatgatgctcataataacaaaaaaaagggtgtatgtttttccctcaaacaaacaaaaagaatccaactgttcacgttgcaagatagttgggaagaagaaaaaaaggtaaaaaaaggtgttgtcactatatatgtacgttcttcggtcgtactaccgttgactttcttcaagcatgtcagattataaagttaataaactacaaccagcaattacaaaagacctaaaaaatccacaatacctcgcccagtgatctatccttggccttgtctccagtaatgtgattcctcatccctcgtggaccacaaacatgaataaacaaaaattatgaaacatattatgcaattaacaatccaagaaatgaagatgatgttggagatcataagcaacttcatgagcatctccaggagttccctatccaaacttttagagtcaaaatataggtttatgcaacaaaaatcaccctccagcagcacccctatccaacatcttatatttaatcgtatcctaaatcaccttcactttccctcaaatatggtgtcgagaaactgttggaggaaacatttaggaagggattttttgtcaggatgcacctatacagtgacataggggaataagtttacattaacaaaattaatcaaacttactttgttaaaaacaaaaatataaagaaggaacaactctacatgatatatcatggattcattaagtatcacaagaatcagcgagtcctctgctgggcctggcaaacctttcaaaaccatgtcctttgatacaaaaccaacaccacccctccagtcagttgagggtttatcaactgtataaaatacctgtaatattttaaggacaatgctatacatacagaagaaagttatccatgttttgatggattacacggaagggcatacctcgcgtgcagtggtgaccactggtgagaggtgtctcactaagtcagcaagtcgcgagttgcaagaggaaggcttacgtcagtttatctcttgtctagactctagaccccactcgttggtcggttggtgttatacctgcacaggggcggtcctaattgaattcaatggtattcaaatgaatacccattatttttgtcaaaagtacttcaatatatatacatatatatagtgtatatgcatgaatagaaaatgaatcaaataaataaagaaattatgttaatttagaccaaaatatctccttcctacttctcatacctaaccaactttatagtttgttatggaccat

SEQ ID NO: 3917 - DNA, 1528 bp, Zea mays
  misc_feature (1)..(100): optimal_loci_270319_G1, chr8:19118594..19120121, Cluster 24
aaggagagggtagaccatcccactagaggagccctaattcccctattacatctcctatcttatttttattttcaaactttactccgcaaatagtattaaatagtgtcatttacacattatcgtatcccttattttagacgatccaccaaagataatccaaagcgtttgaaagtttttgggtaggcagtagaagtggctgaaggcacctagtagaagtcagccatcccgacagagatggagggatagcgcaggcgacgagtgagaatgcaggtgataggtcgctgacattttgttcagagtgaaaaaattacccttttcactcgtagcttttattattcacacgttgaagtggatattttggggttgttagccagtggggaaccactggtcgtgtacgttaaggcttcctttgaaacgtggtattatttttcgccttctgtatttttactttgaaaacgaatttattcttgtaaatttcttgtatgataaattagtgtgtttcaaaaaggacataatgaaagaccgggcaggaaaataatgaatgcaccctgtatgatcgagggcgaggccaaggatgtttgcgggatttcgtgaggtcggtgagtgcggtagagccgacgagcagtctgatccggagtgtggctgtgggagtcggccacgtggcagacgaagccctgcccattagagcagtacagtatgacctacggaagtttcaagtgtggcggccgttttttaggggcgttcgttttttagagggagaagattaagggctttaatagttaaagcctaactccttttgttgcctcaattgggcctcgtatttggtcttttaataggcccattgtttgttctagcctttccaaatggttttgtttggtttcatggcatgtacccggctctatgaatgtgacgaatactccggtaacctgtaagggtagggctgtatcgtttgtacagtgaaatttaaattaaatggaggtatatcaaataagatggataagctgctgaagacagcagagcatatgaaatagttctctagccctgagattaaaaaaaacagtagtccctgttcttaatctctgtttttggtaggaaggagaaaaaaacgccttataaaagttttacataccgacttggcagatgttcttttttatttttttatatctcatgcaaagtgccgtcaatcagattctagtattttaaatgtatatgcttagtacaaaaaaatatatttggatagttttcaaacaaatctacattttttatagtttaattagccatcttgaacaaagtctaatttacctagtcgcagctaacgtagcatgacacaagctaagggtctatttggttcagctatagattcctgaaatctgattctagctgcaagctgtgagaaagctagcgcgagccgacgatatttgcgagaaagctaacatacgtttggtttaaacaattttcaattgtatattctgtaaagagtatgattagcttgataatatagtcgacagaaatctagaaaatccaggct

SEQ ID NO: 3918 - DNA, 1453 bp, Zea mays
  misc_feature (1)..(100): optimal_loci_272676_G1, chr8:34193410..34194862, Cluster 24
ctagtcacgtcatcgtagtcgtgcttggacccctccgttaccggcgtctgctcttggtgagacccgccatgtttctcaacttatttcctcacccgacgtcatgcctgctaatgatgtatgtgtatgtgtggatatgttgaggagtgaaatccctggtaggttaattggagtatgagggcgaagtcctagcgtgatgctcatcaagtgatcgatataaggtccaaactgagagcatcgctgttctcgcggatctttgagtcagattaggatgtggtgagccgattcatattctttttgttagctagcttgattattagatcgtatcatatgttagtcgcggtgattttttggtcggcagctcagatgtgatgcgatgatggccttcggattccatgttgtgcttgtgtgttgtttaggcggcacttagagagctatttcttggtattttccctttgtagaatgttgtgatttcatgtatggtgaagtaggggttaaaggcaagcgatgcgtaaagtgtttgctaaaacgccttatctcgtataatgttatgttgtatgcatagacggaaagtagtcgtaattatgagatgaagtttgcataagggttgttctaatgactatgtaggcgagggggtggtgtgtaatagagttaaagttgtgttgggtgcttgttaaagtggctcatttcatgcggtaaccatgtatgtctttgattgggttatgtctatattgtgattatatttgagttttggcagactagcaagtgttgttgagataccttgtttcatgtatttacatggttatgctagtaagtataaaatagtcgagtcatgtgaaacttagatttaaaatgattgttgtgtgaggagtatttaaatgaatagattagagaagcatgagtgaatagatcttatgtttgtaagagtatagttcattagcaatgatgtttatgctattagtgttgtcctcttagtcctcttgcatttagcattaatgtactttagatcttttgattttaaaagtgtagttgatagaattatgcaatgtctagtactactctacttactaaatcagagaatgtgacttttcctacctagttaatacattgctatacttataagaggtatggttaatttagtaatgaaaagaatttgtttagcacttctagcactttgccggtaagaattattagggttgcttgtgtgaatttctattgcatagtgacattgatgccttgccttagaaagtatcaccttctatgttatttgctcaagttaataaatcatggagggtggagatttgctcatggttcattaaaggtttgtcatattaatttcatcatgtcatatcatttaagtgttctcccttgctaatatagagtttgtaaaggaaagtaatgcagatctatttttgcttgggttttatttagggagtggaagaatcaagtagatata

SEQ ID NO: 3919 - DNA, 2749 bp, Zea mays
  misc_feature (1)..(100): optimal_loci_278096_G1, chr8:74139224..74141972, Cluster 24
atatttccattagattcagagattccagaatgtaaccagttccgatgggattatatataggatcgaacgaaactcaagacggatgtcattaagggtgactaaccttctttctcgcttgcaggcattgaggcatgtgcttgctgaagttgatttggaccggtttgaccacgttgagcgcatgccagaccctatgccaaagccagcttgctaattgtgttgctctctctcaccacagtctagaccatgactttgtagtttgcaagcatctgttcatcacatgtttgactagtaaccgaaaatgtcaacaacggctgctgaggccaagatattgctctggctccgccttatctacaggcaggtgttatttactgtgttttacacctatccagctcaatttgctacctggagcttgaattgcccaaactaatagaaaatggtgaaaagatcacatgttaatacctacctaatgtattgatctcatctgcagaatcaggtgaattgctgagatgatttctcccaacaaaaaatcagtttagatacatgacacagaatgcactgaccttggacttttgcacagttgttgaactttagcccatcatggtgctactgaatgatcagtcctgtcagttctgatagttttgtcttttcatctacacttctgacaggtcttattaatagcccaagatgctgaaagcgctgaactattcaaagaatcaaagagctgtttggtgtgcttccgtgtctaaacccaatactgcgatatttcagagctgtttgcctttgctgccctccctgttccagcatttgtggtgtcaggttcctttccaccagtttaatccagacttgcttcctaagggacggacctaagagactgacaacgataattcagacctaattaactattcaactgacacaatgacgccagggaaattgcagtttgctacaacaatacgagacccgtttgtctcaacttgagacccgtttgtctcaacttgaattgtaacagatggtatgctgcataccacaataagctaagacaaagaaacatatatatatataaccttaaacgtgtgtaccaaaccatatagagcagacccacgtgattgcaagcactgggaacatcattgtactccaaaggaaaacatcctaaagagccgtgacaagtcgaaacacttgtattaattcgaaaacagaatgatcgtcacacaggaaagaacgcagtggaaagattttttgctagatatctttttgaaagaaaaaagaacacaatcatcatcactagcaacagagaaagtgtggactcgaagacctctgtatagatatgttctcaagaatttgtcgggaaaagatgagatattcccagtagtaaataaagagcaaagagctaagatcgcatcagctcgtatcagatagttgccaccaatccttgtggctccaagttcctaagcaacgtgcaggctaaataaaaccaaatcaagctcaaagttccaagcttcaaatatatttttagtacctgctgatctcacccttcccagccttaaactactactctatctgacaactacggataagataacactagcccatgcatctttgcttaaacaagtcctaatctctatgagaaaagataataatcttctaactggattcaagagggttcgggaagggggagcggaattaaagaatacatacccgtgggcaagaatcatgtagagctgagctgcataggcaactaaccacccaaccaacaagattaaacaactaataatcaacagatcaatacaaagcattcgggtactaggcttttgctatttgtatttaacaaatctgtaagaccaaattgtgggaccctggggaccattttcttacatgagcatctatactaaggccttaaagggcttgcatcacccagaaaaggctctcgtgctacagtgccagaccatgtggttgaaccccagccaaaaaaacagcagatttgttaattggaacgagtgatgcactggactcacatacagtgctaacggatttgtgatcctagttggctcagctggtatcaactactcaaccgtgtttatttgtccggaggatagatatattgtcttaaacaggggatcatgttcatgtatgacgcgtgtcagaacggaatatggctggcaggttctggagaactttgtgtccatactggggcagctttcaacaggtcatgtccacatttggcctccactgatgtgcaaaatgttcacataacagatgctggacgacggactgtctcgcctacaggattgcaacacgagccctcccaaagtgcttgctttgtgttgtggacaggaggagatcacacatcaccttctcacgtcgtgcgtgagtgttcgcctggagaacttggcgctgaggcattattccgtgttccacaagtgctggcatagaaactcaagcgtgtaaatgtgtcaactacatggtgatcctaaccacctggatggtttggaatcatacaaattgttgcgtctttgatgagtgcagatggtcgggtagtgttgcaggacatcaacgagcagacagtctttcgggtgatggccgacgttaatgtaaacaccaaactgggatttctaagataatgattattcatgaaataatgttagtgtgttattatagaggcatgatctttcttttaaataaagatgggatccttaattattgtatatttcactctatactaagtttatgtgtgatgaagcattctaccagttgg

SEQ ID NO: 3920 - DNA, 1964 bp, Zea mays
  misc_feature (1)..(100): optimal_loci_281185_G1, chr8:94303349..94305312, Cluster 24
gtgaatgccaaaactagttttatctatattctgggatggaaagagtatttcgttaattttagagataggttcttaaaggtaaagtcatctcatctatatatagatttttggattaagggatatttattccattgataaaatgaaaaaactcagtttctgcttaacagcattcaaccaaagagatcagtaaagccacagactgtcatgcaagacagtgagcaaaggtactgaaatttagacatcgcacttagatctattgaacttaagaccctatcctattgctaaacttccacccattccttgcaaaaatctctattaaacaagtctccaacttcagacacagatccttgatcctctgttactcctcttttcccaataaattgctccaaaatctgaaccagaaggtgctcctgaacaaaacctgcataggggatgaaataaaagcattgttgaagatatgtagatggggatgtgtctgtttcggttgtaagcaagaaatagatcaaaagtcccattcccttttctatccatacccttgtggcatggccattgggcatcagcatggtccttcttacctgggttcagggccatatgaagcgtgtccatgacagaagagtacatgaattatgtttgataacactcaacggaactgcaaatgttttgaatatttttctacctgtaggtagggtgcattcatgcaggagtcactcttccgcgccttagaaacttatttggttattttcaggtatgtgcttggggctgtagaaacctttcttgacgctgttccttctgctggacttttccaaagtaagttacaaatggtttggatcaatatatttagtttgtgaatagaattttcatcttgttatgtatttcaagtgtggttcatgtgctttagtactttggagtttggacatatggagcatctattcacacaattgcagtttatgagataataatcatgtaacatgttatttaatattcccttatcacaaaatataaggcagacatgcaatttcagtgatgagtatgcatttggcgccgtgcttatccacaccatatggattgaattctgaaaatctgctcaaacagacactatcagcagcagacggctagacagtccagtaaaaaaataaaatatgtacttgtataacttatctgttcttaaaaatgtggtctctgttcttaaaaatggtgtgttctctgtactttaatgaagtagagatgaaatataaagataaagatgtttggatcgcgggttagattagaaagaagtataaggacttttttttcgcaaaagggatgacggtggaaattgtcacgaacctggattgacggatacacctctgtccctagggactgtagtgtgtgtatatatataaatatatgctttataagagtagagaagagatatgcaaccagttctatctgttgtaattttttttattatgccaccgttaacctgtctttcgataaagttgctgggggcaaccacatgcaatggctgagatagagagggtgctagcccccttgggtgccacaccgttttcgtttcatttatcctttctcttatttagccccttctacattttctctcatagcatatgtattggatattcatacaatattctttgttcttcttaagacgttagcacaagggtgtaatgttcatttcctggtgcctgtattcctttatgttataagcaccttaattgttgtatagacatgatgtgccttgtggaagaaatgaaggggttacctgaaaagacataacaaaatgcatgcatattatcatatgatttagcaccattttttttctgttaggtgcatgcatgaaagcaaatatattggtggttgccttgcccacctgtcatggcagtcacaaaagagcctatttcgtagcttgaccaaacccttctccgactgatgacatgcaacaatgagcaaagttagctagttagttt

SEQ ID NO: 3921 - DNA, 1921 bp, Zea mays
  misc_feature (1)..(100): optimal_loci_28538_G1, chr1:174371305..174373225, Cluster 24
aatggccacaaaatgggtgaataagctgtacaggctctgctttctcaccccacaaatatctaagtacataggcaaaatctggcagttgcactgttatttcctataccccaatcccttcccttatgaacatttgtcagtttgatgtactttgaaaaaataaggcttgaatgccaacaaacactcaacacaagagttcaccattgtgcaaaaaagataaccatggaaggaaaaaacttttaccagccttcaatcttaccagtccaattgcccacacctcgtgggaagggaagaatcgaattacagtaatgattttcaatctggttttttcaaggtccttaatttctttccagatcaattacaatttagccatgtcagcagcattagaggtgattttcgatctggttttttcaaggtccttaatttctttcactagatgcttctcatcagataaaggtatgctttcaggtaccatgcaatcattcaacatcttaatctaggggagcaatggaagaaaaacatatagttaactgtttcaagaatggaagctctcttagcaaaaaggttcaggacatatccttaggtcaagctcctcgatagaagatcataaacctacactctatgccctcatggcatcgttttcatcacaaaaccttcccagactattctgaagaggctccatttcttttatcttctcattcacaacttcattatattgtttgttctcagcactcaattgcttcagctccacgataatactggacaacagatgttgctaatgaagtgactaacaattttatacaaggatattttagttaacaaaacttgtgatgtgtgcttttgctgctacttcaatagatacaatactcagattgatttggcatgaagttgtagacttaatagacaaaattctactttggatgtgggttcacctaaaaagcatcctcctcttgaagggtccttgatctacaaacaacggattatagtttactactcacccataaattagaaattagttacctagtaatttgttggctaattgagtaaccatcagtgatggtagtcaacaatcaggccacaggagacgacaaagccacgatttggaacaaataaataaaataaaagatatccaccttagaaaataaataagttaagaacaaaagaacacaattatagtatataaattactaatgtatcaacaatttcatctgtctcagtctcctaggtatgagtggcacaacgaaatgatacatgaatggtataccagtgtgcttagacttaattggacacattaacgttttaaaaaatgaaaaacaaagaatcagcatgttctaacactaaatcatacatttctatgttgctaccacattagagaaaagaacatattgattcggcgtggctttaagtgcagatcaaacaaaggcatgctttgtagttgtccgcacaagcagttttcctcatagttttgatcaagcacattatatatgcatgcaagtttggttcagcaataacaaccaaaaccctcactgtcctggaggatgcaagtatgtctcaattttcacaaaaaaaatctaacaaatctggacaccaaacatgaaaaccggaaggaaaaaaaatcaaacctccaatcacttgatttcaactactgtaacaagtaaaaataaaccagtatttcagatcaatgatcacatttccccccaatcaatacatcaaccttttactatttggaactggacaagaggagttgaacaattggaaagtaaataatgtaattttcatagaaatcataggccattgatctgcatcacatgtggctgtaacacatttacaaggagacaaatcatgagcccaaccccgagagtgtggtgggaaagtaaaattgtaattttcacacataccataggccatcgacctttatcctaac

SEQ ID NO: 3922 - DNA, 1961 bp, Zea mays
  misc_feature (1)..(100): optimal_loci_286771_G1, chr8:124289789..124291749, Cluster 24
atcccacgagcctgaccaagccatatacaacaaaccaaccacacacttattaagatttactcatgtgtctctcacttattgtctaaagagctaggccatattggtagaactccaagtctttggaatgagattcgacatagagcagcttcaacttaaatctaggatcctactattgttgagaaaagtgtatggtagagcttttattgtggatatgatagaacagtctactaagcatccaattatagtataagagaagctaactacatactatcaatgggcgttcctcgtcctcttttgtctccctgcgtccccattgtgtccttatatataacagatatgtaattgttctctcgatttaaaagaaacgtttttcctatgtaaattgttttgagacataaaaatatatgtgtttcaagctgtatattactataattttaataaaattgtctggcctaattcggacatttggtgggggctaacattgacttgctcccatgcaaatactactgaacaaattttaaaggcactttgtttcttcacatatatttgtaattttagtcattatctctgataatgaactaccccatacaatatatttcaatggtggttggtaatactgtcatgatttagaagttgtacttatgactttgttttagcctttagcaaatgatttctaagggtaggtcatgttactaactatccctacaaacggatttataggagatgtttgtaatgtcaacctccataataaacacctcatttatagagatggttgaaaagaccaaccctagaaattctttcaccgttatataaaaaatgctcatatatgtgtggttgcttatgttatcatgtatctagaactatggagtatgtttttcttgtgttctaatggggaatcctatgtaatctttcacattggtcgaagtagagtgcacattggctagtaagtcgggtttggttctaaccatagttcaaaataagaacctcctactcttgatttgagggccatattttataaatgacaatatattaggtgcaacctgatctattgatgtaactggaactcgtgcaaccaagacttaagttgtaagcatggaggtggcaggggctgttttgaaaaagaatatttttaaaaagttcatccttcctttatattcgtgtcttgattgcacggttgcgtctaatatgttacctttataaacagagatagattcgatatatatgtaatgatgtcaatgatattgtagcaatctcaagtagaatttgtgaaaatcaacagataacacttattataagtacttcgatttttatatttgatgtttgttagtacaaatttgaactgaccgatgtcaaaagaagaagaatggagtaggttgaatttcaagccgtgggtttctcaaggtgctggtgcctctcgacctcgcagtcgcaaagatgaaaataaacccaacaaaaacagaagctgtatccactagtacacgtttcaaggccaatccacctagggatcggagaccatacaaggctgaacatcacgtcaggtcacacaacccggtccaccggctgcccgtcaatattttatggctagcccgactccgatggctcccacgtgtcaaacctcgcgtcatccaacagcccgagagcgaacagcggcgggctcggccacgtggtggttacgtggtagcacgaggcgggcctgtgcgtgagcaccttccggtgaggtgaccccagcacgcacgacgtggcacagtcaccgacgtgtgaatctctccgtggacatctgacggtggtcctgctatgctctagagagagaagctgcatgctctctcaatatatatacacaactcaagtatcgatgttctcagctcgtgattcaccgtgatattctggtagatgacgggctctaagtgaaatgattttacattatttatccttacgtaaaaaaatgatgcggcgatgtgtca

SEQ ID NO: 3923 - DNA, 1996 bp, Zea mays
  misc_feature (1)..(100): optimal_loci_292223_G1, chr8:153703656..153705651, Cluster 24
ctgtgcagtgcatgccgatgtctctacaaccacacctaaacgtgttggcatgcccgtaagtatttttaaagtatatatagttacatcatttatcaactacatcgtactcaatggcatggactccagttcctaccactatgataggaagtttttgtcgttgtagcgttacatgttcgacgttataaaatgatcgaggcatggactccagttcctaccactatgaccagggctccacgactacgacaagttaggtgtagctggacctatattgggtagggcctattaactagcaaacatgtaactctctgcccccttgtgctataaaaaggagaagagtaacgtagataagggatttccgattgggttcaaaccgagcccatttgagaagtgtctccgactccattaggccaggatcaatgagtgtgaaccagaggccagtaggtctagaactctcaccataactaaaataaaagggagagctagtcggtcattgggctcagttgataattagacatgtaatcttctttctcctcagcattcatcaatccgtcatatatatagagaatgttggatgttacacatccatggtccaaacctattcagatcttccatgtaccggtagccataaaagtatcccgaccaacgagcctacacccatcggtacctccttaaaagttttttatgcttttgctacctacggtaccctcgtgtctcattatgtgataataaccttctaatttctacacaataatattttctaataaccatctaaatcaacggtccacgattatttgaagtaccgcaataaaccccctatatgaacacaaataaaactctgttccggtttataattagtttaacttgtttacaccaagtttgaccagctcgtcttattcaattatattatatgctaaatgatatctccataaaaattaatagttcaattatattatatgctaaatgatatctccataaatattaatagttattatgattttttgaataagacgagccggtcaaacttgaggagaaaaaaaacccaacgaactataaattgggacaggagggtacaaagcacaaagctaaagtagtctcaaagcaggcagataaatattattgctgaaacggaatcatgaatctgggtagtaggtcagagcgaggagaacaccatcgtatctagactattagctagcttcgtaatgacgaaatagtgacacatctaggagcagagggattggcgaagatcgaattccgcagcagggcaccgaaccgaatcgccacgtccagctgctggggtcaccggtctggtggagttgaaggccagggccatcgccgtccccgtcacgtctaaaacagatacagactagtacgtagtaactactagcgaccaattggatgcacagaggttgacatcgttgacatattggcatgagcaagttggcagctaccttacctgcggttatgcttcacatccagagagaaaatttggtaccagacgtacgaacacgaaactcattagcacataatgaaacttgttccgcaaataaaatttgcaacaaagattttgtcgtcctttaaaaaatccatgcatatgatctgtgggctagattcaaatgttcatggctcctacatatcctgtatcaatcggtatcaagatctgtgcatgtggatcaagtatattaagtattctggttctagtacttccccattgcaaaaggccgaggtggttttgcgagatcccaaagtcagacgtagaatccgccatggtctgacgagaacccgcagtccgcgggggtggcacaggtattactttacgctgccagtggctacaagtacagaagaatcttagtctcgtagttgccctatcaaagagcttggatggatccaccctaaaatcttataagaaactgtatattttggttcgctgtctcacttgacacagtttaccaatattaggtaaatatgtgtttgatttatagccacaattgtgacaata

SEQ ID NO: 3924 - DNA, 2586 bp, Zea mays
  misc_feature (1)..(100): optimal_loci_293611_G1, chr8:161138936..161141521, Cluster 24
gcaatcatcgatcctatagttgttgacatgggcaagttgacgtgcttcaccatcagctgcataatctaattatatctctagacagtatatattagtctactttgttgattcgatttgtgtttgtgttgtaattcatctctctttgtaaaccgcgtgacaaccattgtagatgtcatgtgagaacttcctaacattgtacaactagacaagtccttgtatcataatgagaccctaccatcctaccgagatggcctcgacctccttgcgaccttaattatatctcacgacttcattaagtccttaatgttgtcgatgaaatgaatgaaaaggatatcatgcattgctagcttcttgatcttataatgtcatatcataaccttacaaacaattaaggcttcttgttaagatgatatggatgactatagtatcaaaaagtaggaatttacatgttgtcgtcatgctaatcacatgattttttgcatagaggtaggggatgccatacatgaaccatcgattgaatctggtaatgttttgccctaaattgtattggttcctttatggaaacaagttatatttttcaataggtgtgccatttgattggcggactcaatgtgtaactctagtgcaagtatcatgtttgccatgcaaccactcatcatgtttgttattttttgtagttggtataacacaatattccaatcaaacacattgttgacaaccttaacttgggtagaatatagggggacatagattaaaataatgaatactgtctatttttccttcaaaatatggtttctggagaggtaaacatgaacattcattttcttttcagcccatgcattacaagtgaatggtatgtgtttctatagatactcattcctccttatgttatcttaagtagagtgttgtgtgagggatataataaattgtaccttgattgagtggcttaagcataataagatccttaccttgcctccttaatgagatgacttgttccttaaggcatcattgttgcaagtgatgtttcacatcattccaccatctattttgcacctgcattgactcactgatgatattcttactttttaagtcaatcattattgcatatctagcatgtcagttgtcatcttctcattagtgtatatctgacatgcttgtacccttcacctagcacccatgtattgctccttgtgtcatgataaggtgggtgttgtgttgggaacttgggattggggtacaccataattatgtttgacaccaaccatgtacaagacacttaacttgtcttagaatttcaaggcacgcaagaaacattgaaccaaacaatgggatgggggcttaggcccatcatcctagcctcacatgtaacatttagggatggatggagaacataaataagaaaagatagatgacgaaggaaaagaggagaaaaagcaaggataaaaagagtggtgaaaatgagttgccctatataccttcaccacttgtattgaagtcgattaagtttacgggcttgtggaggaggcacaaatatgagcaacctgagagatctagggtcctcccaactgtactaatatatatacccaaaacaaaatactaacaaagaggcacttgtaattatatataacatggtttaattaatgaggggaaatatatcaagtggaccgagctccaaccctagtcaagaaaaaccatgttatatagttggtttttcataattagttggtacaaaatctctgggagactaatctagacaatcacttgggactccatgacatgttttttctagttaaataatctagtcaatcactatatggcaactatataaataattagagaaaaataatctagaaatcactttgggagtccatgaatccatgtgagaatgtagaaaaaattaaccgatagtacattttttatctttgagtgatatagttggttttatagaatctttgtcatacaacgttatgtcatatattgtattaactcaaaaccacttcataataactatgccataaaatatggatttgccaaccaagttacaagctttctttgcctttttgtatgagtttaatgtcaatagaatttgggaaagcacacaacattcttcatacagatggtgagacacttctgttcaccattttcatggtgccatttacatattcatgggctacccccatcataatatgtaggaccatgtatgttcccatcacaatactatatcatgtcatatatgatatttatctaaaaccgtttgaaaatattacatcatgtgcttttttataacactttcacttgttaatacttttgtttcatattttcattcttagtgcaactacttgtacctttaattcttgttggagcataatgtgcaccttagataattagtcatttcattgataccatctcgattaatcgattaatgtcaatatttatgttacaaatgcattgtggttgtggtggttcatctgatgaagtatgtttgttagcataggtaactttacacttgatgtgtttgcacttgctatagttggtcatggttgtccattttgcgtgcatcacgcttgttgtgggtgttaccgctcc

SEQ ID NO: 3925 - DNA, 1778 bp, Zea mays
  misc_feature (1)..(100): optimal_loci_293957_G1, chr8:162582104..162583881, Cluster 24
tgggccgggccccaacgacacgcatggctatttctcggccattctgctggttcagcccacaaactaggtgacatgacatatgggtatttttatttagagcggcagtgctccttgacagatgtctagaatttttatataggccgttcaactctattatataagttttgaacacataagcaatgcgttacaaattgatcacatatacatcgtttttagaacgtgtcaagagaccatcatttctcttgtgattaagggatctgtttcctgtagaccccaattaggtgaaggaatttgttaattgaaaaaaggcaggtatcattggtgtgcagatctgtgcttgataatcccaaatcaaataaactatgcacaaggcgagatacacattatctcatctcctttagcgttcactgcttcgctttacacgtgtagcactaatccatcactattagtgcttcctgctgctagctagtttccctttggcaaagtccaagcaaagaggatcatatctgatccgaaaggaacggaaaaggaccgagcagtttgctcctgggagacagtatcatgaaaagttgaaaacaatttcgactttttctttatacatacaaaaacatgtaatttctcccccgccccaaaccgtaacattactttaagttctactagaaaactagcgcgcaaccttactgaaaggattactaacagcgcggcggtgataaactgaaaaccatacttaagcttgtccagcaaattaaaggacttagaacaaaggattatttctgaatcctgcatctgcgttttttgaactaattcctattaaattcttataccatcactatgaaattcctgcgtttcaaaagatgcctaaatttttagtgtccagaaaccgccccatattgattatgaatcaaagaactaagagcatgtacaaccttatttattatagtcttttgaggagtctctaggttctaggagattagttgaaaaaaatacaagagacggactcttcgtgaagagcacgtctatacactattctctatacaatttatctcttaactgcatttatgattcagaggctcggagttgaatcatgtaatttcttaactgtattttatacttggaaaacaaaaccatagtctcagggtttttcatgtcctaagccatattgtccagccattggctgtcaaatcatccagaaaatgagactccattaagctgcactttctatcaaacaccttatgagcggtgcccatggttccatcaatccacaagtgttaatgaacacaataaactgggaaatgtaaggacatgagagatcaacatacatggaggagcatacatttatcaaaagtttgtgtagcatgcaatttcttatacactgtcactgtcttccgtgtcatcgcaaatgtcttaatctattccgtgtcacccggatataattttttatccttgtatggcatcgctagtagcatagaagggtaagaaattgtatgtcttaatcccttctgcaccactgaggatgacatgcaagggtaagaaattatatccaagtgacataaaagagattaagacgtttatgacgacaaatataaggtactaagtaaaattacagtgacatataagaatttgcccttggaataatattttgcgtcaaacttttatactgaatagaacttagtaatatttagttgtatttaatattctactagttagttgcttgtgcattgttccagtatatatatatatatatatatttggtgcatgataaatatacttatttttat

SEQ ID NO: 3926 - DNA, 1684 bp, Zea mays
  misc_feature (1)..(100): optimal_loci_295303_G1, chr8:168919279..168920962, Cluster 24
aagactaaatagacaaggtgctataatacgagaagaattgcattaactaggagctttttctagatgttttactagcgagaatattttctagatggtcaagttaaggagtggctttgaatggatttctcctcagaagtgagggtgaagcgcgcgaagcaattggaggtgtctccaattgctgttgtgagcaataatctattcagattggccaattcccgttgcattttgggtgggcaaaatgtgagaagagggagagggattaatcagattatggccgccatggttggtagcagtgagcttttaggcttggcgcggacaccagcgtgagaagggaatggaagttttgggccgagtaaacaaaaggcccagccagaaggcacaattcgggcgcaacattgtggaccttttctcgtcctcgtcctcccctgctacggtgctaccccaatcatctcactggcttcgggttctggccgctaggtttgggacccgacgaggatggacgagatccggcagtttggagatcgaggctaagacgaccgacgactggtcttctgtggaggtgctaaagacaagaagatgtatagccgtgatgctcgggatggcagatgggatgctggtcctacagatgaaagagatggtagaaggtagagggaaccttcagagaagaccaagagatgaatgcctttaccgcgaacactgagaaggtccagatcagaataccagggcgcagtatagaggttgggatcaaagggatgctcatggaaagatgcgtcagggagatgagtgggatgtgaggcagatggcagagatgatctttatttgttgcaaactggatgatcatcgacaaggatcctaaataccagcaaagatgggaactcgtttagcttgatcaggtattctctctggccaacgtgctatatttcaattgcaatttgcaacagaacaggacatcagaaaataaactgtttcaaccatctgttttgctataacggtaagcaaaccagttgaaagcgtctaggggcatattgtgatgattgaactcaaacacgaacagagaaaaacaaactacattggatagtaattctctagtttgtaaaatgtatatgttggatgtatttataggagtcctcatttttgtaattcactagttaataagtgtatgtaggttgctactgtatatatcacatcataggtagaccatgtttgaatgggattgttgtttaaatatgttccaaacctttacaaaaatttgtgctctattcaaattggtcaaacttgcaagctacaacattgatctccacgagacataagggctaaatcttttgttagcctaggaacattcaagcagctgaaaagggcttttcagaaagaactccaatactctttgtgcacaatatgaggtagaccatgtttaaggaagctttcttccttaagtttgttcacaatatgaggtgaaatcttttcatctaacttctttgctattgatgttagcctatgtcacctttatatctagtggcgattgaatagctgcctcaaaatcctatgtttctacaagcgcatgcacagatacagccaacacaactgctaccaaagatttgatctgactacctgtaaaaaaattcacggttatgattgtcgatctttatagggtgtggtagaaaatagatgtatcttaaaagttctt

SEQ ID NO: 3927 - DNA, 1887 bp, Zea mays
  misc_feature (1)..(100): optimal_loci_295706_G1, chr8:170786084..170787970, Cluster 24
tatgagaggttatttgtaaaagtataacgtggaacgaccgttgaaaccgatgatttaatatagtagagatagagatgaaataatttaggtgcagttgtatggtaacctagtttattggaactttgattattaattttagccatatgttaggtggtgggagcaaggacaaatatttttttaaggagtgatagtgatcgataacttcttctaaaattgccatgagtagtgggtagtctaataatttgtatgtttgtttaatatccaaattgtttaagctggattatataatatagacagattataaggtaaaacaatgtgcccctcttaaaaagtatacatgacctttgtttttaggttgtattcaatctatatcattgtttgctattatttattggaaatattaatgttttatagatatgactacggatttgctgataactatttgtagttgacataaacgaaagcccgaaccactttttgagacatctgaggaagactaatttcagaataggaaaatacatccaaggaaaacgtgactctagtcttgacatgacatcatttaaggcacaaccgcacaactgatgaacatcaacataatgtttgaatacggagacttcaaagttggtgcgatatctctcacacccaacacatacggccaaagaggttccatttatagttaccgggaaaaaaatatagagatatcttcgataagccaacaaagaagatgtttgacggaatcataacctacttctacttctggtggcatatatggaagaagaacattccagcaaaaaccagtcgaccgaaagaagttgcaatgatgactgttgcaagctgtttgtgaaatgatgactgttgcaagctgtttgtgaaatgatgactgttgcaagatgtctctccacgaagcgcataatccttcactgcaaggatttcagaaaaaaaaaagtaattttatgggtcacatggacaagggagtccttggttttacaatgaaacgaacataacattgttgaccactttttgactcttctttctgccagctactacgcgtcaattgataatgtcattatacttctgaaattatgtgcttacagaagagtaccgattcagacagttctctgaaagtttttttttttttgtgaaatgattactgttgcaagctgtttgatgaaatcattcctgtaatgctcttgtatcatactatactcactcctttacaggtttatgagatgactggaactggatgtttcaaatgttacagtatgttaaataacacgcaaaaggttgagtggagcagtagttaaggtatgtgtggacacaaccttgtagatacgtttgcctttcttatatttttcttggctttagctttgttctttttttgttgttgagaaaatggctttagctttgtttaatctgattatacgatgccacatatcggtaggggtttctctacactccatggtgcattggtagctgctgccgtttctttctacttggccatgacctctttgtagcttttacggagctttccgactgtagcagcgtggctcctgcaactgatgcgaaaaaaaaaatgcgagatcttgtgatacgctgctacggtgcttctgcagcagcaatagaatggagttcttgttttttttttcaaaaaaaaacaaacctttgttgcactcatgaaaaaacagtcgtataatttatagctttgtatttagcctcctttcttgcatcctgtctagatgcgctactggttgggctgttcgtcgcgacattaacgtgcatctgcctcgtctgttgggcgctttgggggtagatgggcagtacgccagtaccagcctaccaggtccatctgcctcgtctgttgggcgcgtcgcatcaggttgctttgtt

SEQ ID NO: 3928 - DNA, 1434 bp, Zea mays
  misc_feature (1)..(100): optimal_loci_295803_G1, chr8:171271731..171273164, Cluster 24
aaccagccaaccaggcttcggggtaccatcggtttcacgtgccagtttggttgagaccagtgattggccataaaacgaggaaagggaagttatacggcgtgggtatccacaacgagacaatgtctattcaaagtagtgggtgggcctcttacaacgagacacggtctattttttagaaagtgatgctacgtgaattataagaaattttaataaccgttttttatgaagggtggaccatatatctattctgaatgagtaaagaaagatgtatgtattcattgagtttgctcaaatctatgaatatcattgaagctatgataataactatttcaggatttcacttgtcatccacttatgttcttcacagtagctaagctagagaaaaatctgagagggtaaacctacattttagatgcttagatttagggtctgtttaaatcttatgtgctaagctttagcatagtgctaaattttagcactctctaatggagagcataagtttaaaattagtagtgtttggatggcagggctaaagtttagcatatggatatataaagacatattcacatatatacctctaattaatgtgaggcagggagagagagtggagtaagggcttgtttgtttatatagtgttaaagtttagcacctgctaatttttttgctaaactttagcacttgtggctgtttggatacaagtgctaaactttagactttagcatattaattgcagccacattaaatgtccgagagcatgaggaggggagagagaaaaagtgacagttgtgagtgggagagaaaggggctgggatcacttttagtttattttaacacctttggaggaactaatgtgttaatgggtattaaactttagcacaaaatttttagccaccatgtttgtttctttagtagataaactttagcaaaaagtgcactgttaacctttaacaagggtaggagatgtcttttttcactctggaccacttttagctcactttagcacccttataggagctaaactgctaatgagtgctaaagtttagcacttacattttacacaccttttaacacttttctttggatctccaagtgctaaagttctaaaagtgtagtgttaaattttagcatcatgaattcaaacagacccctgatgcatggtgaaaatctgatctatttaataacattctattttaggtgtattccatggtgtgctggttgttttaggtgtcgctcctagagaactatcgagttcggcgtgtattctaaggaatgatttttacaaaactgtgttcttattttagttgttgctttgatattatactttttgattgttacatcatgtccttgagcagttacatccacacgcggagtacctccttccaacctctatgttttcaatattgcttaatacaaagctttgggtaggagtggtta

SEQ ID NO: 3929 - DNA, 2113 bp, Zea mays
  misc_feature (1)..(100): optimal_loci_296141_G1, chr8:173322761..173324873, Cluster 24
atggacgactctccaaaattcctgtcacactcgcttaggccctcttggcctctttggtaaggctgcttcaataactcctccaacgatttcttgaaaaaatatatcaaagaataggctatttgatggtatctttctagaaaagatgaataagctcctccaaaaaaccagcaggagatgagagccagaaaaaagagttttaccggctcctcttccttgtttttctcttcgtcgacgctacatcgtaggagaagttgtaaaaaaattatatttccaaccaaatgggatgctctttcataagctttttctgaaaataaggatgaacctattttcttagaggagctagagctatgactgaaagtgacagagaaatagccctaccaaacggggccttattatattaggactctccatattatagtcagtgcttggtgttgaacgcatttagattccagttttgatcttaggatttgataaacacaggtttatatgactaacatgtgttctacaatattcattatatgtatattggttgctcgcttgcagaccacacatggtttttttatcactcgctaatagtttagattagtaacgaatatggtgcaaagggcattcaatagccaagatttttctttagagtgtgtttgattagaagaggggttgaagaggattagagaggattaaattcctttttagtctaaattaaatggaaaggggtttaatcaccttaatcaacttcgatctctatacgaccgaacaaggccttaggatgaccaactcgatatataactatagttgtaatgtcaataaataaaatatatgtatatatagaatatataacagtcgtttgtcataataattaacacatgtatgcactaagtacacgataaattttaacttattataaactaaattttttattttagccatagatatataaattatttttttctttttagtggggacacggtccctgcttgccccctgtctatggcagtgggcattcacacagaccaaaaaaaatatagagatgagtgcaagcttagtgctcagatgtgcttgatgtagtgtatggggctttggtttcatttatctatattattagaaagggatggaggtctcagacatggaacttaatgagactagtgttgaaatcatttggatattcatggtatcgtcaagtcatagcttaagtgatatcattggataggtttttgagtcaaggatctcaaacatgttatgtgcgtcattcgatggtgcataactcactttcgaacttggttctagtatggagtagccaccatattatcgggtgcgacttcgtaatgccagacatatcatctagttaggatgccaccccacctatgttcaccgtacaatcatgtggtgactttgtgataccagacaaataggggtgaaaacagaaagaaacgaatagaaagtactctcttctatttccatattgcaaaggcatatcgtcaatgtgatatatggtcatccaaaaatagataaatacaacaaaatagactataaatgaaaaatgttaggccaaaaatagataccatatggcagcccaattacataacatacgacaaactaaatatttatacaaataataaaccctcatgccgtgacatgacatacataaacacaatcaaaattgaataacatgcacattacaagtcacaatgatagacataagccaaacttaataagtacgactcacaagtcacaagctcacatcatcatacacataagccaaactaaaaaaatcaaagatatagtacacatgataactactcataagtcacatatgagagacttacagtagtacaatgcatacatcacaatacaatattagaccatataagtctatcattccacaaataagtacataatacttcaaataatagacgaaacacacaagaccatgtgtgaacaacaagtccaccaacaacacatgtgaataaaaactctatgtgttaaaagcttctcccaggtcaccattttcattcattacatatggatcactttccacttcttcacgtttttagcacatgtggttatttataatcagttgcaaacgtaaacctatgttattattttaggttgttga

SEQ ID NO: 3930 - DNA, 1839 bp, Zea mays
  misc_feature (1)..(100): optimal_loci_296234_G1, chr8:173698663..173700501, Cluster 24
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(139): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
atacgaattcaagctgatcataagacgaccccccccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatcttatggagcctctatgcaaataactactctaagtccttaggacatgaagtcagaaaatatttgctagacacatagacatacttgcgaagattaaccattcacaaggactggtaaaaggagatgaacaatgaccatattaccctcatgtaacaaactactctaatataatatttatgggtagaaaagtatttacacatgaattataaagatgcccccctataaatatcgcccaatatgtacaaatttttattcaatacaattcattctctccatttgttatgttcgtactttctctcctcaactctgggatgctcctaacaatatgactcttagacatttcctttgtcgtttaaggccccctaccccctagatctcaaaggtccttggcgttcaataattcaaatcgttaggccctaggtttcctaaagagacaaaatgactcatacaatgactaagtatgaaggtacccacaagtcaacaaaacacatctagcctccactagaggcatgataaccctaaaaggtacgataccacatttgagatctacccatgatggtctcatgtcgatacaaataagtattttgtatatcatattaaatatgatgtgagacgttatggaaagatagatgcactattgtcaagacttaggctacagacgtgctcaagataactattcaatatgtgcattgaccctatagccatgtgtgggcatgataatgtactagaaagtattataaagtacatattgctctatgaagaagaatggctagttttggggcaaactagtaaagaaaacgtcgaagctcttgtctgtgagggaccccattagggtaatggcattgccatgttgcccttggtcggccaacaaacctaagtgccatctttggtcatcagatcaaggagtgaacatctacatgaggtttcaatggacaaaagagaggtattatattttttttatttgattagttgttggatgcctcaatcatttgcaattctcttatttatattgagggggtgatcttatctccatatgaaagaaatctagatccaaatcttcaagtttcacatgacaaaagtttagaaattaattagtttagactataatataaaaagtcgacttgaacaattttcaccgagccaaatagccacataacatgtatatcactgtcatcttagtcgattttgtagtgggtccacagctgaaaatattttaaaacttatctagactccaacaagagaattcatatatgtttctttgccaactcgacgagaggagcacaatgattcaatctattattttatttgagcaagttaaaaaaattcggtctatctagtttcggaaaccggtcgatttcactggttagctctctaaaagttgttttctttgtttggacctcaaataacataacataaatatattttatgtatgtcttgacgatggaaacatgatggcaaagtctactatatgtgttaaccaattttggtttctagcagaattcgaagtatgtatatgtctactactatagagcacaagtttctattgtttccaccatcgtcatgtgtcacgtgcgaagcgcttaggtctgtttctctccctcgcatctcacgtctagcctaacaacacacccacacatcgactatgcccagtcaacctcgcctcctttctacctactgttcccccaatcacatgccac

SEQ ID NO: 3931 - DNA, 2240 bp, Zea mays
  misc_feature (1)..(100): optimal_loci_296850_G1, chr9:961244..963483, Cluster 24
ccaatagttcacatgccttgcggtagcaggtgttgcattatgtcgtgtaactacactagtttcgatttggttatccatttgcttgtattcacttgacattctacatccatatatctggtttcgattgcagtggctttacctttactagcggtgctctactgcttcctgaagcaactagcagaaaatgatgataggagttctagtgacactgatagtctatggaatctctggtttatcacttcaggaatttttctacggctcactatcagactaaataggtatgtgaccgtgtattacaataggagttaaaaaatagtataaaacatatatatagaacaataagcatcactataatatgtaaaatctgtgtacaagtagtttatagcaaaatcatcaatcacttttgaccaaccaatagttgcagacttcttagcgctacaaaagcacaacacacaagtatttgatacggctgcatgacattaacaagccccaccatggttgatgaagtctagtgatatcaaaaagatttaagttcaagagttcctcccagcaaaattacaccatgatagttcacctgctcctttgaaaagttaacttcaataacgaacttggacctgaatacagtagcaaaattcataagttaggacacccatctaaataattagtgtcaatgaacaaacataacatacacatattaacacatagtagcaaaactacttactatgtaaatgaatcaattaccttgtgtagtacataaacacaagcttcaaaagcatacaaagtttagaaaaaatagacaagtgtataaatcagtcaaacaaggagtcgatctgatctacacaaggtaccaaaggaactaattcctacaacatgccacatatcttttaaggtgacaaggatgaattcttacgagaaatggatgcatgtgttactcactctttcagtacaggttgagctttgatgattcttctctaagcttcttccctctctattctccacctttcttccgtcggcttttgctgctcgaattcatgcctcaccaagctctctagttgaaagccttctggtctcgtacaatgcttcggttcagtcttaagcgacatctaaacaaggagtatgtttagacaggatgaaccaagatatggtgccaactaaaaacattcagagtaaaattttcacataccatcggatagtctgtggtgtatgggtaaggactagctttgtgaaccttggccttttcctcctccatcttttgtaagagatgtgcttctagttgcctctcttttaactggcctctttcctgaaacaagggatgcacaactattctgttgcatacgcatgatgagaaatgttgtggctcaaagaagaatcacatctcacggacctctgtttgtagactgaaagggtttggtatggtgcgtctaggcacatcttgcttgttgctgtttgaagaacattcagagtgaagagagagctagaaaataagaaaagagcttaataaggcattgaccaaaaaatagcctagtacaatctacgagcatccaacacacaatctccatgcttactatgatcactatgggttgcaagtacagttaccatacatatttacaagcagtttttccaaagagcagagaacagaaaatcattagtacaaacaccatgtacaaatgaggagcacccctaacatgatgttgatcaattctctgtgttaactccgtcagacattgtattctgattgagttctttttcaagctcctcgatgactggctccacaacagcaccaatctcatcatttaccttgtcaacctgtacgagtgaggagaagcatgaaccttcattccagtttaactttcacttcacatgttaacacaacatagtgaaatgtttcatgctcggtttatgttactgtcaaataatccaggaaatatcaccatgtgaaggtttcttaataaaatctgaataaatcacttttagatgccttgccagttgtagacacatgtttttctcagtttcctttacaaaaattgtcattaacttatgatgccaccaaaaagtcacttatgcaggtatgcaaacttaagtgttgtaaaatgtaaaacaattatgtgcacaacaataccagaattccagaaatattgcaaatggtaactgacctcagttcctcacaagaaacaactaaactaaccttcttcaaagcaaagccttttaagctagaaaggtccagcaactggattggggga

SEQ ID NO: 3932 - DNA, 2204 bp, Zea mays
  misc_feature (1)..(100): optimal_loci_29843_G1, chr1:182630340..182632543, Cluster 24
ttatctatattgctattagcatctacatcaaattcagtgacagctccataaaaaattgcagctattgtcttcctcaaatttacattcattaacactcatgatagtaaatcatattgaggctatagtaaaatattcgtacatgcgcgcgcgctggcgcacgcaagtgactagtatctacaattcgattccacaaacaaatataaagcaccacagcaaaagtaattgacttcaacaagtcaaccggaatgtgccggttggatttttcgaaggaaatctaacgtattttctataggagtcataaacacgcaccttgtgtgaaagctgacgtaccactaacaatatgcttaattatgcttgcctaatgctttgatacgtcccgttattctataaatgaataaactatttttttaacgaatctcggtacaaacactgacacactcacgtcaacacaacacatgtgtaaccacccttatcaacattcatcacgttacccataattaagcaaacaagctactaccggattattcaacactcccatcaacgaatacttttttttttcctaagaatctttctcttcgagcttcaccttggtcaagtgcttaacaacagagaaatttaaacctaattagcacaaaattccctccttgtcggaggcaaatactgctgagaattgaattagtttcaacctcaacaaagtgtctgtcggcaaaaaatgttgtacaatttaattgttttcctgtagttgtcatgcaatcaaactacaaaaagtcataaaagttatagatatactttattatttactctaccaacatatcaaatttcaagcttgaattcattgtatattaaaaggtattaaaaaaaatttctatccaatttggaggatgaatcaaaacttaaaattcgatatattggtaaaataaataatattgtttttatacattttcataatttattggtactttgattgcacggcaattacattaaaaaactcgatatttcacatatctctcataggatatcagtatggtaggataggatcaatcggatggaatcccacttagcaatgcgaatcaagaacttattcttgaagagagtaatataagatatataagagaattaaaggcacgtacctcgtgggtgattcctactgtgtgcacatgtgtgaaaagcgggcagaaagacgttaagattggcatgcaccgttcagttcgtcactgttactactattactttaatttgcctttaaaaaaatattctcccgtttatcatccagagctgtgtattgtttatcagcctttcatagacaacaatcgttgttgagaactttgttttgtgcggatgaaatcattagcataatttgttaggacgttcgctattatatatatatggcttgtggaggaaacgacactaattaaggtagattaagaccgaatcgatctattattacgtatcaatattcccatgctcccaaaccaaaagtcccaatgccaaacgttttttttattagaggcgcctctccttttttaagatggttttatcaagagccggctctacgtacaagtggtcacacgaatatatgaggccaacaaataattaaaatcccgcatgcagcttccgtactaattatattcaaccacacaacatgtgtgactaataagttataggtgctctcctttttaaattcaatgcatattaatgcacctacatgtgtcttagctaaaataagatataatgggatacgtacattagatgtgtttaaaacccatgtctaacaatacttattgcgccaatcaatatattcaataaaatcggatgcaccaaccaaccaactacgtcttctaccttcttatctgtcattttcgttttattttttatttttttaaaaaaactagtgcttctgccagtggcatcctccagtagcactatcgaagctctctgcagtgcacggatggatcagctctctcctgtcctaatgacagacacgtagcaggtagcaaccgagctatcgtagctttcaagcagacgtcgttctaaatagagacagttggggggggttatgttattacaattattccggatcggactctgcttgtttaacgatacgatcagtgagtgcggttagatagagacgagacgtcgctgctctcccttttgcgcttcttttcggctacaataacaaggcaacgtattatatacgtactgta

SEQ ID NO: 3933 - DNA, 1827 bp, Zea mays
  misc_feature (1)..(100): optimal_loci_299140_G1, chr9:9724868..9726694, Cluster 24
tgacgcttcgagaagcatatcaccatctgcttcgctcgatcggaccatgaacaatcatttgtatatgcctttgaagaggatgaccttgtggttgtttgtggaccattggtccttcaactgcttggggttggggtacattagggaggaggttttgtggagttataaatagtcgctattttgcccgaaaggtcggtccctttttgtcgtttccctcaacgaggtcaatgaagtgtaatagccacacatgaatataaaaaattatgaactaaaaatattgttggcctaaacattatgtccaattcataacaatatatatgtacttaccagtcttttatccttcgtcttagttcaatttcttcgccattggaactaggccgcatcagagtatgtggactggttggaggatgcatcgttgtgacttcttgggggtactatcatgcctgttggaggataaaaaggagcatgcacactatatgggggatcaccatatgggagagggaacgaaggaggagcaccatatggaggattgtatggaggagcaccatatatacgatctataaggaggagcaccatatggatacctatatgagtatagaggagggtaacaataagaaaaagattgagaaggagtgtcgatggtaggtggtaggagaaggagcatcgatcataggaggttcaatgtaggttgaggagcatcgatgaatagtcgatatagatacagaggaggacatgatatgtaagtataggttatagacttagggaatggagatgggaaggaacatcctcatttcgatgatgaacgtgagaaagaccatcgaagaaaacttgctttatactagtaggggtctcagaacattatggagattgctcgttgagcaagtcgatgaatgtatcaaagttcatattccacattggatccataataaaacataaagtggaaggttgcaggtagagaataaggcttgtgaattagagagtgacgggtgtgaatgcacccaaacacatccctatttatagggtgaatgagtattttttttaaattgttgaaatccaaatgtctaaagtggcaccaacatttcagaaaccaccatgtcaccacgagacggtcgatactgaccagacctagctagtaccgatctagactccaacatcgtggtcaataccaattagcatggtttcaacgccactggtactgactagtgacaggtccatcgatcgacagaccataacacctaccgataggaccacatgtgatcaatgataagggcccaagctgcacctaaccttacaaagtgggatgctgagggaaatgtggactactcaagtatcactgcaggggtgggataagttcatcgatatatggtggacgtcaaacatatgcaactcgatgtgtgtatgacatgccacatgtataagttcgacgactttactaagccatcaaagttaacttgaaataaatttcatagcctatgggccattaaaattatctagcgccatgtgtgcctaccacatcacccatataagtttgacgattttaagttgttgagattaatttgaaagaaattcgacgccctatgtagaccatcgaaagtaattttaatttgatggggccatcatacttatgggcttaatttcatcaagttaaatttgacgggaaaccatccaaattaacttaatatcatcgttttgcccttaatttaaatgggtttttggccatcgaattttaagcaatttctatagtgagtggagcatttattaataaagtacaccagatattgataatattgttgtaaaaaatcctactactaaaattctctagttgatgat

SEQ ID NO: 3934 - DNA, 2016 bp, Zea mays
  misc_feature (1)..(100): optimal_loci_301696_G1, chr9:23132131..23134146, Cluster 24
cttagagtccaaagggcactaccacgagctgctggacgcgacaactgtttgccatcacgcctgcccccacacatcccgtgaaatgcatatgcacattagggagccactgatgatagcctaatgtctccttcaaagttaacatataaaggaaaagatcttctaggcacaaatagatgtctccctcttctgtatgaaactatagttttcactttggtctttatcctaagataaacttttctaatttaaccattttctaaaaacaaatatatgaacactagttcaataatacaccattaaaagttagttgtgaatactttaataaaaaattgatgttgtaggtgttgatgtattttactataaattttatcaacaatgtttaagagttaagacaaagccaaaaagaaaccataatttagaattgataagatctttctacgttgtaggtattaaacatactcatgcttattatgcttacgttttctaagattttagtctatgtaacatgtcaatgaactagtagttatctaaataaatagataatgggcctccatcgtggaggacacaccaaaccaaaacaaatcgttgatgaattgaaccaccacgaaacaggggcgtagcagcaagatcttctgttagggcgctgtataagcaggctagaatgcattaggcccagaagtgctctagattaaaataaattaatacaacatttaaactatttaatgtctttgttattcatgtggatttttaaatagttaaggattactggatagtttctcttaatagagagggagcaccttcttgaggttgttccagtggtcacctcggagagggcccctcaagtttgccatatatgtatgacctctaacccagattgtcgacgatgagatcgtcgaagtgaagagtctatacatcatttttaggagcaggcacaatattcttgaaaactttaaatatagggtataagaaaactgctatgggagagatatttaaatgtataaacgtctgggatgatatctttatgagacaataggaatcgatcaaattagggaattattaatcttgtaaagaatacaacaaacacggatatcattctaacaccgtgccgccagcacaacgtatctaaaggtgatgccaaaggattgagaaccaaaatgattcgagacgatcccttgtggtgttagaggctgctggattagttgtatatatctgtcgatagtgaggatataagtcatttaattatattcggacatcaaatgatgagtactccactttttaaaaaaaatataagacatttaactttcttgaaaagccaactccaactcatcttaagtccgattattaaaattacagagagaattatagaaatttataacaccaaatagcagatttattactatgaaaaataagtaataatataataatacttatttgttattacaattattattactattttaatatgacatttagctgaatttaaggtctcgactcttcggaaaattagaatggcttataatttaggacggagggagcagttcgattgacaaccgcggatcagtttcagccctttgtccatcctgtcatataccaaactctccaagggatacaatcatcaagatgtattaactcttcaaatcaatcccctctttcttgttgcttcataagagtgaatccattttatgggcgaaagccgggggctttaaatccaccgatggattgcttcactcaataacatcattaacaaacaaaagaataaatagagggattccaaccatcagagcaaagattttctctttgttatttttacaaatagaaataggtatcaaatttctagattatggaacaaaaccgcattataacaataagaattccacgggccctttccgctctaattagataaaggggagtaaggacctgctaagttcctactttttcatgtttacaatctggatcctctaattactatagagatgaacccaatccagaatactaaccgtaaaagaaaacacctattaa

SEQ ID NO: 3935 - DNA, 2395 bp, Zea mays
  misc_feature (1)..(100): optimal_loci_30714_G1, chr1:188930491..188932885, Cluster 24
atgccttggcgttctcgactgcggctagcctaagttttcaaactaccctaaaaatataagtgctagtgagaaatgcacctagacagtttagtaagaatatttcttatagattctagcaaatcatggttaaataacatatatgtaatttatcaaaatcgcaatagaggaagagtcggaggagaaaatatatatcgatttaaactacaagatcttgccacaaaggttcaaaagagagatttatttgttaccataaggtcaacttgaaaaaggtgaggcccttcaccataaaataacacaatgacatagagaaaagtacagacactctcaaccacaactctttctctcaatacaagactctaagtaaagattcatgcatccgataggtacaagcttttcaggataatgttttgccttgatgcaagattgccaatgatgtcacctgctgcctaacaccatccgggttttgagacccaaacccaacaaagccgtatatcgatgattttgggttccaaaccacaaaacctagttggagaagcgtattcgctactactccatgatctcgacatgtgtcacaatcctcaaaccattctcaattatctaatcaccaagtcctcatgcactattcgacatgatcaagcaccatcttgatttggtcaacacggtctatgtcatcttctcatatacacttgttcgtcgatgttgccaagtgttattcatccataaccctcacgagtaccttagtacaagcctccccaactatcattcaccaaccctggttcactggcataaactcgtttgatcttatccaatatagtcaatcggctcaacccctgcacccatcattaagtcaaaatatatattgcataacaccatactcacaccatggttagtctcagcaatgaacccaaacttaataatcaccttgacaatcacttaccaaaataacacacatgaccacatctcaatcacgtgttcacaaaattattttagttcctagaaataatgatactgtgatttttctcctcaaactctctaaagccttaacccatttaaattaccaccatgttgtagttttgaagacaactttctctttttttatggaaaattggtaaatatatgacaatgtttttaaaccattcaaggtgtctctaccctcataaaaaattcaaaggaaccatataaataaggttatgaagaatccaagtaaaatatttagagtttgtgataatatatctagaatatttaggaaaatatatttagatcttggaaaacgagacaaaaacattcaaaaaatctataaaactaccaaaaaatggcgaggatgacgttattttggagtaacaattaattggctctttggcccatatggtattttttatgtaaacatcggaggagctaagaggcttcatttgaatatatttactatagatcccagcaacccttaaagggtccaacatggtgcgaagacagaggggagatagatgataaccaacatacaacaaagatcaactaacagactccacctaactcaaaggttgacatgaacttaggggctaaaaaatggctactagaatgtcggatatagagcaaagctcagagaaggatgaaagggtgatcattcaaatagagcaaggtcttgattaaaaaagaagaaagaaaaaacaaaaaaccaaagttgtgaagacaacaatatataaataggatttttttttgccagtcaagacgtaatagagtgtttgaccaaagttatgaaaactctaatgagcaatttcggtcatctggtgtcactagatatttggttgatctacgtgcattttgtatttagacctaagtgacacaagaaagagcaagtgaaaaatgtttatgaaagcaatttgaaaatggtaatttagacttacacgtttggaaaaaaaatgagaattgacacacttacaagtgaacgagttgtgcgctcagtgttattgtttaataggcaccgaacgtacactttgacgttcgttgtgcatcgaacacccctggaccggataggttcggcacaaccaggatgagcatgagaaaaatttcaagagcaacgagttcattttaaagctcgctagatatgtccagtgtggtatctgacgtcataccagactagacatccgaatagattatttttaggatcggaacgcgagagtgttgtgagtagcactggataaactactgtggcaatgactagtttcttataacattgaatatacactatatgtactcgtatttgtatatatttggttaaaggtaaaaatagatgaattcttgaaaaaggaaaaataactgttttaatttaaaaccaagcgattactatcaaacaatagtaatagtagtaagtctacactactttattaataacatactttat

SEQ ID NO: 3936 - DNA, 1620 bp, Zea mays
  misc_feature (1)..(100): optimal_loci_313155_G1, chr9:96769994..96771613, Cluster 24
aacctgatgccctaatcgaccttgctacacccccttgacaaggcaccaggtggcttaggtcaacccctaggtgacttaggccaaccaatagacttccctagtctatggtagaggacaaaagaaaagaaaggtatggctagctagtaggggaaaaagaaaaaaagaggaaatgttgaaccaccaagaatcaaacgcatgacctaatgttacaaacactaaatcttaaccatcgcaccatgtatgactaagtgtttataatggaagatatgctctttttaaaattttaggtatggctagtgccatactccgccactgtccctaattggccaccgacaagccatggtcgaccaccaccctatgctcgccaatgtcactttggtagtcatagagattgcaatgttgtttaatgttttgtggaagacgatagtgaatgtgagagtcataattgtaatgttgtttaattttttgtttccaaattgaaaaaattcttattatgtccttctcacatcctttaggaaattctcagtgttggtaagtttaagaagaagcctttgaaaaattaatatgacttgaaggtaatgtttggtagcatcatttacaaggaacaagataattggaatcctatgaattcaaacccaaccatacccatacatgatgatactccgtttgatgccatagagattcaggactatcccatggattacaacaattcttttgacaatggtgatgaggtcaacaagtttactcctataaaaatgctaagcatcagactcatgttattctttgacaagcttaccaagaaatctaagtgaagcatgacacttgttattcaacgacacatctcaaagatttttaagtctgcttcctcttttatgtccagtaagcatgttaggatcatcattgagtaagtcatggaacatattattgcatgtggcacttgatcaataccgatgagcattttgtggcaacagatttatttgtcaagagagaccaaacgaaaatattgatgactgtccttatcgattagaggctcatttggcttaggaggaagtataatgtcatgtatggagaaaagtgaaagatgtgatttcatttagggatattatcgttatttattgtgaacttttggacatgtcgtcgttatttttatgatctttttagcacgttgccataatttttatggtcttttgaacatattggcgtcatttattatggttatttgaacatgttatcatcatttattattatcagttgaacatgtagtcattatttattttgcttatgtgatcatgccatttgttgcagatgtctagcaatgagagtgacatgttttttaaataaccttaggtgacgctatacttgcccaaatatattatgacatgcacctagataaaaaacccaccaaggatgtcaagaactagtgggatgaggtttttgctaaagacatggtgcactctgggggaatgtcatagtcaacttcatatgtgcaatgaaatattttttgatatccatggttcattgttagagaggtgtgtaccacgaccatccttgtatatgactatttatgagaaccttggcatgtttttgtttacatgtgttggaagtgagtcaacctggaaa

SEQ ID NO: 3937 - DNA, 1486 bp, Zea mays
  misc_feature (1)..(100): optimal_loci_313735_G1, chr9:99685363..99686848, Cluster 24
ccatctctagatgcgtactcacatgtgaagtttattttatatactattcactttataaaaatagatgatctatcgtactcaatgaattctttgtaatattaaatttctaaaaactagagtttttgcatgtattgatttctctttgtgctatatgcatgtactgattttagcatgtgctgaaaattgaatattactatcgtcatgtgttgatttcattgtgtttaggcatctacaagtttcacttgagaaaacaaatggttagtataactactatcttcaatcgaatgaccacacgacaatatacaaattgatattcacgattgatcttggttatatgcagaatattaaatttcttatagatgacaactagctgtctatgagttgtatgacatgtctctttaactatctctatatcaaggtctacctattcgatatatagaaatcgtgaaatgcatggacacctaactagtatacataagtgaattttccattcaaaggtttcttgtcactatgtcgaaggagagaaatagctttggttacgacatgatacatgcaaccaaataaaacacattcaattaaactcgcatgtgctacgcgctagggtttgtttgatagagacagattaagtttaatctccttacatgttcgtcaccaagtgcagccaacctatgtataggtgaaacatgggagatatgttacattcattggcccaggcaatgtcatgcaggagtgtatcactcttctcactctcccacacacacacacacaaactagaggttgaaggtggagaacacaacgagatgaactgcttcccactataggagaaaggaaatacaatgtatgtacaagtcaagaaagggccatgcctcccactacaagagtcatgttgcccactactagatactactctacctactacacccataaccttgtacataggggtagtctaggtagacctcgactaccttgaaatttggtctaaaatcaaactaattcttagcatttaggcccaaacaaacaaatcgatacaacttgcaacctaatttgatgaattaaatgcattatggtacattttggttattttctactcatgaattgaattgatgaaaaattatatatgtggtaccaaattatacatgatattacatatcaattttttgaccttgaccatcctaggtttaaaatctaggtccacactgccagtacatacattctttcattcacttgataaatataaaaaagtggtagggaccttccctatcgatgtggtataaaagggagtggacaatcagagtacacatgttctaatgatgcaaagggcattgagcatcagattatctatcaacttcttccctagtcttgccactgcttgatctcgatcacatcaattctagcccaaagctcctagaaccaaacacatccaattggttaggtacacatgtctatgagtcgctgcccaaagtcgatgaacattaggacaatccat

SEQ ID NO: 3938 - DNA, 2713 bp, Zea mays
  misc_feature (1)..(100): optimal_loci_315281_G1, chr9:107627872..107630584, Cluster 24
aagagtgctggcgtaaatctaaagggctaaatctctagtttgcaacaaccacacctaggcacccgttacaaggagtcttggaaagttatatcaacgatgagctgatggaatgtgatatagttgtaccaaagtgttttatagggtagctaaataaagaaaattagagctattgtagattcaaatcgatcgcttgtgtttgtcgatattgttagtcctaggtagctagctaccagcagtcaacagacgttggtccatagagcatgaaacagcgaaactcatcaaaaggtattattatatatttatttcacttttcacatgcaattcagccttttctccgacaaaaatatggaaacaagaccttgcgttgtttatggaaagctaagtttgaccaagtggcaacaagcaaacaagacaaaaaactatggctatcgataaaatatactttatgttgtctttttcaacataacagattcacaccctgaagattctcccatgagggcaaaagcttttgtgttccatgcacactccataaattaaggcagatggatccttttagctaaggaaaaaagatgattgctaacgtgtgtggcgcttagtcaaatacggcattgcagtaaaaggtgtttcctttggtagtatatgagagcctttttttttcccttagcttggttttagacatagtagtttcgttacctctttttgtcatctttcagatttggaagttatgtcgggccagcatttcatctgagactttgagttgctatccaaccatcatacagaggctgtgtaccaaaaggcctcatctagtaggagactgaaaaaagctgaactgctgtgtcagtagtacgctcagcgtctgttgttgattcatctttcatctaatagctccgatggtattctgtagttcacaacaaacaaacaaacgatgcaagtttgaatgatggaaacctatttgtttgtttgtatatggatgcattgtgtacttagaatggaggaaaagggaaattgtttatcaattatagcagattgcatatcaatataaccaggagaaaacccacgttctgcagaagtaaaaacagcaaaaacttctcagtgtgcacaaacgaatccgaacaaaatgcactttcaaaccatctgacaacttatatatcgaggcccattggtatgctggcgttacctttccattccaatctgggaccacaaagtgagcgaaagatacacattccataatcatggaccacggcacgccggataaaaaaaatatattatagttggttaaggttaagcgcctaataaattataaaattgggctcattggaagaatctcagacaaatattaatgctgcttgatttcatattaagatgcagcatgccgtacacggtacacatctaacatcttagcagagaaaatggtcattacacaacctaaaaattagtactccctctattccaaattaaaagacgttttaacatttctagatacgttcattttattacgtatctgtttaagtgcatagcgaaagtaatgtatctataaaagctaaaaatatcttataatttggaacgggggagtagaatcaaagatatactgtttaagctccatgcaccagttccttgagagaaactagatgcatgacaggttgcttagtgaatgttaaaaacaatactgatgatattgttgaatggctccaatagaagaaaattgtaggtcatcctttacttttgcgaaaataaacttatccacaccaaatgccatggtaagctgacccattcttgcataatgccgtctttactacggagtatttgctaaagtaacttatgccatttatgatagcagaagaaatatacattagaggatgagttatatgacgaatcactaaaatcttgagttttaattaactactatgaatgaatctgtgggatttagttcactttctacttcgaatgaaaatattgattttgattgccaaattttacagaacctccagaaacacatcctgaaaaactgatatcgaatacggtaacagacttaacagttttttttagggcaagtaaaaggtgaacagttgaggaaggcatgagctcgtgatatgtgaatattgaagtctgagtatgtgcacattggttgacatcaggcatgcatcagtgatttggtcacatagggtgaaatgttctttagggcatatgtttgatgatgaacattagttgatactttttatgtaacaacaaactagttagcagccaagtacgtggccagaaaagaaaatacaaaaagataagaaaacaaactattaaatcaaccacctaaggctataatccaagaataggagccattaggagggagagactcttggcccctgccatctcccatagatccttatcttcctcagcagacaaggaactataagaaagatagtgatgatccaatgaaaaacaaagcagcatactgagagacatttttagtttcttttgaagaaaagatatatagataagtttgaaggtaatgactttagttgattcagatagcatattatcagttgaagtattcaaaaaagatatcgattcgtagtttcacctagaacaacatctctcacctaaattctagatttatgagagtgattggtttatgaaatgtaaatagtgccttagttaatcgtaccaacatcgtaatgtgccaaattaagaagtatagttatcaagtgatgtaaatatt

SEQ ID NO: 3939 - DNA, 1438 bp, Zea mays
  misc_feature (1)..(100): optimal_loci_321514_G1, chr9:140776147..140777584, Cluster 24
tgagctgcgaccttttcattgttggagtaggactttcaaagtgcaaatccaaccctagattgtttttatctacaaattcgtatgcttgagcacctatccttcatttgttttgagcttgctgaaattcatatatgtgtagtaaattgtgttctacactgaccatagtgtacaagttcatatgaattatccaataaactaggattgtttcttatgagaaatttcataactcaaagttcattaattacacccccaccaagaaataaagttctattcattcaaaacagcagcttctgttcatatttaaaagcttcatttcgtaatgttgcaacgaaaacagtatctgcaatagcagattagtacagtacagttttttttaggaatttaagtacgattcagtaggtagggtgcctgtgtcaaaactcaaaacaacatatcagatataatgcaaagaaagacaacagcgtattcatctaaagtaacatatcagatatcaccccaagaccctcatttttaggaaagcccaaggaccctgttttgaaggctcttttataaacttgtcgcgcatactattcatccaaaatatcttgttactggacatatactgttgattttacttggacacagtagaaccacatagatccaaataggcttgcttgatgattataccggccatatagctttgattagcacatcattataaactagggcccacttgaagcgcattggattgctggtatttttggaggaacaccatagggaataattcaattctgatggagggttagaaattatcatgttttagatgggatctttccacacttctacctatagaatcgataatgtgagtttgtgtcattcttataaattgaaactagttagttacccgtacattgttacggtttgcatatatcatataggcatatataggcatattttccttaaatgagatatttattcaaacacaattatgtttttatatttacaatatctcttcttggatcctggtacattacaatcaatggttgcagtggtggaagaccagcgatttcatttgagggcgctagggtttgaatccttcttgcccctcattttttggctggttattctgctcctccttttcttgttttggaggattcccaactattacaggcagctcgaaatgggtatggtatgggtatttcagcagtctagtcttaacaactggcgttttgtttgggaactcgacggctcgatggtgtggtatgggtatttcagcagtctagtcttaacaactggtttcatagtaggttagcaccgcatacattaaacttggcgattttcgtgctttatattggtatgagctatacttggatagttttttttatgatataacttcatattgctactggtctagcagcttcctttgttgtttcatgatgaggtccgcgaatcacatact

SEQ ID NO: 3940 - DNA, 2557 bp, Zea mays
  misc_feature (1)..(100): optimal_loci_321766_G1, chr9:142284477..142287033, Cluster 24
  modified_base (259)..(259): a, c, g, or t
  misc_feature (259)..(358): n is a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
caggaagttgcgcccgtcggctatattgttaccaaaccttttcttgttcgtctcacttctcatatctacgaatttggaatccttgatgtacatcttgtaaggttgtacaaaaaaagaatgatagtcaacgataaattcaacatagttgtttgtctaaaaaataactactatcacctaccagcttttccactctcaaagtccttatacaactattttagataatccataaagacgaatctctagatcgtacttaggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacaatcattgagaaataagaagaaaaatacaatcaagtgacccatttatttttagggatgcaccattcaaacaaaaaaagtttaaaatcttgaaatatataaagggtgatcctaatagctacacatatgtttcaacctagcatgacttacccaagtaatagggggcaaattaaggacacccatgttccttgacgaatttcatgcatctatagacctgtgttgttggttgatacttaaagttgttgcacgaaggttttggggcttttattctgtcttttgtgttcaggttcttaagatctttatgatcatctaacaagtcaaaactcatgaggcatatctagttaatatgcaccagagagagatacataagcttccattcaattccttgtggatgtggtaatacatgctatagggagaaatcaatggatctgatttcaacccaatgaagggctccaactgctagtctgcatggaggtgttatacatagaagttagctaacttatggctatctctcttgtgattctaagtaaaccaatatcctcttgaccatccaagaacacctttcactcatatctttgtcttatgcttcatctaaattgagattgtgagtgaactagtgcatttgcatttaattgttgcatctagtggcactagttcaacatttgggctagttgaccatttgggatatatatttcttgatactctttatggtttcaatcacctagatggcttagagaagcttgaggtaattgagtaagattggtgattgttcttcgcctgcgaccaatgttcgttatgaagatgtttttatcccatcttacggagtgcaaagagatactctagtggattgctcatggctagaggaagtgcttctaggcttaattttgcaacgccaagttatgggtctagcgtgaatgctagttagcgcacaaattattcaccataatacttgccacaatggggactgaattaatggtaagcatccaaattcaggagaaaattgattatgttatttctcctgtctgatttggcataaactctacactcattttattcatatacttgttaatagtaaaagtgtggttaattatagctagttgtagttctttactagtttagctttcttgcttagttgtgtagctagtagcttgtgtggtgaagtgtttttagataggataacttattatactaaccattttagtatagtgaattgttattgtaaaagattttttataggttgttcacccctatagccatctaatttctctcaactttcttcctctctcatctcctacttgtaaaaaagagtgtaactaatatggaacaacatatttcatgtgtttcagattataatccatttagggtttatactaatcaaactttgccagcttttactatatgttaagaagaatatatttaacgtttataagttcaataaatccattatcggatacaatttatgaaggatgaaacaaattccatatcatagatattagtacattcttttacaaatttattaacaaaagttaaaataataaatttaagataaccaaaggaaactgcaatttgaaaattagagtagacagggtctacatacctaacataaaaaatattccctctgttcgaattagaatttatattacgttgacttttttactctaaatttgattgacccgttttattcaaaaaaaatcataaatattgttaatctttactataatatagtctagcatataatatatactgtaagtatgactttgaaattttccatttttaaaaaagaaaagacaaaccgatcaaatttgacgaaaaaagtcaaacgaattataaattagaacgcagagagtattaaagagccaaggaagaacctctcctttatccattcactcctccctcactctcttcccgtttaagtttggagtcgcaaaattttcattggtttcacaagccactgctggcttacctacgtaaactggctcaatcatctttcactttctcatacggaactaattctttatcatactagttttgaacttttttttatttaaggttatgctttaaatccaacaatacgcagctcattatttctagcacaagcatcacgcacaataaattgtaatcctgttgcaacatattgaggatgcgtgctgataatattgtatactagtggctttagttaaagaaaaaaaccgtg

SEQ ID NO: 3941 - DNA, 1942 bp, Zea mays
  misc_feature (1)..(100): optimal_loci_322449_G1, chr9:145888223..145890164, Cluster 24
agcatattttagatctggtgtgttacaaagggaacaaggcaatggggcttgggtgtaaaactgcaagtggtgtaggataagttgattggacgaagccagcgatgaggacaaggagccatcaaagatagagccatatagtcgattgagactagggaatgacaagaaaggaatggtggtgatagacaacaggcaagggtgtagttgaggaaaaatagatgagaagaaataaattatgtgttgatacctatattaacgtgcttgtgttagacatgagcttcctacaaagtgagtatcctaggcagtaggcacaacaacttgttactcaaaactacaatgttaaatttgcttgaataagtactagttttacaaatgagtactaaggttttatcgaattgtaatgtaaatcatttcacgtctgtaaatatggatgatttattaaaattttgcaaagtccattatcaaatcaaataggtgcatatagcaacacttggtcgcaatgagcctttgggctgtgtccatcgatcctatgtttttatttttatctatttcctgcctagagacatcaactttagtccaaatttgagtgaccacatttattccatattttaagatcatcatgtcttattgttgcaatgaaagcaacttaattatctctagctattccaaaagtcaagttttagagcaattattatatttaacaatgcaaccaacccaagtggccaaacttatttatattgattaataatatccattaacatcagttacgaaacataaaagaatatgtaacctggaatgacccatttgccctaatcatatataatatatagaaaatgaaaattattaacattataatactacactgttggttgcaactagtatccacttgttacgtctactagtagcttataaccatgtggatgatactctcgttttgtaaccatgtcaatattttttattagctaaataaagctaaacactttaactaatagctaaaaataaattatttagctaataaaaaaatattgactgacactattgagctaagtacttctactaactattagccggacgatccaaacaaagctcaactaatatatcagttaacagcctgttagtaaaaaaaaaactattggctggtttcctataactagtagtagccaaccaacaattagctatctgggtctaaacagatccttgctacaggcagaaaatttaaagaacttcccaagtggaaaaaaaacttgtttgatcttgaaaatatatgcttcatgactacactacaactggtattttcttgtagctggcaaaatgaacttccatcacggatacaagaattagtatcccctacaactctgaacttgttgctgtcagaagctctctcaactcttcgtccaggttatagcattattattataagatgaaagcacgcacgaacgcgccagccaatgcgctactgcatgcaatggaaaatcagtttgcgtgcgtagaaaacgatggggattatggtctgaacctcgcagattatcaaagctgattacgagatttatcactgctgaagcgtcgtgcgccgaacaaacgtggccgtcgtcgccttcaaaggaaaatagaaaataacacctgggtgctgagggcaaggcccggccacaaggtgggtcacacgacgcccaccaggccaccagggagaggaggcgcagatcatcgctcaatgactgcgcttctataaaatacgtccatgattggtcaaggttttaacttgcggttggggatccggatcctttgagatgatggcgtgcgtgacaactgagcgagcgccgcatgtgatggcctgatgggactgaagtgaactgcccagccagaggcagagggtacggcatgatgggacaatcatgtgagttctcctggcacttggcggcggcctacttggctgtctggttgttaagag

SEQ ID NO: 3942 - DNA, 1843 bp, Zea mays
  misc_feature (1)..(100): optimal_loci_323186_G1, chr9:149521056..149522898, Cluster 24
tgtagggataaaaaagttaggaaacccttctcaccgttttgacccgcatacgtttttgtttggttagaatccgacaacgtaaaagtcgaaaatggattatgccgaattccagaatataaaatatagataaatgaggacaaaatatcttgaaattaatcgagaaacggtaacttaatttagaaaagctcataataagtaagttccaactacacacaataaataagttccaactacacacgactgttcatttacatctacatacaagtttcactcacacaaacactatagactatccatgcagagttgatcatatatatccatttataagttctaaacttttaatacgtatgccttaaacaaacgatacataagctaaaaatcttgtatcatatcgtctggatcacttgatataccttttatgacacccaaaaaaataagtatcacatctaaaatctctaaatccataggaagagataggacatgcgtgaaagctgaaatgaaagacataaaacaatttagtacaagaaaatcttctatagttacaaataaaaactttttaaattacatgatttttataaataaaagcggtacaattacaaactttttaaattacatgatgattacaaatgaaaattgtttcaatgcaaaatgtttaaattacatgatgtttaaatgtaatatgttatgagatgtttgatttaagaaatgactactaacgatgagaataagatgataatactaacattaattgtttacttgtaaacaataagatgattttttttcaaaatatgagaaattactgaattttcccgaagacaagaaattgagtacaaatacataaaacacgaaaaattaccatatttttccgaaaaatatgaaaatagacggtaaatacgccccattgtttatcgtaccgttttttaacacattatcccgttttcgtattgttttttatatatcccgataaataaaaaaataaccagaaaaattgagtaaacaataccgaaaaactactgattttttccaactgttttcacccttagtcacatgacttgcactactagcaatgcttatgctttcttggcttcgccgcatgaacgaaatgacaacaacatgggcgccacactgtcttggtccggtccatgaaaagtctgagcctctgaggcctagcacgagaatctctggcccaatgtggcaggtgtaggaagactacttatgctccgtttgaacgttgatattagatgatatagaattgaattgaattgaatttaataacaaatcagccataatattaaaatgatatgtaattccaattctattgtttggatgttactgaattggagtttggaattgtgcggtctaattccacacaatacagaggggtgacactttgcgttgggagagagagtttctagttatagttcaactctagaaaattaggtctctaattctaaatctcaattttatatgcagacaaacaatagaatttaggaaatctgattccaattcttaaatctatactccaatgtcggtatccaaacgagctattatactcatctcctccgaccactccttcctatgtagttaatcgtgtcctccgaacactgcttcttcccctcctccaaggctctacccttgcacgatggacgatggatggacgaacaaatgttgttactcgtagtcgtagcgatcctagattcgaatccggccacagagatttagttgggagagttgccttgacgggaacccgtgctgtgcagctgtgtgcgcccgatcgacacacgcgccaaattcgggcggggcggcggtatttcgcacgcccaaaacaccttggttcagatcc

SEQ ID NO: 3943 - DNA, 3528 bp, Zea mays
  misc_feature (1)..(100): optimal_loci_324478_G1, chr9:155542790..155546317, Cluster 24
gcaacaccaccaacgtcgtggctcttcctcgtgggcaatgacggatctacgccacgagccacccctagtcctaggattgagctatgtaattatatatgagtctctaatttagtccgtataaaatggtacaaatagctaagatgagggggagtaaagtagatttggtctggttctgccccctgctaggtgggtggcgtccggttgatcctatcgtaggccacggtcggggtggtgctggcagccaagttgaaggaccatggtgggatggacgagggagcacactacctggtcctggtcatcatgtgtgtcttcgtcgtcaggcaaactctcatgtatctggcacccaccgagatcggcccgctggagatgaggtcggcgctcggcggggcagaacatcgtcatctgcttcgtgtcgtttctgaccgttgcttgcgaaaatgaagccgccgatggagcaggtctagttttgaaaaaaagatttttatcatatattgttttgcattgtattgtattggtgtctcagtaacaaccgatagagcatgtgtgtatatatatactagtttggtgcccgtgcgttgctacggtttctatatattatataataaagaatttacaattggttgcatgttctcaccctacaacatttaaccaatcatcatagctttgctttgaaatgtagagcacagttgaacccaacagatctaagaaagaactaagttacatatacaaatttctcgatgttttgtttacatgtcaagtattgcaagatgaaaagatcatcactatgtaccaccgattttaaactctagcgagttgggtcatttcttcagagtgtaaacattggtcttgtcaaagactttcatcttcccgacgaacactatttctaacattattttggctttgatagcgacaactttgatgaactcaataccaaatatgcagcggttattgacaagaaatccagaggagtgatttctgctggcatacactctggtttcacagaatgaggcacactttgctagtgaccggttcaaaatttgattcctgctggccagtatgtacctaatgaactcatggatctggctatgaaggttagttagcttattgatgaattttccttcagtgttacttcacataataagctatggacttgcatgaattattgctagatacagtgttctgtaaactggatgtttgcagcaatgtaggtactagctcattagttcaagttatttttcgattaaaagaaccacattcttttttctaaaactattgtgttgcaggatgccaagatgcaagattccctctacttccattatatcactaaagttgttttttgcttttaaggcttctatattattcaacaatttattctcatattatgttgttaatatattatttcgttgcaatttctagagtaatgggaagctacaaggaaatttgctccagaaatttcacaaaatcaaggtataagttttccctccttttatttaatgaaggtgggaagtgcaaaaaatgcttcatgttgctttattgagaagaatacaaccttgagagcacccaaacaaacaaccacactcatatcagggagataaccaatagactccaaataaagggtcagataataaggagaaactcttagcccctaccaagctccaaagcttcgtctactatctatcttatcaaagagtgtctcttaaccttggcataacacaattaagtacacatatgttcctatgtttctaccaaaaaactacaagaacttttctctctcttagtatttacttaaattgttctctctttctcttttaagaactttgttattttgttgaatcacccatgggaaatttataacgcataaaaaatcttaattttacctacaacaaaagaccataaaagatattctgatcagcgaagtggaaaccttcttcatattgtgaatagtattacgtttcaacgttccataaatgaacaccagtgcttctatagtcatttattctgttgtgctaaaattacaggagatggcttgactttgtcaagttagctttctatacagacacaagcttggcatgtatcgagcttgtcaccaccgtcatcggaaggtcggcaagttggataaagtatgtgatctgcaagtgttgaaattcgaatgagtggtacgcaatcactggttggcgaagtcctaggtataacttttattggtgaaacttctttcttttgatgtactatgtgtgtcctttattttgcacaattgcggtgcagatgacctcgtcgttctttacacctgactacttgggggctatttttcaaggacgacaaacttcactagattaaatggaatttcaactaacaagaatgcgccatgtgcaacataacaacaagcatgtatatcaatactccagtgactgttgttaaatttagtcattttagcatctattttttgttcaatgtttttgaatggagagaggaggagacgaagggagagggagggagggaaatagagggtttaagaggtagttgtgtttgtatgattttgaataacatatttgatccagcatgtaattcctgtttgcattgtttcaacaaccttatgtttcatctttgtttagtttcagttttgagtaacagctttgaataccatttatgaccttcagttacgagtaacttcggttagtgctacataagagcacataaaatcatagaactatacctaaataatcctaaaacacaagttgttacacaaactgaaaccacaaaactgatatcacaggtacactgttactgctaatagaggctagcacaagtaacagatatcacaagctagcacaggtacatagatatcataggctagcacaaattatgtagaattttaggttcacacttacaaacttcttcaggttcacacacacactgcttcatcaggttcacacacactaaacaggttgacacaatacataaggtatacaactacttcaccaggtttcaaaaaacccaactcttatacaagtacactggcatactttgcacatatattttcatgctgcagattctttttccttgctcagtggctgctcttatgtgtgttgctgctattctgctgttccagacaacaaagcagacccgattacggaaggtatgcacataatgcatatggtggtgttgtaggccatctttttgtgtgatgttcagatgtgctacattcgtggtttactttccatgcatctctcttttctcagatttggttctctcgtactttgcttcctacagttgttgctacacttgaactaggcctatgatttccatagatgtaattttcatagaacattgtatctagcaataattcatgcaagtccataacttattatgtgaagcaacactgaaggaaaattcatcaataagctaactaaccttcatagccagatccatgagttcattgggtacatcctggccagcagaaatcaaattttgaaccggtcaccagcaaagcgtgcctcattctgtgaaaccacgcctccgcttctaaacacc

SEQ ID NO: 3944 - DNA, 2046 bp, Zea mays
  misc_feature (1)..(100): optimal_loci_325207_G1, chr10:4037358..4039403, Cluster 24
tggacagtatagatgttatattacaatggtattgcatgctcacatatgagtgggccagtttctttgtatcttcagttctatgttagtaaatttaaggaactaagtgatcttatagttgaagtgcatctaacatgaaaggaagccatgctttttcaatagtaaaaaaacatataggttaacacgtagataaacaacttagattcagcaagaaatgttgtaatgggtgagttcggattccaaattgaaagtatgtacatcgaactaagcgatcataatgttgaagtgtatctaacatttaaggaaaccatgctttttcaatctataaaacagacatatagactaacatctcaattcagttacatgataaaagaaaaggaaaaaaatcactcgcagcattgtaatgttgaagttattataatgctctgcataaatgtatcgacaatctacgacatggtatgagaagatagtacttacaactttaattgttagtatcagatggttgggattatgaacttaaaaacataatttcgctgaactttaggagaatctagcagagatataagcaatgtacgtagtacttgtttttggtatcagcttcacgtggatcaagtacatacttcttgtctgtgtaaacaattgccctgaattctaaactgtcagcccaccgtatcaatgttgcattgttgctgaaacattccttctcttgtacacataaggcacacaacggaaattttcagaaatcaagtagaaacggaagtggggagattcactacaaaaatatcaataccaaggcatcgtacatataacttgtaaaaaagagtggcatcgcaaattgggacaacctcctcagttctgcactgatagttgagtttgcaaggttcccttgtgcttaggcatgtggtaagcattgttgttgttggcttgatgttgtggtacataagttggaactatgactatgttgaaagaatcatcatgtccatttgagcacctaaatccacccttaattgatcaaatccttgtaaaatggtagcatggatattcataggtggacagatttcaaaaataaaatatgagcacatagggtaacattttttcatagcttacagttaatggtcaatccttcatggtaaaccacgtacatccatcctgttttagtccagttcaaaaatttggggtgttaaaaataagcaaatggaagaatgctaaatgtatgaatgattcacatcataagcaccctaattaaccaaaagaagaccctggtgcataaaaggtttgctggacaggctgacggaagagtacaaagacaaagcgatgtattccagcatttggctttgggttttcatagctgacattttcattttctgtgataaaatttatttaaccatgtcacagtgaggtaatatgaacattattctcatctgtgtaaatattatgagatgaacattcgttgttgtaaattttaggttttgaaatatgcaaattacagggttgctcatgttaagctaaaaataaaagttcagttgaactaactaaatgcacttttactaccattgaattgcacaacctttagcagtataattcaaataattgactgatatgacaggcaactacttattgtccaggctgcacaatctatggtgacatttatattatgagttttttttaaataaaatgtagatgatatacttgcctttacgttgtgcagtgaggaggtatacatacatgtaatcttgaggaacaccatatccatctaatataaatattgaagtaatgtattatttaaattgagaaggacagaacagaaggacccactataggaagcatttgttgattccaggatgtttgtcattttccaatagttgtgaaatgttccaggtcttaccaatgaaggtattctctttttttgttgggttacttagacttgggaggtatacagttgcggcgacggagggagatggggagagggagagataagagatggttcaaatacaactgtccattagatttgagtaagagagggggttatccaatgatctgaaatgttag

SEQ ID NO: 3945 - DNA, 1901 bp, Zea mays
  misc_feature (1)..(100): optimal_loci_325589_G1, chr10:5906031..5907931, Cluster 24
attgctcagagtccttggattatctcaatcattatatacagctaacatgcatttgctgcccgtgtcctgtgccataaaactgtttgcctggcacatttcaaaaccttaggccaacttaataacggacggtagtacagtaacaaaaaggctgcttgggttgtgaggcataaaagttgttaccagcgagtacaatagagtttctgctagatttctgaagacgacaagttgccaccagcagattattgagcgtcgttgcatgactcgtgctgaggctcctggataatatctttatgtgttattacttattggctaacgctggagcagaagactgttccaatccaagttccaacacgatgacgaggtcacgctgtagcggatgactattacaacacaatgacaaggtaacgctgttggaatttaatttggtggaatagaatggccatctttagtggatacagaaacagaaataagcatgacaatcaacaacagtgctgaagattaaaaccaacagctcttagtactttgcttgtttggctgctctgcacttgccgccttcatagatatagatgcattgcgaaatatatataacctatctggagtgggttcaattgcatgttcttctttcacgaattacgactgggcatttcagttctcggataccatgatcacgggaacagtgtcgcagaaagcgactcggccatttagacgcattacattacattacagcactgttaggttcgctcatgctttggtggttcatggaactgacgccgacctgaaagtgacgctgcctttgtgcttgaccattcacggtcgcattgcgagatttggtccactactaatctgcctccctatactggagcccgtcatggttgggcagctacgcttatcggtttctttgccctgttggctttacattatggacccaactgctctgaatatgcaacgcatcttccatgcagtactgggatgacgacctccgaattatttgatgagcgtgttgtgtgtatgcggtgtccagctcatggtttttaattttaatctgaaaaattggtccagctcatcctcatctctttggactctggtacagaataatgggtagccttggatgctttttcatcctgttaccaccagaatttaaaaaaaggaacttggtggaggggaccacggcccaggcccaggcccaatgaaatggtttgctcatgcaatcccgtagatctccaacttcctggtgtattttctttttttcccttcaacatggcgatgatctcaccttcatcttcacgagatatgctgcttcgtaaccatgcgcccccatggcccataccttggtggttggttgcgggtgtgagccgtctatggctcatgtgctacgtgtgcacacaactgactgcgctcagctttcaagtttttttttttgtctcccacaatgtattttgtatttgtagtgaagctccatttactgagcgtctgctatactgtatgattggttgattgcgacaataatacctctaaaatggttactcttgctgtatactgtgatctagtgatgtcgatcacatgaacatgacggttagtttttaagatcgtccgattgtatcgattcggaatgaatgcttttggaagcgaagaatggagatcatatgagaattcctggtcggcgtagcttcataaacggctttctgagttattataagcttttatttttgtccaaacaaccctttcaaacagttttatgggtgaaactcatgtttcatgctctcataaagcaatgacgaggtgaaaaataagagtagcttttcgtagctctctgatgtaggtgcagtctaatgtttcgatagagctaactttgattgatgaactccacgttcatgatctaggctttgaaccaaggctgattc

SEQ ID NO: 3946 - DNA, 1689 bp, Zea mays
  misc_feature (1)..(100): optimal_loci_338568_G1, chr10:85315583..85317271, Cluster 24
gccgtatacactggcttcatcctcagcattaactagtttcactcgtatatcagccttctcgttaaatacttgttcatatccataacttaagtgtcaactattttataaggctatctccaaaactttactcattctcatcctctatttcaaattactgtaggggcctaacctacaatatttatgattgaaaaaaaagtatatggtgttaaacgatagggatacaacctttatttcggttcaagccatactataaagggaacatgatacatgtaacttgacctaggtgggtctagttttgcgtgtgacggtgcacacttgtgaaagttagtgttagataaatccaagagagcctacaaaaagtttataacaatctaactcgaaaagtgggtgaaacgaatgagttagtcagcttgcagcaggaccagacatgtttggtgtttcaccggacaaaacaccagataaaaagagtgtgctgtagtatctgagagctacactggcgtgtttcatatgcaccagttatgatgtaacgcacagacaaaaaagagcttgcagaggtggactcatgtagttttatatactcaccaacatatccaatgcaacgccgaatatggtacttaaaagcatgtgagttgtgcctttgaaagttgtggaaaaaccaaatgtaagaatttgggggaagatggtattagccaggggccgacgtagccaggattttttttatagagagggacataaacaatatttaatagattatatgcagtatatatatacatgaatgtttgatttcagtttaacctactagactacaacacgcttttatcaaacacacacacaaacaaaaaaaacaaccaacatttattgaatcacaaccactgattttatatacttatatatccatatgtttgtacaaggcccctgctagcctccctttatatatgctatgccactggtcggagttaggtagctagacatcgtcgtacataatactcccactgttgtagttgttttgtctctggtccaacgaaggaattaagcaggtttcaacgtacacgagcatagcatgcatgtacagtctggcgctcgctcggtgggatctctccggttcaccgacgccgcgcgcgccagcacggcgccgttgactaggaacttgtctcactttgtgggtacggtgccaatggaaaccattggactaacctagcagccactatagcaggcaggcaggcatatagccatggcattatattgttaacaaaccatatatatccgatgaaagccgagtttgagacgcaaagttaatcaagcatggtcgaacgcattcccccggccgccgtaatagtaataagaaaccatatccgaaccaatcatatgcgtgcagcgcatgtctctagaagatttgagggtcttcatcctgtgcgtcgtacgtgcttgtcctacatgcacgtatgacgtatcttaattcttaatcctatatatacagtttattatatccactaggttttcctacaagtccattgccgagagctctagcgcgctccaatacccatctattgttttttttttttttgaaaaaattctaacctcttttgacctatgaaaattgcatagacgattgacaacataacgagtttgaactcattgtgaaaatgctcttgtctatagtatatatatatatatatatatatatatata

SEQ ID NO: 3947 - DNA, 1628 bp, Zea mays
  misc_feature (1)..(100): optimal_loci_34407_G1, chr1:209237032..209238659, Cluster 24
ttttgtaaatttgcatgggcacagtctagctagcttcgcccatgatgacccaagagaataaccagcaagtagaaacggtgaatttcaagcgccgatcgtccgcctcgtctcgtagagactgatttctgcaagcacgaaagaagatctgctagctagctgggttgcagcaaggttggagaagacacaaatcaaactctgtttggaaagacctcctgaaccgacacgttaggcctggtactggtagaatggggaaaaggaggatgaatttgaatgtgacatatatcgagaggaccttcggggagccaacgatcaatcaaaccaaaaagacgtggaagtgccgttgtagacattgacacatagataattgacgatccagtaaatgtaagacggagagccattagagggagtgttcgataaaatttatctgggttcagtacattttatgattttcatgtttttttaatcaactgcatatattttcatgattgtttttacaaaacgtatctgtcttagctgcacgacaggtttattgttggtcctgaaaaaaaaccattgctacttgctctagcctataattttaaaccataataatcttatatatatatatatatataaaccataatatatatataatcttacatatacattattatggtttatatatgtgtgtgtgttaaacttcaaattattccactcatcgagaaacaaaaatcgtattttttagactgcatttttctagacacataagagattttgttgactagactgtaaataatgacataaagatatagagtaaccgcaatggagatagtctaaaccgtgctacggcttacgccaaatggtatgcatgagggactgtttggggactgtatttcttaaaaccgtagtttattatatgtcatgtcataactatactatattttatatcagtccaaactagcacatgtttggagacaaaatattttagttgtaatgtaggagaagagaagaccgcagctgtatgcaaaccaaattttttgatctatactaaagtttttttacctaaaaataccgtggtagcgtgtaaaaccatgatttaaaatatagagtttttagatatgctcacaaacatcttttagtctaaaatattatggtataattaaatatcatagtattgtttcaggaaaaaaatgttgtgtttccaaacatactcttaatggcgacgaaagaagacagctgctactctgcaaatctgtagtagagtaggcagattcctcgtaggaccgaagcacaaaaaacgtggccgactgtcatgcaagctgatgtccaaaaccagtgctcgtacgtcgtactgctagtctgtaactacaaaacgccatggcttatagctggagcactaggtgcctggcccctactaggcaaaacttgactggagcagccagtaacatatatatactgacattatatataggctggtaccaagggtatcacatcggacctgttcatactggtctagcttcagaatagatcagtaccgacggatcggtaccgatggatcaatatacattatacaggcttgtcagtaccgatccaaattgattggtaacaattgttttcaaagaggaatggacaaataagctactgtcata

SEQ ID NO: 3948 - DNA, 1983 bp, Zea mays
  misc_feature (1)..(100): optimal_loci_345891_G1, chr10:126564625..126566607, Cluster 24
cccgctgctgaggctcaagcgttactcctccgtggtagggttggggagcgtagtaccgacgtgcgtacgggattggagggatctgatggtaatcagagaggaattgggaacgtatgcgtgttgatcatctgagctaaacgtacttgcctggtcggggaatttactcgacctaatgcagccagcagtccatatatttgcagccattacgtgttaggcttggaatctagcgatggatttgtgggttcatttgaatttcacacctcataggaatggaggtactctgcttgtgatccttggctatagtagccattttcctacaatgctacagtttcagcttgtggattatgtgaattaacttagttttcaattagcacaacacctacactttgctgcagatttgcatgggtgatgcagtatttataatttctataggttgtcataggaacatgttgtttttgcttttataagcatattcaacagttccctgcaatctaatttgaaatctaggtcctatgtgtaaaagtagagtacattgaccagaaaactaagagcgttacagttttccatggtcagaaatatattgtccattcacatttgttatcatactttttgcctagatgacattaatttagcttcataacaactttagataatatcttgcttatgtctagttgacatgaatttggcatcaatagtttttgctcgaatcatttggtatcataaagtagtaaacaatgtgtacagttctgttacatgcttggatgcttcattatttttgtatgtaatgacatatgcgtgaggaaagaggaattgtcagttatcacttgatctaaaagtctgttacattggattctattgcaactttactttgttttttattcttgtcttgttgctggttgctacaatggcctctctcaagactagtaatttttataatattttcattggaaagcatgctgctagatgcctatgctctaggctgtcttggcattttggcactttgcacttacactttccttatgctccgggcaacatttatgcttctattaaattgttttctatatttgttttcatcatacaaagaactttataagaagttgctgaagttcgtataaagatattttcttttactactagggcttgtgttgctgcaaatgataaacttcttgttatcggtggtcaagaaggtgatttcatggcgaagcctgggtctcctatatttaaatgtgtcagaagaagtgaggtatgttgacatgcacctcattcttatagctaattgatgcacattatgtggtccctatgttttaagatcaactgagatcaattccccgcattaaagacaacttagccatatgttgtgcatgattaagtctagtaaataagcatctaagcaccacacacgctgcgcctactttcttcaataaataatggcggacctaatttcaccagaaagtggattgggcactgtatttttcaaagaaaacaaacaactgataaagacatttagttttatttaactatgaagctatcatatatcacatatattcaaacattggcataattgatgtttttgagttgagaccagaatcaatccgaaagtactagtagtttcactattttcttagtaaccttactatttgcactatttatttatctttgttattaccctcttttttaaaaattacactctgcttgtgaaggttgtgtatagtaatgtttatatgcttgatgatggaacgacttggaaggaacttccacctatgccaaaaccagattcacatataaaaagaactgatatgactaagccgttctttgtgtttttttttttgcgtacaactgtttcaatccccccgtgagttctttcttggttaggctatctctagcagctctcctatcgcaccatttcgtgtagagaatcgatggctgtcctgggggatgtgactgtcgcaatcttgtaagctgtagcctcttctttattgagct

SEQ ID NO: 3949 - DNA, 1699 bp, Zea mays
  misc_feature (1)..(100): optimal_loci_347126_G1, chr10:133583872..133585570, Cluster 24
aagcaaccaagcattgtaccctttgcccaacggcgaagttccccggaaactaatctgcctcacgccctcacgccctcagcgcacgtgatctcaagtctcaacacatccctatatatgcataaacaatgatggagatggagctgagtcccacacggccacatgggcgagaatgcgtctttgattatagtagcacaaagaagggcaatcttttaatcaacagtactgggtgcactaattcggaattactagcagtagtatattcctagaacatgaggcagcaatcattcaactggaactggaatggctgaggttttgctggctacagctcaggtcatcactgactgctgacgcaagagagtttgttggcaccagtgactgacagcccaccttcaacatgtgctcgtcatttcttaaagtgacgtcgacgaaatcacatcggtcttctaacttgttatcgatacaaacacgatgtattgatacctcgcgctttttttacgaaaacttctaataccgttttgttaaagaaaaataacattaaaaagtgattatgaaacaatgcaaacagctcttcacgctttgccgctacagatgtcttgcatccaaacactttggacagatcggatggctttgtgcaacattggtagatgacaatttggtgcattggctttctcacctgccgcttatcaatcgctccttgactttcttgtcttcttgatgcagtgttaaactgttaatgcatgcggcagaggaaaggattaaggatctgccgctacagatgccagcgatgctaggatttcaaccatcatctctagaaatagagtactcgtctctaactattacagctaatgttagtttattgcttacgacctatgttcaaaccccaataagtgcatatgctacctagatataaagcaagtattagcaacattagtaggtggatctaaatgtgtctcgctaataattagctagttaaatagtttaatattagtgccaaacagacaggttttaacagacttatgctaataattagtatatctaaacatacccatgctaataataaagccaatacatcgagtttagcccgcaacaaatacatcacaatttcaccgttttttaggaatattgctacaacctcctgtgcatcctttttttaaatataatatacagtacaaaggacgtatcggttgttggaatgtcacagtgatcacctaatctgcatcgttttcgcgcaaacctttcatatgacatgtttgtttttcgtgatgcagcgtgctgatgggctgatggcaggcttgagtgcgctgccgtttggcatcttttctcgtgggttcaatttggaatgtgcaaagtagctagtggtcaggagcaggaggttccattcctcagcacaaggaaaactcatgaaggccgcagaagtgaaagagtactgcagcatatatcttcagtaaggacatgtggccgagcaagagcagtttacatgtctaggctgtggatccatcttgaggactcggaactctccttaagaacagcagtattgtcatgccttggagtttctcctcttctctgaacttgaagaaagaacaatgcatgattcaaacagatcagaagttggctgctgccagtgggcgcatgtggctgatctgagattagcgctggaaagacgaccatcgtgaaaaaggaatctagctttgattggaga

SEQ ID NO: 3950 - DNA, 1444 bp, Zea mays
  misc_feature (1)..(100): optimal_loci_347715_G1, chr10:136473247..136474690, Cluster 24
tagggtttaccatcaattttctcaccaaatctcaggggtggatctaggccacttttgtggtagattttggtaatctccattaaaatgtatgcttgatagttcttaaatgaattgatgatccctattgccatctctagttaggagtcccttgctctatcgaggctagggtttaccatctcattttctcaccaaatctcaggggcggatctaggccacttttgtggtagattttggtaatctccattaaaatgtatgcttgatagttcttaaatgaattgatgatccctattgccatctctagtcaagagtcccctcctctatcgaggccaggggtttaccatctcattttctcaccaaatctcaggggcggatctaggccacttttgtggtagattttggcaatctccattaaaatgtatgcttgttagttcttaaatgaattgatgatctctattgccatctctagtcaggagtcccctcctctatcgaggccagggtttaccatctcattttctcaccaaatctcaggggcggatctaggccacttttgtggtagattttggtaatctccattaaaatatatgcatgttagttcttaaatgaattgatgatccccattgccatctctagtcaggagtcccctcctctatcgaggctagggtttaccatctcattttctcaccaaatctcaagggcggatctaggccacttttgtggtagattttggtaatctccattaaaatgtatgtttgttagttcttaaatgaattgatgataccataacttaatgaagatgacaccaatgattattttgtctagatccgaaatctcaatgatggttgaaatagaaaaaacactcagattttaccgaaattctcaaatcctgaagggtttataattttaaatttttaaaaacaaattccactgttttcggatggttttcgatgattttaccacaaaaaaatgttaattattttttgggaaaaaatgacagaattttaatagaattttccccaaatctcgttttgtgtttatttagaaattcaaaattttgaacgattttttagaaaaaaacaacactgtcgggtctgttttcgtgtctagtgccggtaacagaaaaagaaaaatatacctgcaaccggcggttgacgtgtgagatttggaactatattttcgacccgacggaaagggatcggagtagaacgatctataatttgaatttggagggagcacttagtaacagatagaaacaagacatgtccctcactgctagagactcgatccacctttccagccaaacagttaaattttgtttctacaggagtatttcagccaagctagctttaattcataccaatttttactatttctatattatttttatctttatggattacagctgtaacagttcaaaaccttaggttccgtctaagtttactttaaa

SEQ ID NO: 3951 - DNA, 1850 bp, Zea mays
  misc_feature (1)..(100): optimal_loci_348220_G1, chr10:138994614..138996463, Cluster 24
gttcatacgatgattgataattaaagacgtaaaattgtaaatccaaagcaggctgcaggaaaaatcttctacaacttgctgtagagaatttgttttccctttttcttcactggctccaggtccaacaataacttatttcaaatctttgttataaaaaatagacccaactttgtataatattttataataattaattaattataataagtcatagccatgcaaaggaaaaaagacaatgttttataataattcaccataaccatggtaatttagtaaaatatgcatgaaataaaggcaatctttgagaaacctctacaacaatcatggttaactatgatatatacatgaaataaggtaaggttctagaatcatctacgacaaccatgtgaagcaatgaaacttagttatttatatatttgttgacatgataaactaggaaccatataaacttagatatttattgagacctttataatatgtacaagggacacttaggactgggcaaaaaaacctaaactcagaatacctgaaaaccgaatagaccgatatttcaggtttcggtctttatttcgagtatgtgttcccagaaaccgaatttaatattagaatttcgatttcttaattcggtaacccgaaacacccgaacaacatgtcaaccaaatgtctagagtccacagtccatgctcggccactctagactcctaggcagtccattaggcggttagccgattagtcacttttagcccattagacccattgctcattacgaaacgctcaagagacctgcatggtcacctgtagtcctggagtagtggagttagggttggagttcgactacagcgcccgacgtcttgcttgccggtggccgccgccccgtcacgcacccactccgccgcccgcgggtctctgcttgcccgcctcccaaccaaacgccacgcccgcaggcctcttgggcgcaaccgcacaggtgactgtgttatgcacttctgctctgtcgtctgcgtcttcttgagccttgaggcatggaacctggacgcctcacgtctgtaatgtatagttgtagtctgcatcactgattcactgtacatgctgaacctgcacgcttgatgcttgatatatttcgggcaaaaccgactatgactatgagtttcggttacctggaacttcggttctcaaatacccgatgcatgcatgtttcggttctcactgctaaaacccgatttttttttaaaaaaaaaagaaaagaaccaatgtcgggtaaaaccaaatgcccagaattagtgacacttatccataataacacatcataacataagtgttagtattccgattaggcgatataatttttatttacttagtgtataagttatgatttatataaactaggttggcttgcctttcatacacgtataggtccttgcatatatagttggtgttagagttaatctgttttcatattacaaaacagataatagaaaataaaaaatgctatataaaaaatgacatttttcaattttttgtttttaattagtttttttaacatcaatatattctaatattatagtaatgatacaagtatatactaatgtagataaaaaaattaaaatacttacattaagtagaacaataataaatactatagattgtatattcatgctctaaactagagttagtagtagttaatataaatacatatatagatactttatagttgattaattaagtattaggtgtgtgtccgtgcgttgctacggagtgaacatgttataataagatacattgagatacagaagcattaattatcgttcaatgctcttgttagcatctttttaaaggttaagaatgtttac

SEQ ID NO: 3952 - DNA, 2394 bp, Zea mays
  misc_feature (1)..(100): optimal_loci_349425_G1, chr10:145353829..145356222, Cluster 24
ttatgatacattaattaatatcactagttcatcaacatgtactctcacgcggtttaaaattgtaggatataagcactagttattgtttggataatttatattaagactctattacagacctctaaaactaatatatagttatcaacaaaaattagcttagaggttcggatcgattaggtaatggaccatctaattgttagttatacctctcaaaagctattatttgttagctgctccagtccagttaaaactagctaacaacttgttatctaactaataattatcttgggaggtttggaacattcccaaaatatagtatttatttatcatctaacgtaatacacataatagatactttagagtctatatgtacatgtaattattaatctttttttgcaaaggactggattttatgtcttctcatcaatattcattttttccttttgcattatatctctctatagtttgaaacatgcaattaatttgaatcctatcgctaactaaggtggctcttgtcgcatcatatagtcatgaatcaatttttgattttataaaatttattcttattatctcaagttaagttaaaaactcgtgtgtttattgaatgtttagttaactcttgtttttacacttctctagaacaaggattttaagtcgtcagtacattcataaatactacaatagcataagaaattgttagtaacacgcataatatcattcaagataagtcatagagcttgaggtgagatctaggatcaatgtggtagcacaactaaccttgatttttttaatagtcaagccttaaaatggctgaccttttcctttaaagtaatattaaagagcttgaaaaatagatccatcaatgatcacccacagttctcacttccacttaattagggaatcatatatgcaattatggctatactatcaatatagatgtgtcaaaaactcacttaaaatatctaagtaaatctaaactaacaacctatatatagaaatagttgttatggaaacaattttatcttatgcaacataacatatatatttattgcccatttatattggcacgatgtgcacatttactttaattaaattttaatgtattaatgttgatataagtaggcaatgtagaaacatatatatggtctatagtgatctaaacaattttattgtagtagaagatgttaatactcgatttagatgtagatctgagtggtattcgattttctacaataatagaatgaaaactgagttatgtctattatttattacaataggaggtcattggtaattagatacaaattaaggcctacgtactttagctatagtgtatttcttcctaatattgatgggtaatttaaatatagagtcatgggttacgtggtttaaccgttatctggaggcacaagtgtccaagattttccaaagagttcagaaaactccgaatccatggcttgtgcttcccgttcactgaactgccttgcctcatcataggattttggttcaactagcacttcatcagttttgtgagcagcaatacctgcaatatgccgtattgttaaactactgaactgttaatgctgttcttcagcctagtacgcattcagtgacaccttagagaacccctcaaatttctctcaatctaccttaaatcgaacaagcccttacatggctggctgttggaccagcaggttgctcggtgtggactttgttctgcactttctgaagacagtggaacccgcagattcagattttagaagcatccacaacaggatgatcagtagcaatcttaattgacccggtgttaggtaaataatcctaaaactgggttacctctaggttatttgctgcctatatggagtgctattgttggattttcgtcggttaaatattgttcaatgagactgagtgatagtaagtagaatcgttggctgctgtgaggttttttgtggtgtatcgtttatttttggatttgtaaatatgtgtttttagttcagctccactactagttttgctccgaccaaaatgcgagagtaccatgtcactgtatttgaagacaaaattttcaaatggaacaatttcatatggcatgtaattggttggatactacagcaatactactgctcagttggcactacagcggcgcctgacatcactggctttgatatagcaaaactgtattgtaggaaattgtttatcattatatagaataatgattacatatcttaaaaaacacagattcagtgctaaaaaattccacgtgagtgaggtctacgaaaggattgatcaatgtaagcctttaaccataaaaacatagattaaaattcccacataagctaggtctatgaaaaagaaaaatcaaagcaagcctttcacggtaaaaacatagattaa

SEQ ID NO: 3953 - DNA, 3871 bp, Zea mays
  misc_feature (1)..(100): optimal_loci_349654_G1, chr10:146532753..146536623, Cluster 24
ccctggatggacagacctactgaacacaactgagaaagggaaacccttgaaagcaatagttctttgtgttagaccatgaactctattgcaggtttgtgtgacctcgaaggtcaaaattgatggaaatcattcaagctaacatttaccaccaaacaccaaggtggccacacttcctactattatagctctcctatcacaagaaaatcccaagcagggcaatacacattttggaggaaagtaaaaaaataattgatgtccaagattacgtactcggatctctggatccacaactatgtattgctttaagagtttgtcaccaaaagcacgagaaacagcaagtacaccaccaacatgccatgttcctatagaacaaaggatggatattaggagaagaatcatattccatagaacttgaagacaatacaatgactggcgtaccttcccacatcgcaaaacctccatcatcttcaatacggtgccgcgtctgccgctcatcagtttgatcaagtttgtgatcttttgaaacaacaatagctgcaaatcaagcagaacacatcaagataggaagtgatttaatggtgttacaaacgctgaaatctcaatggtagactcaactcctagcttagcagggcaaggtaaacaagggcagaattcagaccttaacaatatctaaaaaaattggaagaaaccatgtgttttagcaagataagacaaagcaagggtaaaatacagacttcgcgaaatgtctcaaaaaccatcatattgtggtatcacatagactctacaagcatgcattaagcaatgaatgaagcaaagggtatacattctaacatcatccttttttctaaatcatgaagagacttaacaaggacagatactaatagtcaacatcaagagcgtcgtaaaacttaaaaccataatgcaatgcattactgtaattgtagtaaattgatggaaaatcactgcagattgtaccctgtttctgtgttcaattgtcagtaaagaagttttagacgaaagcaaattgtcctaggtaactatattacgtaaaagtaacaagggggttcaaagaacaggcacgtgaagtcttcattaccatttccttccctgcatattatagccctagagtcaccaacatttgcgacaaaaagacggtcaccaacaagtacaacaattgatgcagtttacccacattgattttgactactgtcagattctaagaattcactgtcggtgcttttataagcatcatctgcagtaacacaaacatgcaagttcaagctctcatgattgtgttgtgttcacataatttagcaactaatgttagcggaaaaggacatgaaagaatacctatagcgactttagccacagatcggccctccagcacgtccaggttttggggattttgggttgagcagggtcggaagccgctcgagaggaatgggtttcaaggattcagagcagggttggcgctccctcgtcagattcaggcctcctatctggcaaaggtaaacttcatgtattaagaaacttttatttagaaaataaactgctcgatgttttttgtgggttgtactccatatattttttattgttggatttagattaatgcttggactgcgttatgcaaaataggcgaacatgtgaaattgcacgatgtatttttagatggaaaaaaaaaacgccaaagcgaatacgtgaaatcgtacgatgtacttttagatggaaaaaacaccaaagcgaatatgtgaaattgtacgatgtatttttagatggaaaaaacaccaaaagggcattgcaaaatggccctaaagtttgataaattttcacagcctaaactaaagtgcttgcacatgctctctggcttcaagtcaccacgagagtgttgaacctccaaggaggtgggatcgtgcagggccagccagtggacaggacttgcgctggaattctcttccaagtctctcccgacgctttcgtaagcacagaggaatcttgcggtttagctagctgcagcccaagcatattcattttcaaaactactagatcaggaggcgcacttcgtgcgccctacagtaaccatagttatgataaggcatatcaaattggaactataataaaatcttaatctgcggtaacaattagacaaagcaatatgaaatgcaagagaaacataattaagtatatctctaaagaacacagtaccacgcatgggatcatatcataacgcttgatcagatagagacgggcatgaacattagacaagatttgctatgaagagactaaatatctggcgggagaggtcttacattagacaagatttgccatcaagagatctaattacaaagaagaacctacacaaactttaatcttaggaattcaaacacctagtcgttataagaatctacataaactttaagcttactttttcctggtcatgtttattcaactgtcccgctctgcagcctcggtggccagcctcttgattatttacagaatgacagcacatcctcgttgcttaccatagaccatcacctgcatacaggaaaggaaatcgaacgaagttaatttgtctttgttcggcgatcagcagcattggctacaaaaggattatttctcactatcagggctgctactgccgtgcaaccttgctgccagtctttttggattatcatttttgacttccagtgaacaatgcttgagaaataattgctgctgtaagttgttgttcagtataagtcatttcaataacagtgtgtggctaaaaatatggcaaatggtcacgtctagagaaaaaaaatggatttttcatgttaaatatggtgaatatgaacatatgtatagaactaataaatgcataaacccaagtaaaaaacacctgaatctaaatatttaaaaagttccatagtaaatcaaatttcaacatactgcaataagtctggttgtaatagccacaataattaaatttctaactgcagctgaatgtccaacaaattatgacctttcctgctaggcatcatggaataactatattatagaaagatagtcgctcgtaatcaattagatgaacttttacatcaaaattgcattaaaaaatagaacactttaatcaaccaacaaagaacataaaagaacaattaaatacctgtgcctctgctctcagatgagtataaggcaccataccagtaagaagctcactgtaagttattgaaacagagactaagtctcagaacgtcatgactaatgatgctaacataatacttcagtactgaataaattgtcagatgtacaaagatgcaacctagttgaataatgtagcaaaacgtcttgcaagagcaccatgcaaaagcatgtagagttttgattcatagcgaagctggggatgtcgtgatttgaccgattcctaataagaggttatacacacacacaataaggtgagcaagcagctccaaattcctagtagcagctaaggcaaacaatataaaataaaagttatgaccaaaacctgcttaaggaaatctttctgcagcaggtaaactgaagcctcttagagctttctaggaacacctgacaaataacacaagtaatgagaacctgaaggacgataaatagtgaagtgtactaatcagtaagcatggccaataaaatgagaaataggtaacacgaacctttctgcagcaggtaaaccgaagccatatacaacagcataatcacataactacaacatctgctgataaatagtaaaacctttctcattcttgccaggctccacattcaccaatgaagaagcaaaatttcaatagaaactaaacaaaaacctgaactaaacaaaaacctggaacagacgcgtctgattggtgaccacataacaatt

SEQ ID NO: 3954 - DNA, 1497 bp, Zea mays
  misc_feature (1)..(100): optimal_loci_38417_G1, chr1:230125298..230126794, Cluster 24
gtgtcgtcacaacgtatgaacattgtactcgtttatgtatatgtgtcatgtgcatagtaaacattcacttgtataataatgataatcctaaatctataccactatataattcatcaactttaactttgtaaaacccacccaaccaaattacctcatacttataacatccactaaatccatcaaacaaattacacccagacttaacaaaccatcaaaaccaacagctcagattaccgaataacccactctctcttactcactcaaatccaatgaacaatattatttggatcatccctcgttcctctccttcatctgcccccgccgccccttttcccctccccatcactcacgccaccgctgtcgatcccccctcctctcctcgagatggtaacgttagcacgggctatatgctagtttacctttacgtttgtcctttatgtagggtgaattctaccaatctaaaacatatcccctaaatgttactatgtccctctcttttataatacaagagaggaaacatgaacctcatattcctgtggttaagacatatttaccctattattatcatgttatttgagttgtaccagggccacaccctcgatcgtggcaaagtgtaagagatattcttttcctagagattatcatacttgtatgatatgtcacagcaatgggtgtcacggcccatgccacctagtatgacatagttggtaatcggtgtagctttttgtacttgataatactttatggggcactttggctataagatcgatgcacatatcatatagtacctcgagcaccttgcaacctaggtcatgacaaaagcatgtttgttaggcttgtaatgtcataaatcacatatttgatataatatacttgagatttatctgttaagctaccactatagagttatcttcatgcctttagatgtaggatccctcttacgatggtcgtactatccctggtagaccagtcgcatccttccatcttgcaatagaactatacttagttatgtagagttccatcttgcaatagaattatacttagttgtgtggagttccctattaggatgttactacgagggctttttcaggtcccaaagggttcaaggttcggtgctcataatccaaagacgaggaccttaagaaccttaggtcttaggactaatagaggacacctagagggtgtttggtttgagaaaccactccattcaagatgagatgatgtatcatgagtctattactcaaatttggtgggataacctcattactcatgttagtaccaactaactatgaggaatgaaatagtgatagatcaacttattgtattccacaaactaaacaaaaaagaagatagactagtttattcctcaaaccaaacactctactagtagtgcctcgagtccaaaggctttaatcgcttattagtgtcctgaggcactagaagcctcaaaggcttagattattctattgtaggatgtcccgaaagactgatcatcgg

SEQ ID NO: 3955 - DNA, 1606 bp, Zea mays
  misc_feature (1)..(100): optimal_loci_41528_G1, chr1:245883041..245884646, Cluster 24
taacatggatagagttataaatacgtacatcagaaatccattattattaacttatagatgcaaaggtttaggttagcccacgaactctaaaatttgatttatgggccgataaacttttggagtggttcaccaccaagtccaaatccctttctttgaccctcatctcggattcaacttttgggttcataaaataaacttttaaagtagttcatcataggtttatatctcttcgtttgcctcttagagctaacatgtcacttctgatttaagggcaaaataaaagggtatagacttgcgatgaacctcctataatttgtatgcaccccgaagttaaatctaagtgttagaccaaagggtctaggacctagggtgaaccaatttaaaagttttaagaacccaaaaagtcaacttttagagttgataaacctataatcgaaacctcacctttagtacatttaccttatagggatattagtataaccgcacggtttatgttattgcttgatcagtaagatatatcgggaaaaacacatgtatgtactatgccctcccttatgttagtgaattgataggtttttgttgttttaaataactttgaagagcagctatataacaaattagttttctgtcaagtattaaaaaccaccaccacccttaatttcctacaaattaggtgttgtttggttcacataattgtaacgtgactggtaatagataatgttaaatcatatttatttaagtccaaccctaattagatatcacactaaaaattaataccggtctattcaaacttattacctctcgtgaataaaaaaaacaccttaagattttcgtcgaccctagagttcaacttgtaaacggcatatcgttgtatacgccacttgtttccattatttttgtaacctggggtgcgatcaatgtgtcagcataatagcgcatctgccttatcagtgcgcgatcgtacgttgtgttgttatgtctatccttgggatagaatgaagtccataagacaataaaatacatatatacatacatacatgtccgtacatgtaagtggcaaagtcaaatgcatgagcaagaagacagaacatgtgaatgcagttgctacactagctagtttataacaattcaacaaaatagagtatttgtaaattagcacgtacgtattgcgctttgacaattgaaggacgaaagatccaggtatatatggactcacgtcatcacatgagcgccaccagctcatttgtctagatctcaagtcaaactcctccatcagccacgaaatttattaggggcgaaggaaagtgtcatgccagatgaccatacaaatgaagtcaaaacatggaactgcgcaatctagccgccagcttggttggccttaatattctagttttttttttgtgaaagctaggttgctgatgatatatcaatttaattagtttacgaatcacagccgcaatgtctatcgcctggcttaattaagttggccttgcaacttgatggtcagaagtgacatatattaatttgtagaagtgaccatcttaagcaactacatcttggaattcaatttcaaaggaaaatttcctaagtggcctaatcaataagt

SEQ ID NO: 3956 - DNA, 1575 bp, Zea mays
  misc_feature (1)..(100): optimal_loci_41929_G1, chr1:247761446..247763020, Cluster 24
ctagtttggaatggctagaaatctggcagaaaagttggttctcatgatctcaacttgtctattacatttgttctctttataatgccttcttggcattgtttaatttttcttttttacttcatccatgacagctttgtttcaagtggttattaggcttcatggatatgtctcaggagcaagaacaagattttggtatagtgctgaagcagggggcagaagtgatggatcaaaatgtgtatataaaattgaaattgaatttgatgagtatatacaaattaaaatagaatttgatgagtatataaaactaaaactgaatttgatgagtatataaaaactaaaactgaatttgatgagtatataaaaactaaaattgaatttgatcatgtaacaagtgaattgcattacaagaaaaatatgtcaagagttcataatacagagaagtgccatagaacatgaacatataatatcaatatggtacataatgccattaattaatgatagtaacatatagtaacatgcaatagctagtaatttattgggggaaggaatggccaggtgataaaaaaagaggaggaagaaggatacattgtcatatattgcagtagtaactaatggtgatctattgctctaggttttaaggatacccatatgcagtcatacatagattctgctcaatggaacctaaaagtttaaaactttcctcataaatcagcttatccgtgtggttcaacagataatgtttagtaatgtatttgaattccatttagcaagactcttccagtacattcactatttttttgaggctacacatgtataaactagataatccattcctaatataagaacctaaactgacacaaccaatggaaaatagtaaatgttaacatttgcaagatacactttattgtggacattcaacaattgacatcactctatgcacaagagcaggtcctattggtaatagatttggtgaaataatgcatgtaaaacagatttgaacccccttcaggtgaacaaaaaaatatgaaataatgcaagatatgcagaatcgagttcggatatgtagttaaccttaggagcaagcttgaattctggttctagttctatctgtatcccatgctactaatgactaatataatacacatctatgcaataacattactttgcaagaactacatttgtactatgcaacaacattaacagttcctagagaaatcattcaatgttttcagttcttacattgttgcattgtaaaatgaatttagcaacagaaaatttagactcatgactatcatgccaatataaatataatgtccctcaggagtgaggctactaaatatacaagagttaaatatcatgagttaatatcatgctaccaacatgattcatgctactaacaggattcatgtagcttttgtctttagcaattgcatacacactagattaatggttacaattgaaacaatatactgaatgctacatctacatgcctaagagcagatttctcatgccttttgctacattatactagggtgggcaattggtactcgagagatagaataaacttaatttgat

SEQ ID NO: 3957 - DNA, 1794 bp, Zea mays
  misc_feature (1)..(100): optimal_loci_42985_G1, chr1:253306878..253308671, Cluster 24
catcaccacctcattcctcataagctaataattaatatatacacgaggagtaggttgattctaccaaaattgatggaatgaacttatgatgcatcacctcatgaagtatagagtgactccacaaaccaaacacaccattatcctctcagtcccctccgattcgaatgcaacggaacaaatcttaagtgtgaatatatatgtgtggattgcaatttggatgtatataaggacagtcggaaaaaagaaaagataacaaaacttctcgaaagattgcatgcatgttgtttggctcctctctctaaagtttagttcgtgttatatcaaatatttaatattaattatagatattaaatataatcataacaatatttaataaatctgtcttattttttagcctttatctatgtaatttattttataactagactaaatttaatatatttaattatcgtttaaatatttaatgtgacagtgactaaattttagttgggaggaacgaatagaatggtaagactacgctgcaacgtacggtctaaaaaaaaacaatcggagtagcaatattactagtaccacaagttaaacacacaggcctagctacgcctagtaaaggactactactatacccagccaagcctatagctagctaatttgacttcgttgtgtgtgtgtgtgtgttttaagaaaaagtggcgagaaggtttagatgatgttcctgatgtcgacacttgcatgccgcgcggtgcggtgctccatgacgcgcgcgaaaaagaattgtttttgcagctcgcaacaagcaaggtcgtgtcgactcgtgtgctatcccatcccagcccatgcatgagcatgatacgctccgatccttttgtcagcatcaagtcgatccaaattcaatctaccgaagctagctagctagctacgagccgtttattggtgttaactaactgatctagctagctgctctgcctgtcttgaaatgacgaacgcgctagctagaattaatcaagcctgattcgtcgattccctgtcccactactgctctctgctgtccatgcatgcatgattagagatgcatgcatccaaaactaaattgcatatagactgactgatatagatcagagcagcttcccagtaccgtttgactgttggcagagatgccttgtgttcctgcaaccacttacaaggctagctagctgagacgtcgtcgtaacacactgctgatgattgggctgctgctggcctgctgctcatagtgtgcatgtgtgtgtgtgtttcaactgtccatgactaaactaaacatcatatactattctcgagctgtacgtgatgtgtactacctgctgttggtgtcgcccccggccaaccgaaaagaaaattcctggcggtctgctgcatatgattccgatcgacggatgcagtgcagtgcagtgcaattggacttgtttggctcggctgtattgaaaatgctgcactctgcatctggggttcccacgactagactaatagctagatcagagcaaaggtttgcatgcatgttcagtttgttttctgttttcaaagatgccatgtgtcgcaatgacctcccacatccagcgtatacgtacctacaaatgtgtgtatctgccggtgtgtgaactgcgaaccatatatatatgcccttgtactattcgactttcttcagtctcctgtcgaatcttgattgtgtttctgcatacggtttcctgaaaaccgtgttctctcgatcgttgtcatcactgctaatgtaagcagctaaactttagccttggctctcgttgt

SEQ ID NO: 3958 - DNA, 1534 bp, Zea mays
  misc_feature (1)..(100): optimal_loci_43764_G1, chr1:257462099..257463632, Cluster 24
aaagtttatcatgcttaccttatttattggaatttcatttaacacacctttttattttggtttgtttttaaagatggtacgtacgtgtttgactgcccataagagcactaaaggatggatctacatcgcaccctcatagtctatgctaccaccttccttcgagtcggatgtggaggaggcactattacacgtcacaatcaaggacaactctggtgatgccaagtttgatgaatggttcatagatccaaatgaggacaatgagatgcaagactatgagcctaagaacctaaatagaggtttgcttgggtggttgagctgaatgaggataaccacccgaaagtgtcaaaacacaagaaacctaggtatggtgcaagattcaaatggttgtgaatattagatatttgatgaagttaacaaccccttggaaggaacagacatatcaaataatgatatataggaggacccccaagagcccaatgaggactatgactctaacaagatggtggagatagaagcctcgtaagccctaacacaagaaggacctgcaccagaagaccctaagcctaaggtgccccacctaaaggaccatgcaccagaattacctcttaacctaggatggagaaggaccgtccacaacaatgatggcatgactttatagttcccacatatgttttgtaacatactcgtcgacttagtactaatgaacctccaagttaactacattggaatacaatactaacacattaagggtagtaccagcccaagtagatggtgacgacagagatcaccagtgggacgagtatggcataaggaatacaatgtccacacattatgctctatccatttgaaacaactctgaagcaagaataaatgatgctaccaggatagccatgttttcattcaatgatctgaatcaagggtatatggccagtagcatcaattggtactatccgcaatgcccatccgagagaagcatcatgataatcgcgtgaagggtacgatagtagaagacaacatctagatggacacactagatatctgaagcatcatgataattgcaacccatccaggagaagtagttaagaagatatctaaagagtttcaatgtgtttcatccattgagttggcaggaatttaccaaattgctcttagaattgaggttttctccacaactaacaaaagataaaacttcatgctcatgtgggatctgatcaatccatcttgtagatgtgatctcaagtattcatagcatgtagagaaggaaaaaatgatcaaaatgcccacgctgattggagcaccaaaacacaaaaaactggacataagaagaaaaggagcaaacaactcagaagattgaaccaccaagaacctaggaggtatgggcctccattcccacaaacttcaatggttatagagtcagattacatagatgaatgatttttgtagtgtctaaatcatttgtcactatggaacaaagggtcatcagtaccagttgagaaccggctataataatggattcccaaccaatactgagcat

SEQ ID NO: 3959 - DNA, 1921 bp, Zea mays
  misc_feature (1)..(100): optimal_loci_46198_G1, chr1:270730961..270732881, Cluster 24
ctgacgacatctccatcagcatcaggcgtcagcaggtaatctgcaagactccgtccaccactactagtactgctttgcgttctaaaatatgaacttttgatagcaaatagcatttacgttctagaatctagatagctagtagtacttagtcgtacttacgttctgcatatctaggtactagctttagatattaaaataatttatttatttggagttggcagactgctcacttatacgtttttgcctatttattattagattggccattggtcatttgcttcaagacatggcaagcaacagctggagtgaagaggaggaagagatccaagaggtcaatgctcaagcaaattcagagcagcagcatgatggagccgtagagccagatgttattgtgactgtgtgagactgaggttcaatttctaatgtgtgacagtatgagactgaagatgttattgtaaatttgttatttctgaactcattgtaccatgtaatcatctctgttgttctgagctgtagtaaaatcaatattatattatattacttgatggcattagccatgtaccccctccagtctgcactgtgcagacatgcacacaggcgggctcgggccatgattatgtattttctatcgggctacgggcggtttggagccaaagtgttttcatgttgggttttgtgtggcccggcccgacccggtaaatgatcaggtctaatatcatccatatatcgtcgtgtcatatcttttccactactgataaatggtgtcggtagaactaatcttttgcccaagacacacatttggttttttgcttggtatagatctacctgtatttttgcttgaatattgagtcaatacttttatacagataggtcaccattgagatcggacacaacgactgtacaaatagagcacacatcattgttactaagttttctatgatacataattaactaagtatatattgtcacaagctaaaacacatcgtcatctcctatctttcaatccggtatcacagttggcaaataatctcatttgatttctagaaaattgttgacaaaacaagtccttggatttttttatcaacgagcgtcgaattattgtaattcagaacatgatttctaagaacacgattattttgaactatatcattttaatttttaacgattttgtaataaccactcactcttcagtccgtgtgtagtatgatgatctgggttgaaataaacgttgttgtggtccgagcttttgaaccatcctttattacgatgaaagagttacaacaataatatatgtgattactaaacataaaaattaagtaaatgttaaaagattttagctagagaataaattaatgtgtctcttgttacgtcacaacatagttccaataattatgctcttgttaactttagctaactctgaacgcagaacattttttttgcaagaggtcagaccatactctcacgatgattagattcaatgttttttaaaaactgtcgttatgtaaagtcttccaccgatatgctctaatgactccaaatgaaaaactttgccaacaatatctgcaatatctgcatgcttgcttagttaaatttaaataaattttttgcttctatcaatatgattataaaccacataaaaggaagggtcattatctagaaatgtctcattatatatttggatgacctcataaaatagtataagatgatctagatagggaggaaattgtattagaatgatgaatggctccatattagtacatttccgcaatttcaactatatactatgcttaatattctgaaagttaagatcgccgaatttggatcgaacaacactcttttcaatatgtatagagtgtcgtccggtctaaactagcagatcttaacttttgaaatattaggcatagtctagggttgacattag

SEQ ID NO: 3960 - DNA, 1846 bp, Zea mays
  misc_feature (1)..(100): optimal_loci_49165_G1, chr1:285097516..285099361, Cluster 24
taatttatctagggaatagggatggaagaagtattactggctaaagcctgacctgtgtagaataagggcctcacaagaatataatatcctacttgctccgtttcaaatcacaaggtgttttagcttctttagatacaatatattgctacgtgcttagatgtacattatatctagataaatagtaaaagaaatatatcttgaaaagccaatacatcctataagtagagtcgagggagtaacatcttgaatcctatgcgcataaaactacaattaaatatttgtttgattcaactatatatgagctgtgaaaaaataaataaatgtgagataagtgcactctggaaaagttgtagtctatttagttaaaacaactgtaaaaactaccctctatttcttgatctaccttgaaacatttctaaaacaactttgtatttccatctattttggaaaaaacaaaatctaaacacaaaaaaggtctaagatgttaagaaaactgcactgcattaaagcagatgcttttggtattattaagttgattggttttatggctgtacaagcactcttcagaagctgaaccaaacacagccggaatgtttgaatggaccgtggaaaaaacaaagaaattaagagaaagagagaatggcataaggtatacttccataaggtctagtctcttaattattagatatccttagaattccctatatagcaaggcaatctatatgatttataggaccctaatcctttattgaaaggagtttataggaaaccttttctatttcctatgattttctattcaaaataaactaaattatgtgaaatttccgtgtttcaaatcggtgctagaatttctctattttttttgtttcaaggcgtgtgtttgtgtggggtttttttctctctaaaaaatacaatagtccaatttcttttgtcccaaaaggggagaggcaaaacaggtgctctacaatatcgttagagcatcaaaaatccaaaccagaaaccactgtaacatgagtacacgaagacaccacacgcaaaggtatcttaattggttgagacatataccgtgtgtttggtttcttagatgtacgcgcccaggtccgttgcatctgttgactgaggaagtgcacctgtttggttggctgtgtgatggagctctaaactgcacacgtggatacaaagaaagccattttaggggacatgggttgcatccgcggagatgtgggtaaggtctcgtcccgtatcccaccacatgcaggcttggatggggctacacgtctgcatcgggaaaaccaaacacatagatagtctcccctctggacatcacaagtcctattaaaaatctctttgcgtggttaagccgcttttttaatcatactttaatttgtttttttgctgggctcgacctgattaaggattttggaggcgtctgaaccatcgtaataaacggttggtgcagctgcagcacacgcaacaaaaagcgcccacgcacgggtgccttggctttgaccaccgccacttcgcatgcatgcagttgcgctgccatgttgcatgcatgtcaacgtcaagaatattgggcatatatatgagctaacctatgaatccatttaatgtccgttccatatattcctctttgtctccactacatttgcttttgttttgtcaataactaacaacacctccagctatatgaatcccacggcgtatccatgcatgctactcgtgacttttgggaactactgaaaatactaataccatcccttttcagaaaaaaaatgattcagtgcgttaggctatctgcaaggataccccttatggctcccctaactatatgtagtgaaacttg

SEQ ID NO: 3961 - DNA, 1891 bp, Zea mays
  misc_feature (1)..(100): optimal_loci_49365_G1, chr1:286368594..286370484, Cluster 24
agtgccaccctagaactagctagttacatcaaacactgtagcaatagatgaggtcgacatgtaggcatgcgttgcttgctgggacccactgaccctccgtttttcgtggttaatctacctggtcctaagtcccgaagtccttcgtgttgaggtcttcgtcttcgcctgtcggtccatcctctagtctggcgtagaggaacgatctccttcgcagcacccaggtcttcgccagggtaaccaccgggagcaaagcccttgaggtcttcaacctcttggaccaaaaaaccccgctttgattcagacccgttgccgatagatcccaaatggcatcttcgaacccttcgtgtcatgctagggcgacttctcgtgcacaacaaagtcatcgccattcgaatcttcatgttgagacgattttatgcgttcgcagacaaggtttgttgaggttggagacggatgaccgaggtctggttcgaccatgttcccagcatttcccatgaagtggattgtagtctaacagcacatatgctatgtatatatgggcactagatcatccaggacatgcacaagagcgacaatagtttttactaaagaaatgagagtagaatagttcctttatgataggagaacaagaaagtaagaaagaagaggggagagaaaaacatttgaagatgcaagaagcgaacatgacacaaagtgggtttgtgttgtttaacacatgaatggtttatttgtgcaacaaatatgatacatatttattttggttaaatcaatttgtgctaatacgattttttaagtttccatgaattttttagcttacctttggtacccgatccaatttttagcactaccaatttgcaataataactatgttattttctgttttcttgtatatgacatgaaaggatatatatgcaatattaagtatattctattgcatatgaaagaatgtctaatgtttgtttccatgaaccttatgttttatgttagaaaggtgtatcttgcttgatgtgatatatttaatgtaatattaattttaatcaagcaaatgatgtgacaataatatatattttgggtatcccgatcaagttcaagaagatacatatggaatgggctcatgggatcggtagaaaacccatggagtcagaagcaacgaccagaaggaaggcctatcagcagggggttccagaaggttaaacatgacagagatcttaagagatcttatctagatcaagttgtactcatctcatggtggataatggtaatacagtagtaaataaaaaccaaggaacaaaggaaagaagatgaagaatccactttatgttagtgagggacaaattcataagaaattaagatgccatttttgcaagaaaattggccatttcaagaaggattgcttgaacaggaagaaatggttcaaaaagaaacatatacatcattatgtttttgtgtgcttagaatcaaattttgttgaagtttatggtaataccttacggttattttgtggtgctactaatgtttcacatattacatagggatttcttctgacccaacccataagcgggtgtaaccagttcttgtacatgggaaataaaatgaaggcatgaattgaacagatcgagacatcgaataatcctcgagaccggtctgaatgtagacttgaaagcgtgtctttgtgttcttgaatgttctagaaatcttatatctacaagctagttgtatgtaataagcttaaagttcatggttggtcatggtatgtttcagttatataagaacaaatactagtatggttctattattttaatttgatggtttatatcatttcaatcttgaaggggttttctaaatccctatttaatgttgagcatgttgttggaaataaatgtagtacgca

SEQ ID NO: 3962 - DNA, 2164 bp, Zea mays
  misc_feature (1)..(100): optimal_loci_50154_G1, chr1:291563015..291565178, Cluster 24
tgctatgcttgtcagagggtgatgttaaccatgggctgctatgcttttcagtggtgatgttaaccatggctgctatgcttcttatgaactttaaccccccaccaaagtctgaaccaccccccatggaaacccaagaagaacattcatactgctcttttgtaccacactagatagatagatgcaagaattgctgaggtgagaatgacaatgtactctccaaacttgagagccacacattagcaaaagggagaaacaaaaagccgccattccatggtgaatacatatatctaagtctaagccatgcatgcatggttctccattattacaagagctactctaattaggatgcatgcctgccacttcttgcaagcctccaaggatgagccctgtaccccactgcccccccttgtcctggtttaaagcaatggtcaaaaggaaagaaaaaaaaaacttgtgtaccctatatatatacactgaactttttggtattctattgagggtgacactagcatttgtctctttcttttgcatttgtttatgcgcacgtagtagcttgcaaggctgggtggtgatcatcagaggcagtgtttttatatatattggcatctttatggggaggggttcaaaggcttcatggacctctaattcttggggttatagggtagttagtacaagcatgcaaccgccaagactatatccaattccaagttggtagcttgtttaagaaggtgagatgcatcattgcttctgtacttgttcaggacatacccactagccaactctggccatctcaatgtgcggcaccaaaacacttagatccaatagcgaaaaaacagtgtaaaaaacaaatcttatccttcagtttgttactttgttatatatataaatatctgaatgagtaacgacaaataggtcaattaatagttaaattaaaaaggtgccaaatgcagcgtcgtctcgagctgataatcatgtggtcttacaagccactatgatggggtggtgctatcttttagcctttcttgacgttggcgttatcttgtgagaattccagatcgatatccttgacaatgtgaggacgcacgcatcttgatgccgagctagggctaggtgtagctagttccatcgcattgtgacagataatctctctgaaatcggattcttctaatgtgacacaaagcagatcaatgctcattgcgataaatagttacggcgccactacaaaaatggtttttagacgcagcctccaattccaaaagaggctcttttacaagggtggatatatatgcaaatctctccaaaaatcagacaggggcttcaaaaaccttttttttaaaaaaatataaatcataaaactgcaccaaaagagagaaaataaaatcctcgtgccctagctcatggcagcaagcctcctgtagcacattttttgtatgaaatacacacggatgcgcctaaggattgagaccttcagactcgtgtggaactacttttcaccagcatactgtatagtcacacatgtttagattttgaataatatgtactatatttaactttgaattttttcccgcgtctccctcctacgcgcaccgccagaaaactacaaaattaagtacaaaacctagagttcaaaccctaacctctctctcccaggcttagcttctaactattggaacacaaatttatttgtgttctacaaaagatagatattataaatattgtgaatataaaaatcatagtaacacaagggtaaccgattgtatccttttatatcaattcaccaattctttttgtatatctggtcactaaatgttctcaaatgaaaaatatcaactatatatagaatttcagatctcaggcactagaactttggtatagagaaaattgtttgacatattcaaattttgaatttaaaaatatgagaacttataatgaatatcacttaaatgatctcaattggaaaaggattaatcccacacagttctattgttttaatacaaaatttatcttaatccggctttatttgtaaaagttatgaacttagttacgcaaaaactatttttaggtgcgcttgtcctttaaatttcattttagagccaatccaattagttaactatttttagatgcgtcatatttgcattgtgtctaattggatctcttgctcaac

SEQ ID NO: 3963 - DNA, 2306 bp, Zea mays
  misc_feature (1)..(100): optimal_loci_52977_G1, chr2:6319459..6321764, Cluster 24
cacagagggagtataacgtaaaccaacatgctacgcaaaagcagaaatacatataaaatacaaagtgagcagtgcaactaatggaaataacatatatgtgaaatagttgtgtccatcattaatggaaatttattcttactagcaaatgtgtccatatattaattgcaccgaacctaatatatcttggaaacaaacttcgtattatcacttgacacgaattggcgagttgttctaattcatataagcacaagacataaatacatgtcacaatatatatgtcacatatgccatatagatgaagtaaaaaaagcgagatggaagaataaatgaccctttacttaaaaaagtatagatatatagcaaacatgagcatgctacgctatgaagtaagctattttttttacagtggtgatttgtttttatttgtcttttagttgatgttatgtgtttgtactttaactttttattatcggtgaaatatatgtgataaccaatgaagcaatataattagccagattgtgttatttgaggactaaattttttattaatggttataaaagtttacaacactcacggattgggctcacttatcgtcatgtataagcctacttatttatttatttttcttctctgctgcccttatatatatcctttctccattctcttctttcctagatagttaaattaactttctttcacaaaaaataaatctacccgctaaccaagtacgtctctatctaccataataagcatatagaggtggaaaaagatgttgtgggcatgttgggcaatgtcttgttgatgcttagggggtgctcgcgactgccgctcctccaccaccacttcaccagcttcgccttctcaatttctcatgcatgttctagctagcctatggtgtctgaggttgcgatatgaaaggtcgatatagattcatcaccgtctgacacattattttttaatattagaatagatcgagataaaaagttgaaaatatgtactataatacatgtcatctaatgtgtgcatatgcaactggtaagcaaaaggttaccgactattccactacttacatgtatgttctagtaactccaaacatcaattgcattccgttatgtttgtagcatgcatattgcataactaatttgttcaaactgaggtgaaagttttttagcagccacattattagcaataactaagattatgtttggatcatctagagcaaatagagagcttttaagaaaagctatagctgatccaagcctgattgaatacccaaccatccaatgacccaacgaataaaaaagttattaccctggcttcctagttaatgcaactaattattagctcggaggatccatagtggtagtttttttctaattgtttgggaaggggaacgatattgttatcacgttttttacaatataaacttgcattatatgccatttattggcacatcagatgaatcacacaaattatcaaatggatatagttaatctatttcaggggcaaagccagaaattcatgcatatagcaatcttacttgatccatggcgacatctcctatgaatacacataattgcatattctataatggaaagtgtctagagctttatatttttgtataaatattaactcaacatgagtgtaaaaaagtgaatgtggctctagaagtgcttgctattggcataggttagcgtcaaaaataggaaacgtatgaagaaacatatctagagcttagaaagcacatgcatatatggaaccatgattcaagagttagggttttggatacttacatgagtgctgagtatcaccaattttgagatgcatatggatgttgagtgtcaccaagtgttcccccaaacacttcgcattacacataatcttgaaatgagttatttgaatggcgcctcatgtgaagtatttgaagggaactcatggtaacatcagacattgttcaaaattgtatcacatggtatccatgtggccatcatatattataatataactaaatgcttcgtgataccaagagttctcccccaaacacttcacaattataccctttattaagccaaggtatcgagacgtgcttgtagggaactcctagtaacacaaaatgttgtatagccttcaactcgtatcacatgacacatgacaaacatctagcacatgcaaatgatttgagacaagagttcccccaaacacttcacaaaagctcttgaaacaatgcctcgtgaagtgcttgcatagaactcctagggacatcaaacctagttcttacaaaacgtgccatgtcatccttaaatcat

SEQ ID NO: 3964 - DNA, 2594 bp, Zea mays
  misc_feature (1)..(100): optimal_loci_54128_G1, chr2:12635610..12638203, Cluster 24
ctgacaaattacaacaacataaggctcacagttcatttgctcaccctgattaaccttatccccaatgtagcccatcagtcctctcccaacacaagaaacttttagatttcttgtttcttaaataaatcctaaggtacacggtataactgagagtgtcagcatttgtatacaggaagtttcggtattcttctagtgagacattatccaacgtgtccttctctggtacacttcccttttatgccgtttgcagcaaagaaagtcggtggggacaaataaaacatggaatcaaacattgatccaaatacaccaagcataccatctaagtcttcctagaatagtctcttagcactctcattgtgtcgtacttgggggcaaactcactaattacgttcaagaccaaacacccacaagaagcttgactaagataattctatccacctactttctcgcatccaccacaacgttattgagactcttattaatcaaaactccaccatttctatttgcagatgtccctatgctatataccaaagcttgaagttgatatttcacaagacaagcaaaattctaaccataccagtaaaaacaatgaaattactctaccaagcattgagatccactacacaattaaaaacacaaaccccgtagtgattcttcgcaaatatattaacaatatttttttcttaagtaaatgcaaagcacatatgaatgaggaaaatgaaggatagaataactaaaatgagtctatgcccctaagaaaaataatcccaattatatgagaattcaagcctttgcttgcaaccagataactgaaatcgcaagaagcaacggtgcatagctaatgagcaagcaccaaacgatgtcttacaacaacatcttaactgagcatgtggtcctggtggtgtagacgtgatgattgagacaaaccaattttgctatctttgaaataccgccagagaccatgtatccaagtatgccatcaacaacaacgagaaaaaatcaagcaacatggtgtacttcctacttcaatgcagctacaataatcagcgacctagatccaagtatgtttctgatctggactctgaaagtctgaacaattccaagtcgtactcttacaccattcactcaatgccatcttgcaggctataagtcttgtattttgagtgagcagtgtagtatactaataaaaaaagcacaaaaaaaggaaatgtgttactgtcttcctgggtatcctccattaattcagaaaacataggaaagctgctttcaacgcaagcttataccttctggaagcatattgttacttgggagttgtggaaacatggattggctacagaatgcaatagctgacatgttgctctgtatctgattttatgttaatgtgaataattagaagagcttctattaatatatagaagtggggaacagattgcatcaaccaataaccagtttatacagtacagtgctacatcgttgtgttggggccagcaacacatgaggaagatgttaacaagatactggtaaccataatatcgtcaaagcattgttatactaaatagtccacaaagtcaagacttaagcttacacatgcaaggttaataaagaagaaattttcaaaacaacaataatcatgcaaagttgaataatttgttgcactgacctgtgagcacaaagattatatgtggttactttcaggtagagttccttcacctatgtgtattccccgtcagatgatttattagtcttttttgcatccttctctgcgatcacacatgccatttggacagatccaccaccatgatcaaccactccaactatgtctacataaatctttcccaaatttcccaacagataattgatagtaacctataaagagagaagagtaatacatattacttgtttctggagtgaagtctgaatataaaaggaaacatacaactgatttctaaacacttccacactaactgtgaataaatcctaaaaggctaaaacctatatcttactcgccttgttgtatttaaactaataaacttttacaaatctacaatgttttgaaatcatactctatatggttcttcagaagattgacagatggtaggtacgtttacatgctagttacgtttacactattttttgttcaccgccatctcatcatgtaaacactaaaaattcagaagtccaaaattgatgtcaaatgaatatactcacctctgctgtcaatttttgtgcataatcccctcaaacccctatgacagcctcatcgacattggccacgtgtggtgagcatggaccccctcaaaacccttcttcctctccagcactatctccatagctagactcctccgatccggcgtgatattattaggtctttcaagttcatgttcaccatccgaactttcctgtaaagcatccaaaatgagatccaatttggccgtcctacagtaaataaaaaaagttcttgcatgattatcacctccaatttggtcatcctcattttcaatctaattcccaatttggtcagtttctgccaaattggcaccattccctgccctgtccctaggaacctcgttccctcatcttgcttggacaaacaa

SEQ ID NO: 3965 - DNA, 1747 bp, Zea mays
  misc_feature (1)..(100): optimal_loci_54829_G1, chr2:16394676..16396422, Cluster 24
  modified_base (1020)..(1020): a, c, g, or t
  misc_feature (1020)..(1119): n is a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
  modified_base (1074)..(1074): a, c, g, or t
  modified_base (1075)..(1075): a, c, g, or t
  modified_base (1076)..(1076): a, c, g, or t
  modified_base (1077)..(1077): a, c, g, or t
  modified_base (1078)..(1078): a, c, g, or t
  modified_base (1079)..(1079): a, c, g, or t
  modified_base (1080)..(1080): a, c, g, or t
  modified_base (1081)..(1081): a, c, g, or t
  modified_base (1082)..(1082): a, c, g, or t
  modified_base (1083)..(1083): a, c, g, or t
  modified_base (1084)..(1084): a, c, g, or t
  modified_base (1085)..(1085): a, c, g, or t
  modified_base (1086)..(1086): a, c, g, or t
  modified_base (1087)..(1087): a, c, g, or t
  modified_base (1088)..(1088): a, c, g, or t
  modified_base (1089)..(1089): a, c, g, or t
  modified_base (1090)..(1090): a, c, g, or t
  modified_base (1091)..(1091): a, c, g, or t
  modified_base (1092)..(1092): a, c, g, or t
  modified_base (1093)..(1093): a, c, g, or t
  modified_base (1094)..(1094): a, c, g, or t
  modified_base (1095)..(1095): a, c, g, or t
  modified_base (1096)..(1096): a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
aggctgggacagctcatttgaaactacctgtatgtgatacctacaacaactcattttttgccattcttttcaatttagttgggtgatacttttaaggaaatgtctagaaaattaagtaacacaatgacattttaaactacgtgtgtgtgatatatatagcctatgaatacctatttcagttttgcttacttcatattaattgacagttgttatttggctcatgaccattctatttgacaacaagagacaagcaaatctaatgtttacagttttggtgtgttgcttctagaaattgttagtgggtgataaaaaaagtaacaaaaggttagcacataaagattagatactccttgaaaaggttatattttactctagattacagttaacatgtattttcgtcatctacttgcatagttcaagagtttgttttttgtcattgctgatttaacacactactttctattatccaaaaatagtatgatggtgcatgatttggggcgcataaatataatcaatataatattttgcattgccatatccgtatttctcttcttagacaacgtcataagacttgattagtgctacttacaccacctaaccaactcagctagagggccgtgggctgtcttagatagagttttatctagatagtgcatagcaaaagctatgtatcttgaaaagccaaaacatcttaacacatgaaatggagggagtagataacactaggaatattaattggtttgatattgttatggttcacatcttttagttggaaacaatccttataaacctaacattgaccaccgcaacctggagtcctggacattcattcacgtgtctacttatgttgtttgaacatggctacttatatgttgttcgaacatgattatatttagtggtaccatagacagatttagtaggtttggatgttctaaattcgtccctctgtcgttcggacatgattagatgtggtggttgacagatacctgtagaacgaaattcaagccttaaaatacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatcaatcaatattataaaaataccgaaattcatgacaatttatatagtgttgatatttgcaatgttgccctggttgatgtcaccttttatgcttataaccattttgtctacccatgacttcctacaatatttttacatttcttaattcttgttttgtggagttaccagttcatttaaagattatttggatttatctagctatttttgagcttacttgttttctacttgtacttaaaggcagataagctagaggagaaaagaagtaacaaatttgatgctggattactcagttaggatagcaataactcatacccctaaattccttagattgccacaatgagcctgagtgcaagaatgtggtctgcaattcgcgggtcagggagtcatcgttggcctcattgacacaggaatagatccaacccactctagctttgtagactatctatcaactgatagttatccagtacctgctcactactctggcatttgtgaggttacaaatgattttccatcggtatcctgcaatagaaagctcgtgggggctcaccattttgtagcatatgcaataactagaggagtcttcaatgcgtctcaagatctttcatcaccatttgatactgatggc

SEQ ID NO: 3966 - DNA, 1534 bp, Zea mays
  misc_feature (1)..(100): optimal_loci_59466_G1, chr2:42961900..42963433, Cluster 24
ttgaggctagtgttcctttctttgtggcgattactggaacgtccaagaagctttgtgagtggtttgaacctatctaatctaggaatggacaaggaatactcttaggactgatttagtgaccagagaattggaggggatccatggagaggagatcacttgctatttaaaattgagggccttgtttgggaacactttattttcttagtcccaagataataccatgatttttatgcataccacagtattttataacaaaaggtgtttggaagcacatctaaaaactctgtattttaaaccatagttttaccaataccacactattttggggtcaaaaaaactttggtctggaccaaagtttttggcttgcaggcttgcacgcagctatagtcttctcttctcctacactacaactgaaatattgtctccaaacaggtgttggattggactgatgtaaaatataccatagttatgtgttataacatacaataaaatgtggtattataaactatagttttgggaaacagagttcccaaatgggtcttgaatagcaagggatttcctctctcatggatcccttcaattccctggtcaccaaaccagaccttagtggactttaggccttgattgtcgtgtagagcttagtagtgaatgcttcagtcttaactaggtggtgtggtagcacctcaacaccacaaaacaatttgatctcttcttaaaactgcattggccccaagtggattttggtgtattaatgtcacacaatttagaatctaacaagttctatgatacatagttatagttgtcaggcacacatgaaaagttgtgtatacttgtgcatcaaatgagagtcctcaattgttctgaatttgaaggcttcaaactcaatgcatggaaggcttgttatatttttttgagtttaagaaacttgtatcaccaagacgtgtgcaaattcttgttgcaaatagtgctcaagtaactcaaataaaatatacttaaaagagcactaaagcttagcactagacacttagtttagtgtttggaagtctgccatattggaagtcctgaccctagattggaagctctgatgtatgtcaaaatcctagaagaagccacgttagattttaagtcactgccaggtcagaagttatgaccctctgttggaagttctctttgtctagtgtaagaggtttttggcattagaagtttcaagatttttagaaatcttgaatttcgtagtaacagttagaatcgaaggtgagtataaatatcttctcccctctcctttcaagtatcacctcgaacatttactttggccaccctcaattcaaagctcctatagagcattcaagtctccttccactttccttctttctccccagacttagatttcaaacaagggtgagcggctgagagaaaaaggcaactaagcttcatctttttcgttcaatgctttagtttttcatctagtcattacactttaggcatcgtccatctctgtgatgcatgattatcgctacaccacctgcaccaatag

SEQ ID NO: 3967 - DNA, 3278 bp, Zea mays
  misc_feature (1)..(100): optimal_loci_5983_G1, chr1:30281327..30284604, Cluster 24
gtttgccatgaacctattcacaaggctagcatccatagaaaacaaaaccaatatatgtcgtacagatccatatgtatacgagtagtttgttttcatcaatattttacggggtcatgcacccaaagtagtatatttaatgttcatgtcattgtatatttaaagggttatcaatgcgtagtattgcatttgtttttatcacaatttttttttggaaatggaaacatcgttccggccttttttatgtataccgagtagtttgttttcatcaataatttacggggtcatgcacccatagtagtatatgtaatgttcacgtcattgtttatttatagggttaccaatgcgtagtattacatttgttttttaccacatgccgttgtatatttgtgttcatgtcatttcattgcattatatttgctggtacattatttctaactgttttcatgtcgcatatcaattataatagctctgcttacaattattggttctgtaagaatttttttatagtctattcagcattcctttagccatctaggacctttcatagttgatgaagtgttaggcccactcactaaaacaacactttcaatatacctatttcaaaggatgacatattattaattttaggcagaggcaattacaaggatcaagagaaacaaacatgcacttacttcactgttgttatcatactctaactcaagcaaaactctaggtgtaaggaccgttgaatctctacaatcacatagagaagggttctcaatcagttcgttggtgtctttggtctccgcgggatgtggaacttattgttgagtgtgctcgtgtgaccaacgtccaccggtcgttagaaagaaggcaccctttgggtcaaacttttgaggaccattttgatccacttaaaaagttgcatctctccaaatcctaaacaaaacaatgccacaatctcattaatagtttataagaaatagcaagaaacatcgagacgacatatttgtaaataactactgatacatatagaagcgtcgggtacctgtgtctagatgcgtcgactgattcagctcctcttttgatttgtttctggatccgccaacatggcatggcgtgaacaataaaaatggagagcacaacgaatgaggagtgcagggtacacagccgtacagggcatacgtacctgaaaatgagagagccgcacctgaacatcgccatggatgtggcagcctcggtactctctcccagtgccctgtggcttgcaaattttctagtgagcgcgagcatgatgagtgccgtgcccgcgcggcgcctgcgcgcgcgctgatgcttccatgtgcgtgcctcaatcatgcacgcacgcagacgcagacgcagatgcaggcaaccggaattcccatgggggccactagacgtaccatcctactcctacgtgtcatgtcactggattagtggctatattattactattcgtttcgctttccgccagttacctgcagtgcagccagcggcgccatttgcccgttaaatttaaactaatcggcggcgcacttgcctgagcgtcaggcaaggagagtggggcggggcaccttttctttttctattaattagctggtgatgtgaggtttgctggtggctggaggcgacagggacaccagacattccatggcttcagatctggccccaaaacaaatgcaccaatcgcaccgcgcctttgtgctaaagcaaccgggcgggcaactttttgtcaggtcatgtgtcgcgcctgttcccctaaagataaactaatggcgatgtcgacatgctttgcttagctttagctttctctctccaggaactttgactggaagatgggccgtggggcgcccccccaaagtctctgcgggaggacacaggaattgcctcttgaaattaggacgtaaaactgctttggtttctcctcgctctttacggctctgttgatcaccttgttcagaaaatggtgagagcagggggggcaggcagtggatggagaatagaaccgcttgtaccttgtactctagacgcactattctttaattacatccatccatcgagctgctgcgttcattcaaaaggaaaagttgacgcgcgcactgtttgcagattccggatccaataattccaagagggacagcatgagtccatccatgtctctaggttattatagctcccctccctttgtagccgcctcgagctggagagtagtgatcagcgtacgaaatccagttgctcattctctctgaggggcctacatgttccataccatacgtacgtgtgtgtgcgtgcgtgcccacacacatgcttgcacgatgcccacattttccctgcagctaagcgctgcatcgccatcttcctccggtcagcaacagctaaaaaacaccaacaccctcatggattagaattcagagccccatttgccggaacgctggtggaggtgcgagagatggagagggatagcaaattaaagtagattgcccattctatcaagaggcgtcgtctctgccttcgattattattacgtgtttgcgctgtgtatacgcatgcatgcacctcaaccgtccggaattctggatgatcggacaagacgatgagatggttatctgacgacgtcggaatcatctccttcgcggagacggtcgatagatgtcctgatcgagcatttctcggtccaagagaccgacgtatttgattgagctcgaccgatcgatcacgcgccggctgttccattccaaagccccatcatttcggatccagatcacggccggataggtgtgcagtccgtccttggtgcaggtcaggtcaggtcatgactcatgagccttcattcgttccttgcagcaagcaattcatgtccctgttgcttcgaaggatacgcaaggagatataatttgcagcttgacgataacccagaaaggagagagagagtcggtcagaaatataatatatattgctgtggctgacagcaacaaacaagattggcagcaaccttagaccattgcatctccagatgcagtctaaatgaaatgtacactatcggtctgatttgttgtctatatctacaaggcatttgattcattgacgatgtgttcttttttagaatgtctttttttttgtttcttgatggtgttttgctatttttttttttggatctgtaaggcggggtatgcaggacactgtagaaggctacaacattttgtttttattataaaaaaaaatctcatcctaaaccattacatgaattgactctatatgaacgtatgtttggttatctg

SEQ ID NO: 3968 - DNA, 1615 bp, Zea mays
  misc_feature (1)..(100): optimal_loci_72848_G1, chr2:128584592..128586206, Cluster 24
ctaaactagaaccatgaaccacatagcatatgcagagaagtaaaggaattcaacatataatacaaaccttagattttgtcggtggtaatggaacaaggaactacttttcacaaaagattagctatatagaatctaatagcataggataagcatgtagaacaatttatacaacattagccgcggttgaattagcaggaatttacaaaacttggatataacttactttatatttggcagccaagacatccttcacgattacaaaattcacgtccatagagtgtttagttagcaaatgacctcccatggctgttactagttcttcaatcctaacctgcaagaataaaaacaaacttgagataaatattaaagtattaactatcgaaaactgtaacctgtaacattagcggcactgatacatgtaccttctcagacttttcaaagcctgaacaaagtgttttaaccccatccattgcaagacaacacgtataactttgtttaggtagaaagcgacgttctttagcacaggaaagaatgcactgtggtcctgtgcaaattcaaaaacattcttaaatacaaaagtcaggaacttattagaagattggctgttatgatttcaaccacatagaaaatttatgcactgcaaaacaagtaatgttttggagtccaaataaacaagaaagcctaatattttttcgagataaaaagataaacagaaatgtgatcatagcttcactgggcatgttctggagagaaattacatagattgcatcaacaattttcatgatcaagtccctagcgactcaaataatcttccctacaagtttcggcactaagcatgaatggtgcaaccaacttagacaagcaatataccttaaacaggaaccttctccgttctcccaagacattaacaaagtagagttcatagaaagcagtatattgcgcatgaaactaaattttcaattgaagatagtcttaagtcttaacaaatcaaatgcagcagtgcagcaagctctgtacaacttgaggtaataaataagatgtctatctgtagtgccccaagatcccatcatgctctagcctacccacacatagtacaaatgatatatacacaacccacacgagttttatcttctttccattttcacacaaaagggttgacaggaggccatcacctaggattcttacggctttatatgtttgttaagcccaacattagctagcaaagtgctgactactgccattcttgcaactgttatcataataacaaccctaataaagattaggttggggcatctgataacaaatttagctccatattgcaaattcagcacaattcacctataaaattaaccgagcagttactttttaacaatctggcacactaatctctaagttagtacaagttttcgcgtatttaacacacttaaccaatataaccctaccgttaagttatggaccatagattcacaaattgctgaaattcgataatgcagcttccaatcgtcacaacattgtaaacaatttagcctaatttaacttgaatctggaatgattccagtagtcagaaaacaaaaaaatgtgcaaccatagggcccaattccagaactgtgcagat

SEQ ID NO: 3969 - DNA, 1641 bp, Zea mays
  misc_feature (1)..(100): optimal_loci_81064_G1, chr2:177442956..177444596, Cluster 24
ggattttgtataggggaaattgttggagacaacctaaggaggttcgggtgctgctgaccatttcaattgcccgttgacaatggcaagctacaggcttccttcagattcacgaagagcatactcaaatggtgaaacaatgtacctagaaatagttgatgtaatgtcatccatttatcgaatactatacataaattacatgagtctgccgactggataataagtgtaggaaattggtcaagttgatttcaacttataatctgttgcaaaatgctatagctgcctacagaaacataactagacttgaagacaacttatcttggaacccttcagccacccaaagagtatcacagaaccacatgattggcagttgtccataaatgttcaattcaagctttgatgggacaatcacttttctagtacttattttatcgtcccattaacttggaaccaaagggtgtatttaattcgagaatactatggtatgttgatgctaatttattttaaagattttattatgttttaattctaccaaaggtaacttagaattgaaatatttttttagtattatgcatttttaatttaaaccaatgttacatttttatatgcatgatgatttaaatttcaagcaccaccatctaagatctcaaatgctttgaacacaatctttagacttaaaaacattaaatagatctaattatcccccttggaaggagaaattaggcatgccactggcattgactaagatagattatgtcattgataactcgaagcttgttggtcctgtgttgtcaacagaaggaatgccaggcagctaatagtgtagagttgacaatgatgtgtcgtctcgaatgtgttaagggtgagaaatcaaagaagaaatgcatgatggtcattataagccctatcatataatctataaggggagcaataccagaatgtcagagtggcactgagtaccttaacaagattcaacaacaattcaatcattcttctaaagcatatgctagaaccataacaaagaaaattatagatgataagtataatggctttggcatgagggaacacatactcaagatgaccaatcttattaatacgcttaaatcttttaatatgaaattaaaaataactttgttgtccacttaatattagtgtctctactcaaagaaattaagacttatgtcataaactataacatgagtcctaaaaatggacgatgcacaagttgattgccatgtgtgtccataaagtggacaaatttaaggctatgaagactggcaatgtgaatctagttaagaattcgtcataagttaagggtcaccccataagaaacaatattttaagaagccttttgaccctcaatttgagaaccaagataaaaatatttatgtctcatcatggaggcttaagctcaaatgaatatttttttcaaagtcacataacaaggaaacaagtttcattgcagaaaggacattctccatagatcacccagaagagataaattatgacacctgcagatgatgttgctagaatgtgcatcagatgaaggattatattcagttcctcaaatggatgaacaagaacaataagaataaaattgcattcatagatgaactatgtatttagatttgtcaatcgatactt

SEQ ID NO: 3970 - DNA, 1437 bp, Zea mays
  misc_feature (1)..(100): optimal_loci_84980_G1, chr2:198861988..198863424, Cluster 24
aaagttggcggaagggagggcggcagggaaaaaatatggcaccatgttggaaaggggccgggaaagagagtgtcgcggttcaccctctcttcctgctttggagtcaattattccttcaagtgccatcctctctttaatttgtctgatttccgatttgtccatgcttgggaaagaaagaaagaaacgctaggcggctagggcttgcgtgtcctttacatgtttgaacgctactgctcgttcggggggctaccagcatcttgatggatgctttttttatttacagagaagctacatctcgctctatatctctcggccgagcaattcactttctccagtttttcattccgtttgaacaccaatagaaatagattaacaataagcaatgtccatgcacgacctcattagttcttcgtcgatttatgacatgtttgtttaccttctaaattatataagttggattatggtgaaagaatatataagattcaaatatcactttggtaacacaaataagctgaaataagatagtagtttattttaacttatttgtgatcacaaagtgatatttcatctttctatcttttttctataatccaactttcaacttatataatcggaaaataaacagggcctaaatgcaacaaggtgcaagaaaaagggcagagacattagggataagcaggtcaaagaactaatgattgtataaatacagaacaacaagtagggcttcttgccggctttgatctagtctccattcctttcgagttcaaagccaaaggtccctaactagattcctgaaatatggacttggagacttgggtttgggcttgagacggggggccgtagggtagctcgtagtagcacaagcacagttggccacctctctctagggggaacgccactgccaactgaagatggcagggttatggctagctataggtagagctgtgcaagtggagagacttaaaaagttacagagtttgctattaatttggggtattcgatcaaatcaggtggttgaagctagcacccactctcacctgatggctgctttgcagaaaaactactagaattaacagcatacgacgtacatatccagtacaccatctattcatatttcagtacaatcacgtatatgagaactaaacagacatgtttgagacaaaacctcaagttttttttctaatggtatgacacatataaacagtcaaccataacgaaaatatatttacactacgcgcatggcagatggtatatatgaacaaaaaatcgacaaacaaggatatcgaaattatttgctattaattatgagctaatcatgcatttgagtctggttacaccatataaacagatcatctgcaaatgattgaggagcacatttacaaatgaggtgggtcagttggttgaggtgtgggttacttcattaggtttttttccctt

SEQ ID NO: 3971 - DNA, 1878 bp, Zea mays
  misc_feature (1)..(100): optimal_loci_85651_G1, chr2:203904620..203906497, Cluster 24
aaaacgtagcgagaaaaggtcatatttatccactcgaggtcgttttcgtgagaaaatattttggcaggcggatatcctcaacctcaagcattcgatcgatggctgcgtcttttcttccgccacttccacttgagatagctaggcaagcgcaagcgtgcgagtatttcccccaactccacccatttccccctttttctttctcttttttcccataaatgaatccatgtaatcgagtggaaaggaatagtccttggagctagcagcctagcaatcgagtgggtttattttagtaaaaaaaaaaagaatttcagttgaagctgacagagggagcaaccacatctgaaaataaagctagagttcaccggaaccgtaccctctctagtttctaaccaaataattagcgtaattttcacaagattggcatggccatgaccatggtcataccatatggcatactatcagtttggatcgtgaatgagatatacgaatgttttcttttgccattgattgatcttactattattaactaaagatcctcatatatagaactctccacgtttaattcttatatatacacaagaaactagtccaatacagtacgctgcgacgacacaatcatactaatactcataaaaataaatttagtatcatagtgaacatatggttcacatatcagttattaaaccgacaagatcaaatattacactttattttaacgacaagatcaaaaaagaataagacgaaaagacaaaaaaaagaatttaatatcatagtgttttaaaagagaacaaaaaaataaattttagagattctcgtaaaatttacatacttttggcactagttcgatagactcctaccataattttaaaaataaccattggaactatattgtactttctaaaaacttgtccattctttattataaaatataatataaattatttttaaaaatctctactctttaaagcactagtttcgtgcgtcgtgccttacgtgtgaagcgcgtaggtctttcctctccttagcttcttacctaacaatgagtccaataggctattagattatagatgagccatgagaaaccagtcaagtccaacacgataggaagtcatatgcaatgcaacggacccatgtagtcccacctcgctagctaaataaaaaccagcgaccaagcaaactatataaaaaagttgagctccgtttcaacttttttttgctttacaaactttgctcctagcctcccacataaactatagcaaggagctgaagagcgccaaaacaagtctaattactcactcgcatcaatctactaaagacgagaagtctcccattttgtctagagataattcattcaaaagtcatctctaaatataatttttgaaggcggacattttatttacggagatcgtcaaaaataacatgctaaaaatagcctccattaatagaaacgaagaggtcatttttggagagacactttttaagcggccgggctgtcacacagaaatggtataaggtctaacgagggacaaaagaaccatgacctagataataaagtaagattgtgcataactaactagacttaatattgctattgaaaagtttaaagatctccaaaaggaagttgttcctgtgtaaacgagagacttaatattgctatcgaaaagtttaaagaactttatgaaccccaaatctataataaagctgctctacacggtagagagttagatgaatcttgatggatccgaaactgacgaagctctaataaattggtcatatatagtggctcacctgccggccgtagtagtgatagtgatatatacacacacattgatggttgatcccgtacgtcatcagcacagtggggatcggacaaatata

SEQ ID NO: 3972 - DNA, 2099 bp, Zea mays
  misc_feature (1)..(100): optimal_loci_8897_G1, chr1:46922382..46924480, Cluster 24
ctattagcatctaatggatctaaataaaaatatgagtaccaaaaactaagtgtctctaacgcactcgagaagcgtttcaatttcccatgaatagaaaaccggaaagggtttgtttgggagcaagtgaattggagtgtaataaaggagctaaaattcctctattattcaaaatttgaactagattgttcgtacattgctactgtttttatatatcatataggtagatcttgtttaaatgatatatttattcaaacacgattatatttttattttcaattattagtatacgtatacatttacaaatctctccttaatataatataactagacatgagttatagtgatagaagccaagcgctttttaccaaattaatgttcgatggagtagacgaaatacgaagaaactcacacttaaatatagtaaagatagtaagggaattttagccccttcaaatctcccaaacaagaaaaaaaaagtctcaagtatatggtgttatcatgttaatatgttgggtcttcgtagcgttaagataacatttagatttctaaagttgttcatagaatcaatatttcattaaaataaactctgacttgacatgacaacactagcaaagtgctcgtacatagatatggttttcatttatacttaactattgaattcataaaaaacaaagatatatgtgttatgttggctagtgtcaggtggatgtgaacatgatacatgagtttagagcaaaaagccttattagtgcataatttagcatttttagtatttatttaaaaaaaatataaatgcggaagagcacgataatggtggaatcggtgaactaaaaaagctagtaatttaatagtcctcgctgcgacatgtgattctcgtagcgtttctggtcgagaacctcacacgtgtctaggttgccaatgcaatggttccagtagatccaatagtatataattcatcgacgtcttcctattcgccacagacttgcagtgacacgcgccaatgcagatctactctgcccagggaagatctggcgacgggactgtctctctgagatttgactcttggttagagacgattatatgtttcaccctctatactaaaaaatacaactgtacaatccgagtcggtttaaatgatttaagtttaaccaaactcgtacagtcgtactagtaaatagtatttacatctataattctaaaccgatttagtataaaattttgtttggtatttaacttaataatatttatttagtattatagtaaatattgatatttttattatactgatttaagatataaagtgcctcccaccgccggtcgccgtcaacggaggcggcagtgccgcccagaaacttgcacgtaccctagcggccaaagggcagatctccatttctttatcacggtttctttactccggtccagcaggccacttgccggcccgagcagcggcgctggtgcatgatgacagcacaaaaaaatatgtatatttcatcagtccaaaaataattaatgtttttaagttctaggtaccatactgttttaaataaaagagtcaaaacaaaaatttaaataaaacgaacagtcaaataaaatatctaaaaatcaaaagcattaactaaggtgaagcagcacagatccgagatttctgagagagatctttccggccgatcgatgctttccgtgtcccccttgcccgccagccgccaggtgtgcctgttcgcgtgcaccgctgctgccggaatcagcgggcaggcgtgagcatgtagcgatctcttcctttttgttggctttcttttgctgccggcaagagacggcggctcggggcggcggttccgcgtctgcttccggctgcctcgttttttatcctcaacaggccgggcaccagcaggttgcatctgattttctggtcgtgcaagggacaccggcaccacgcctggacgccggccatacccagtcattatccaccaaatactcaagacgtgcgtgcgtcaatcgaacatcaagcgcggtgttacatgcaaatggcagcgttgtggatggcgttgttgaatcgacaaaattgcacgtggatattggcaactgaaaacaccactagaaga

SEQ ID NO: 3973 - DNA, 1581 bp, Zea mays
  misc_feature (1)..(100): optimal_loci_90016_G1, chr2:226636654..226638234, Cluster 24
tagtatataggtggagccatatatggggaatggatggagacgtgtatgtagggggggaatcttttaaagaaagatagtaaaatatattagaaagtacagataaaggatagaattaaagaaaaatggttggagataggctaaggtgagctgcctctgctgtgtgacataataaataagtaaataaagatacaaaatcctttctcttgttcaacgtcggccagcacgatcgtaggtttgaacatggcaagttaaattgtttctccctacaccatttcaatctgagtctatccactccttccttatatattcttccattcattgaaactcatgtagaaataagaggtgattccagttggaagagttgtatttatcacatgcatgagtgtgcatgctgatggcaatatgtgcagtagcacctgctaggaattgtcagctaaaaagaaggtagtttgtgggtgcaccttttggttttgttctttccttaggagcttgcttaacttaattaatcttagaggaagatttttaattctatgtaaaactgttcgtgaatttgtataattgaaagtatgaagggatgcttccggcttccgttgtcctttgactgaaaaaaggtgatgcaagtgtaggttggggcgttgggcttacctttgagcattcagttcttgtactttaaatcgatatgcacagaaaatcagaaaattggtttatgcagtcaactggaatatttaaatgctgttgcaactaaaattgtagcagtgggagatatatttgacaacaaagatgataatggcgagaatatttgtaagaaccacaatattcgcgcaacaaaaattgtgttttgggaagcaaacctgagccaagtccttgcgggcgttggagaagttttaagcatgatcagaccagtggggattcaaattatggaggccagtcggcagcagcagaacctaccaaaatggtcaaatatcacattagaacaaagaaaacatacatgcagacgtaacagttcatgacaacatttattattatatgaaaaagattaaaagagcatatacagatagttttttcttttcataaaatatctgtatacacagtcaaataagaggaacggctaaatctggcaaaggcaaaatccatcagggcatcccacagaacaattatcacaaatgtattaccatattatgaaaaattccttaagagcttacaaggacacctagatcataataaacatatccaaggactattatctatctaaaaatttagtgttaggtaagatattcaaatattcttctcggtaagacaagttcctagtagaagcatttttgaaagcaaacaaagaaacacataaaattcttaaaccagcgtaagatctaagcaccattcagtatcggcagaaaccaaatgacagtcagaaaccagcataaaaacatgaactgtaaatcctaaaacaaagaaatgtatgacaggtaaaagatatgttttccttatgccaattaatggtgattcgtagttcaaaccttgctgatagaatcatctgaatcatcgcttcatcggtacaacatttatggcagtcatccaccagct

SEQ ID NO: 3974 - DNA, 1831 bp, Zea mays
  misc_feature (1)..(100): optimal_loci_91493_G1, chr2:233395855..233397685, Cluster 24
  modified_base (752)..(752): a, c, g, or t
  misc_feature (752)..(851): n is a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
tgatacgttcggttaccattatttgaccataaaccaccattccagttcattaaaaactatacataatatcataccagtccagtccagctaagaattattccggacactcaatctgaaataaccgaacatggcctcaatctcgtctaatccacattgattaactgccacttgagtacaaggacttgttagacagagaaccacttgctcacagctcctttctaatcttgtatctgaatcgatggtttttgcaactgaatttttagtagacgatcctgttacacaaaaaggtgttacaaatattgacacctaagtgcaatcaaaataatataagaaagtttttcccccacctctttgtgaaaaaaaaagattgcccctttttttttctaaaaaaaggtggtttttctatcatttagcccagtatgaaccccactttccccaaaatttagagcgaaaagtcgaaaaagggagggccccaaaagggcaggccatcaaaaaaaagggaaaaaaaacttttgcccattggggggggttctaggaattccccaaaaaaaaaaaaaaaagctggggaggaccaaactggggggtttatttggtccacccccacatggtgctccttcttgctggggagctttgagaacccaaaccttcagcagggttccgctggtgaagaagggtggcgctatacctaagggtcagtctttaaaaaccctaaataaaggggacggggggtccggctcctccccctgttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatccacattgattaactgccactttgattacgaggacgtgtagacagagaccacatgctcacagctctttctgagcttgtatctgcaatcgatggttctgcaactgaaattttagtaggacggatactgtatacacgagaaggtgctacaaaatatttgatcacctagagctgcaaatcaaatatatatatagagagagttttgtcaccccacctcgtttgatggatacaaaaaaagagttgcgcctattttttttctgaagaaaaagggtgtgtctctctcattcagtttcagcacagtactgaacccacgttccctagattctagagccgaaagtcgagataggaaggccccaaaagtgcaagccatcaaaaataaggcaaacaaacatatgcacattgtgtgtgatctaggaatttctcagaaaaaaaagatagagctgtggatgatcagactaggtgggttagttggttcaaccccacactgtgcatcgtcttgcatgtgagctatgagatgccaaatcaatcagtcaggcatcagctgcgtaagcaagtgtagcgctaaactaaaggatcaagtcgttacaaacactaaactaaaggatcgtgtgatctgctactctcacttgttaaacttgcatttggacaccgagaacaaataatcactctgtttttttttacacaaaggaacttttatctcaaaataaaacggtgttgtcgcgaatgctacttacttagcccatgttccaaacctattaatagatagcagctaatgttagctaagaggttcagaacggattagctaataactagctgttggttatatctctcaaatagatattagttgttagcaacttcaatccagctaaaaccgcttgcaacttattagctaactaacaattagctctagagagttagaatagggccttatttggctatggcactacacgttctgtgtgactcgcaatgagtagatat

SEQ ID NO: 3975 - DNA, 1719 bp, Zea mays
  misc_feature (1)..(100): optimal_loci_93248_G1, chr3:5772762..5774480, Cluster 24
tatataaagacacttctagtataatgacatatcaagtgtaaaaatggttatgtactaacaatgctagcattaaatcatattcattggatccaccatctacggcacacacgcatcactttaatttttttctctgagaaacctgcattgctgatgaatgctgaaaatacatattaatctcttgtatgcatgcttcaattcctcgtgtattttgaccacttaaacttgctggcgcatgcatacgaaataggtgtatagtgtatatataatgacactgacagcgagctactgattataataatgtgtttacggtgggaaaaacatgttctaatgattggttcacacacatacacacacctgatcgaatcatacaaggccatcgtcacgctgaaatatttgaacgctacatgttgaagaaaatgggggctgttacgacgtgtagtaggttaaaatttttctcttgcgtaagcgagtagccagctctgtttgctgatgatttttttattgggtcattttccacgtagatgttcgcggcagggtgttgtacttctgcgtagacacagtagcaatgccgtatagctaagcatgtagagaatttaatttctggtgcagtttgcatatagggcatgcgcatgtccgggtgttgagatttcctgatcgcccccatatcgttccaagagggttaattgggttgagttatggctgattttttttttttcgaatatccttttgaacacgcaaggagtacaagtagttccccggatggtttgaatacgaggacgtcagaacccacaaaatatatctcattattacctaatcagataaactaccgtattatgccatcgggattgattgcattgtcatcgaacaagatggtcaaagtaatgtgcatatatatatttatttaatttgtattactagtgtaatcgaggcacgccgtacaatacgtattcggacctacctatagctcgttagaagggaaatagtgtgaaaccagatacagttccacgataccggttcgtaattaattaagcaggagagccaatttggctcgatctgggccaggtgtgaatggtacggtgaagatagaatttccttccactcaggtcctgtttggtttatatataactattataacctgacgagtaactgataatgttaaatcatgtttattttagtctaaccgtaataaccgacactaaattatcacactgagagttctagcttaacggtccctagctagttcaactttatgtctccatttagaagatcgagaatcctgaaatctcaaatctagtttcaagcattgtttttgttgctctactccacgcttttataaaccaatggaggagagaaaagattacatatattggctggactatgggccctgatcatatgtggcctaattaacaactccttatgtcgtgtcatggtatcaaggaagattgttgcaatggtagatatgtgtcataggggtaagcatgtcctatcatatcaacggatactgtgtagtccaaaccactactgtgtaattgtgatgtagcagactgtactttataatgctttccggtactctagcgtgtccacacgtggctactgggatggcacaaataatcgaatagtgatcttgagtactatgtaagtcaagacaaaagtgcgtctatgagattgtactgtcgcacatcacatagtttatcgtggaaaaaggagacacatagttta

SEQ ID NO: 3976 - DNA, 1630 bp, Zea mays
  misc_feature (1)..(100): optimal_loci_93433_G1, chr3:6516051..6517680, Cluster 24
aagctttaaagtatcttattctgtctgagaaaaactaaatcaccacttttatgtggacggagggagtactatactagcttataccagcgtcctacgcccctaccgaccaacaaaaaagaaatatcaaagcgaaagcagagtccgcaagtacccttccgagtttggatccaaaaaaacgaatcacattaaattaactctgccacggtcacgagaggccacgcatgggtctcatttactccccactgggcgcagggacccacgcggcgcggccaatcaggaggagcccatgacgcggcgtgggcggatcagctttcacgcactgaggcgcggggcccggcgtccagctggcccctgcggcggtcacgccagtcgtctgagttggcacgcaggagccgttcacgcactctgttcttcaatgcttctcgccctgtggtaggcgggccacaggtccacataacctgaaggcacaggatgccgaatcgaagaaaaaaaggcacatactgtattttttttcttcattacgagtacatatgttcctaaaacgatgtaatcataggtctgtataaagttagactatcttcaatttacctaaattataaaaaataatgtcaacacatgttactccaaatagatattttgtacagttcatggatattcatttgcctaagttcgaccaacaaaaggggaatgtaataggtaacaaataacgttaaatcatgtttgtttaagtccaatcgtaatcggatatcacactacaaattgattccagcctattcaaacctgttaccgttggtaatcgaatgcaaaccattaccgttaccatttacgttacattttggaaaccaaatggcaccttagttgttcgctaatttatcatcgaaatatgagaactgcgttctttatggacaggtggactacgcggatattgtttctctggtttgagcttcgttgtggggttttatttcaaatttgacaacatgacactatttttttaattaaaccagatcattcttgaaatgattgtttataaagaatctctaaattttctgaaatatgttgctgacgaagtatggaatgcaatgtaaacacacatttttggtaacgatcacaataaaagcatgttgtcggcaccgatattagggcatgtacgatccacataaatgacttatatcttaagagtattttaaggggtatgtcgaaaaaacaaaagatatatcttggtgaaagaacatctttattatagttctctaagtctaagatacagtttcacccgtataactcatataaatgagtcgtgtcttgggtagttctagtgaatacgatacaagacttaaatacattgacttgtatgaacatatttttagtgtatctagtacttaaagaatcgtaacgtagtatctaggttatacataaccttagaggatattcataactgtcaccatggtcgtgatgattatttcactaataccacatatctcctgcttgttttcatgttctggttgacaaaatacataacatacactaaatgatctttaatctcgtgtggtttagtaaaaaaacttggatcatgaagggacatggctcctgatattgccttctaccctgtcatttctttgttgtcatagttaac

SEQ ID NO: 3977 - DNA, 1635 bp, Zea mays
  misc_feature (1)..(100): optimal_loci_93463_G1, chr3:6649638..6651272, Cluster 24
tgtgtgtgtgtttgtgtatatacatgcacactgtaactagcagtgtcattatcttatctgctggtttccctactgatcctgctgctgcacttgattggatgaaaggtgtccccgttttaggtcgacgtagctgttctacttgaaggtcgattacagtgtttgggctgttgctgatgcatccatcatcttaatctagctagaaaaagtaaattcattcattcattcattcattcattatttctttaattttttggggtgcatgtaggcacgagatggaaactgtatcagtacagtagggaaagcggagcaaccagcagtagatagcgaactgccgcgtggctcctgactatacaatacaataaatcaggtagtagatagtaagcatatattgataaaaatgcaagtgtgtttttgaatcctcatgagaattaatgatcgaaagaattttcaagcctcgtttcatttggaatccggtgggaaagtggtaaccaacgtagaattacgacgtcagttttttttttgattcagtagcgagagtacttacgtctcaacgaaccaaacaactcacaaaaaggaaatagcaaaccgagattcatctcaaacgtagtccgctaaacaaggtagatactataggtgtggtgtggtgtggtgtgccgagcttggaccaggatattctagaccgaagattaagaaacctaactgatgtgataggatgtgataataaacaaagcgacaatataaagtagttggtgttgggtgaagatatcatgtgtgtgtgtgtataaataaatagccgtctggcttctgttgtgccagaggttatctatatcagataactggcctaaaggaacgcttattatgcaagcaaagcattgctatcaaggttaggtgccaaggtacacaccatcggcaaaaaggtcatcaccgtaacaaccacagcaggagagaggtatctagtgcacttcgtaccctcctagcggacgtatcatcatacacatcgctatagcttgtagaaatatcataccggtttttctactatatatatatctgttacccttttattatcattgttatctccttgtgtttcgttttcggatgacttataatatgagctggatagggtattattactcctatctcggtctgctagacacctaatctgccgtgaattccaacttttttgctagtggcgttatcctgtgttttttatggactttattatatctttcttctcactcactcattgagtagacccccaaatagcaggtctctctttagtgtttagatgactagatttagcgagtggagaacaatgacgttcgtgttaactcgcactaaaccaaaagtaaagagaaggctccaaaagaaggagtctcatccagactaacaaaattgtagtcgcctatgaaccagatcccttctttttttgttcacctgctctgtcctaaaatagttaacgttctagatttctagatgccatgcttgatcatttgtcttattcagtttttttaaatagtaaaataactaagatattattaaactatctttaatctcaactacttattaaggttgtaagctcaacttcttattcagttttttttaaatagttaacgttctgccgttctgcggttttgt

SEQ ID NO: 3978 - DNA, 1841 bp, Zea mays
  misc_feature (1)..(100): optimal_loci_94635_G1, chr3:12877829..12879669, Cluster 24
tggactctatatttaaaattgatactgaagctagtatcaataccagttttaaaacaactagaacaaaacttgttgaactgaagcccattctctagtagtgcatggtccatcatcctaggtaatatatatagcagtgttattcgtcaccctagatgaaataaattacaaaaaaacttaaatttattaagttattccggggtagttgatcacctaacgtgataaataacaagcacgcacacacgtacatatacataggtataacgctatttgccacctagggtgatgatcatacaccctgaaataacttaagaaatgagttataaagatcatgaatagcttaaatttgttaagtcattttagaataggtgaccatcaaaggtgacgaatatcatttctctctatcaatcacgtaacagccttttatgcatggtttccagagaggaaatgatgacaaacccttgcttgtttgtttatttgattacacacttacacggcatggctgggacctttttcgttccatgcacatatatatatatatgtcatgcggcatcattgtacatgttgattcggactatactaatggcggcctagctagggaatggtggggcctcccacgtcttagggcctcctgttaccacgtactgtaaaagagagttttagtgtgaggctatacttgtctgttcttgccttcttggagaccgtgacctcgctgctgctctctttcttgaggagttcccatgtttgctctgttgactactcgaacaattgacttggcttttctcctttagaaaagtttaaaatgacccatagatatatatgtagttctggtccagccagcacacactattaattgttacagtggtcgtgttattaataattactgtacgtgttgtagtagctgtacagtttcaaaactgtgtaatatcaaaattagtgacgatcgatcttatatacacggtatatacaccatagtaatttgtttaagcttaaaaaaatgacaccttttttgcttggtttttttggacacaataaagaggtgtctctggggtatgaacacacacacactgtgtactgtcacttgcttggcctcagtgatctgcatgattgttggccagactggactgtggatgccttttgcaacttttttttagttttgaaaactttgctgcaaccagcagctagctagtaattacgtttgtgtttgagatgcatgtatgtacgtagatcatgatgatactgattatatataagcttcatcagctatatatacgtacctatacatgacaaagatgacaaaatctaaacgaaagctatcatgctctgtaacagcggccatcattgaaggccacatgtgtacttggaattattttatgggcccctgttcgtcgacttgcactgcaaagtaatctctgttacgactcgttacacatgcatgacggtcgacacaaatcgactcctgctgtatcccttcatcagctaactgtgtcgaagggccagtacgtgtctggacgacagttcgaattgattccttcttagggcatttagtgtaaatttctccattttcagcagtaactgtcatggtgggattattttaattgctttattacctactgtatgcatcgatcgtgtaaatggatcgaaacattggcgtacgtgtatatcatatgtcttgttcatatttttagtttcgtaacgtatattcttcggattattgacgtagagtatggttgattcatgaattaccccattttctattttgagttaggcgcattacatacagttgaaatgattatgcttttgttcgtactactagaaccagggaattcaacatgaaaacttga

SEQ ID NO: 3979 - DNA, 1963 bp, Zea mays
  misc_feature (1)..(100): optimal_loci_94640_G1, chr3:12885415..12887377, Cluster 24
ggttgatggcttgggacaaaactagccaaaccgtcaaaaaattttcttttgggggtgggggggatagaggtagtaaaatgcaacttaagtacgatttgggtcaccattttatttgtcttcatgaattaaacttgcttgaaccagacgagcgggacgatacggtcatacggatgagggttgacctatataagccttcaagataaacctttatgcagtcttttaagccatcaaattccttctaataaccacaaagtaattgtatgggcattcaacactggaataagagataagagcctacagtaaaaattgtattttgcgaataatatgattaattgtattttgagattataccataacgcgttgccttgtgacgtatgtaccagctagctgttgggatatataatgacgctgaaccaactggtgtttttgtgatcggattactatgagaagcgtgcgagagcttgcggcggcttcaggcatgcatgcacacctttgaagttaacttttgacgttttagcgcctgaaaagggccgcgcgcgcgcgtcaataattctgccattgacgataggatcgaattccatcgtgtagctataggtttacgtgcgtttataagtacatataaacacaataatctcatacgattttttttctatctatctctatccgcgtaatgattggactactgttttcagtctaccgtacgtaccagcaattacttagtgcctaattcctagctaacttccaaaacttaattacgtgtgtgcatatatatgcatcatcatcacatcacgcagtactgttcgtcacattattcttatgcaccgaacagtagctatatattttgtggactgattggacatgtaatacaacacagaccatatacatgtcacaccaaacagtagctataggtcgatggtccatgtgaccaccacacggcccttcatgttggtcctcgagcaagctatccttaacgcatgccttttcttggcactatacatgcgttatttgtgcattatatttgggggggtccaaatcgaccaggtttgacattcacctggaagacaaatcaatgcattatttgtgccaattaattgccaactaatatggaatgttatgctgaaaggacaccatgtctttatgccataattatcctgattaatagaataatatatagcacaatctattggttggagaatgatgacaacgcgcgataggtcgggttggtgcctaatcacctgtcattcctacctatctatttagggtgcgtttagttgcaatgacaggacgggacagaataaaacgattcatcaaataaagttgtttggttaagaatcgggacaatactattacagtgttgtatcccttcaattgaaaggacgagagagaacaccagggaacgtccctgtcctggctgtcccgcaacaaaacgcaagatatgtcaaatgtgcatccacccataccatataaccagcgatgtacgtgtgtgtatatgtacagcattcgtatttaccattatgaaaactatacaatctttagattaataataacagtatgggtgcatcgagtggaggatggttcatatcagacgctgatgtgtgtgcaagaatcaagatttggtttcaccggtgagatgatgacgttataatctttttaagtgtatataagcagagataaagagaaaattgtctacacacagtatcaccaattaaggtacctatatgttttccattaaaaaattatgccgtttagttttctctatcaggtttagctcatatggtgtatatagatatttttccagttcaggttggtgaaataattgagtacctagctagatattcaaactcagataaggtacatcattcaatttaatttgcgttaaaaataatcgtgacggttaactatatgttaatttggtttggaagcaccctctacatgattaaaagtaaaagtcatgtgtcgtata

SEQ ID NO: 3980 - DNA, 2376 bp, Zea mays
  misc_feature (1)..(100): optimal_loci_97755_G1, chr3:30049223..30051598, Cluster 24
  modified_base (1254)..(1254): a, c, g, or t
  misc_feature (1254)..(1353): n is a, c, g, or t
  modified_base (1255)..(1255): a, c, g, or t
  modified_base (1256)..(1256): a, c, g, or t
  modified_base (1257)..(1257): a, c, g, or t
  modified_base (1258)..(1258): a, c, g, or t
  modified_base (1259)..(1259): a, c, g, or t
  modified_base (1260)..(1260): a, c, g, or t
  modified_base (1261)..(1261): a, c, g, or t
  modified_base (1262)..(1262): a, c, g, or t
  modified_base (1263)..(1263): a, c, g, or t
  modified_base (1264)..(1264): a, c, g, or t
  modified_base (1265)..(1265): a, c, g, or t
  modified_base (1266)..(1266): a, c, g, or t
  modified_base (1267)..(1267): a, c, g, or t
  modified_base (1268)..(1268): a, c, g, or t
  modified_base (1269)..(1269): a, c, g, or t
  modified_base (1270)..(1270): a, c, g, or t
  modified_base (1271)..(1271): a, c, g, or t
  modified_base (1272)..(1272): a, c, g, or t
  modified_base (1273)..(1273): a, c, g, or t
  modified_base (1274)..(1274): a, c, g, or t
  modified_base (1275)..(1275): a, c, g, or t
  modified_base (1276)..(1276): a, c, g, or t
  modified_base (1277)..(1277): a, c, g, or t
  modified_base (1278)..(1278): a, c, g, or t
  modified_base (1279)..(1279): a, c, g, or t
  modified_base (1280)..(1280): a, c, g, or t
  modified_base (1281)..(1281): a, c, g, or t
  modified_base (1282)..(1282): a, c, g, or t
  modified_base (1283)..(1283): a, c, g, or t
  modified_base (1284)..(1284): a, c, g, or t
  modified_base (1285)..(1285): a, c, g, or t
  modified_base (1286)..(1286): a, c, g, or t
  modified_base (1287)..(1287): a, c, g, or t
  modified_base (1288)..(1288): a, c, g, or t
  modified_base (1289)..(1289): a, c, g, or t
  modified_base (1290)..(1290): a, c, g, or t
  modified_base (1291)..(1291): a, c, g, or t
  modified_base (1292)..(1292): a, c, g, or t
  modified_base (1293)..(1293): a, c, g, or t
  modified_base (1294)..(1294): a, c, g, or t
  modified_base (1295)..(1295): a, c, g, or t
  modified_base (1296)..(1296): a, c, g, or t
  modified_base (1297)..(1297): a, c, g, or t
  modified_base (1298)..(1298): a, c, g, or t
  modified_base (1299)..(1299): a, c, g, or t
  modified_base (1300)..(1300): a, c, g, or t
  modified_base (1301)..(1301): a, c, g, or t
  modified_base (1302)..(1302): a, c, g, or t
  modified_base (1303)..(1303): a, c, g, or t
  modified_base (1304)..(1304): a, c, g, or t
  modified_base (1305)..(1305): a, c, g, or t
  modified_base (1306)..(1306): a, c, g, or t
  modified_base (1307)..(1307): a, c, g, or t
  modified_base (1308)..(1308): a, c, g, or t
  modified_base (1309)..(1309): a, c, g, or t
  modified_base (1310)..(1310): a, c, g, or t
  modified_base (1311)..(1311): a, c, g, or t
  modified_base (1312)..(1312): a, c, g, or t
  modified_base (1313)..(1313): a, c, g, or t
  modified_base (1314)..(1314): a, c, g, or t
  modified_base (1315)..(1315): a, c, g, or t
  modified_base (1316)..(1316): a, c, g, or t
  modified_base (1317)..(1317): a, c, g, or t
  modified_base (1318)..(1318): a, c, g, or t
  modified_base (1319)..(1319): a, c, g, or t
  modified_base (1320)..(1320): a, c, g, or t
  modified_base (1321)..(1321): a, c, g, or t
  modified_base (1322)..(1322): a, c, g, or t
  modified_base (1323)..(1323): a, c, g, or t
  modified_base (1324)..(1324): a, c, g, or t
  modified_base (1325)..(1325): a, c, g, or t
  modified_base (1326)..(1326): a, c, g, or t
  modified_base (1327)..(1327): a, c, g, or t
  modified_base (1328)..(1328): a, c, g, or t
  modified_base (1329)..(1329): a, c, g, or t
  modified_base (1330)..(1330): a, c, g, or t
  modified_base (1331)..(1331): a, c, g, or t
  modified_base (1332)..(1332): a, c, g, or t
  modified_base (1333)..(1333): a, c, g, or t
  modified_base (1334)..(1334): a, c, g, or t
  modified_base (1335)..(1335): a, c, g, or t
  modified_base (1336)..(1336): a, c, g, or t
  modified_base (1337)..(1337): a, c, g, or t
  modified_base (1338)..(1338): a, c, g, or t
  modified_base (1339)..(1339): a, c, g, or t
  modified_base (1340)..(1340): a, c, g, or t
  modified_base (1341)..(1341): a, c, g, or t
  modified_base (1342)..(1342): a, c, g, or t
  modified_base (1343)..(1343): a, c, g, or t
  modified_base (1344)..(1344): a, c, g, or t
  modified_base (1345)..(1345): a, c, g, or t
  modified_base (1346)..(1346): a, c, g, or t
  modified_base (1347)..(1347): a, c, g, or t
  modified_base (1348)..(1348): a, c, g, or t
  modified_base (1349)..(1349): a, c, g, or t
  modified_base (1350)..(1350): a, c, g, or t
  modified_base (1351)..(1351): a, c, g, or t
  modified_base (1352)..(1352): a, c, g, or t
  modified_base (1353)..(1353): a, c, g, or t
catatgcaacatttccacaagcatgcatgacactaccgcaaaaatgatacttatacaatttctaggatattttgtttatcttgaggggtctactactcatacaatttctttatattctagggagctcatggcagattaataatcttaatatatatatatagagagaaccttttattagtggtatacttaatttaatttgttatgaataagatatagatttctttacagaaatcctgtggaaatagtatatcttttaaaggtgtggatatggttttatattagggagaaggagataccggatacctgacacatcttgcatgtgattggttggaggtttgaagagaacggcacatgatggatggcaggatgcatggggacgtgtccatcgggaccagaggtaacgacgttcgtctccaggatctagacaaaaaacacaatattcctgcgtaccgtcggtacaccgttagtactacgcgcacgcgcgtattttatgtgtgcccgttgcactacagaaagtgaagtgggttcgatgattattaaaatcaataccgagttaattagtgcataacagttccgtcccatccgtatgctacggaattacggacgtcgtcccggtcccgagtcccgacaggacaaaagaacagaggaggaccaccgtcatgtgccgcccccccgtgtacgcacgcacggcacgtacacggaccacacgtccctgcctctcgctcgcccacccactcgatcagctggccagcatgattggtcaagtgtctgccaccattatttgcatcgcatgcctctctgctgttacatacgcgtcacagaaatcagtgggccatcactagctaaacaagctagctagtacgtagctgcatcatagtatatatcatcatatcgcatagttatcagcatcgtctgattaataagatgttgatgtagtatattccctgatcgatcaggtcatgctactgtagtatctcaaactgaagctttattagcatgcagcaggccacatgcattgcttgttccatttcagctgtttatttgggaggaacaatataatcatgcgcgcgaccggtggagcaagtaatcaggcaggcagcactcgatcagttcagttggggagtcacattggtggtacagtccgactaactaacctagatttcggttcccgcacaacttcgttaaggttatttctagtctattgtatatttgacataatatccaaagctgtcagatcatataaaaatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttatggtaacaacaccatatcaggatggtgatgacatgctttagctatagaataaaattcacccatatatccatccactatctatgatggctgagaccaaacccgccttgctagaactagcagatatctccatttcgttcagaatcagtaaagcatcgttgaggggggggtaaagatccaatgctaattcatttcaggatcaagttttccaaaagtaccctttaaccattaggaggcaactctcagcttctctctccgttgccttcaagtgaagcatcggcaaaacctgcatgaaacaagcatcgtccgcctattccttgtgtagtccataaggaccagaaccatttcatgtttatgtagatgtagtaattcgaagacgcaacataccaacgccagtaaaaacaccatataagcatgggttggtcatccaaacagtagatctttagttgatataaatagacaaacgaatacgaaaacaaaccttttatggtagcaggtagtgatggcaatgatctatcttctttgaagattttctcatgaaaatcactactaaagacatttttcaactcgatgaatcaaaagcaaaaaaagcataatattaattccataccttcagtatttgcagggtcaaagttgactgcaagaacattcttttgccacattcaactattggaatttgatacgtacttgatgtgcttccaatttaggattaaatgaacatcctacaggctcaacttcaacaacagaaataacatcatatgtgctagatctctactgttagaaattttaaaaacaagcatttattttaactatatagaaaattgcagacgacatcaaattcaagattttaaaaaatagaaacatgcgtgtatacatgtttatgctccctttgcaggttgaacttccttactaatatcacttttctccttagcctttacaacaagctacataaatccttctctctaaataatgacataaataaatatttaggacaattatgattataccctccccagcat

SEQ ID NO: 3981 - DNA, 1190 bp, Zea mays
  misc_feature (1)..(100): optimal_loci_198387_G1, chr5:164712378..164713567, Cluster 25
gaacatcctgcatgcatatagcctggctggtggcagcattcttttcttcatgcgagccagaccctttttatcaggaaaccaatcaaaccctagacttctgcctggtgcacgcatgttctcatgtcatttaagaaatgcacataattttgccggttctgtacgattaggacttttcatttaatttcgtacatttttaccaaaagttagtcagattagttcaaaataaataaaaaactagtttttccccaaaaatcataagaccatttgtggtaaagcattattatatgataacaaaagaaaactaaggtcttgtttggttgaccttgtgagttgtgaagctgcttttgttttggtcaaaaccaaaagtcaataaagaggagaaaagaaatagctacttttgctctagtacataatttatgactctttcacctctacttttacttcagttgtgaaaaataacgatttattttcctcgtttcttgtgcccgaaagagagaggtgtaacccatcctctataacagtgtggctttgacaacggttcaatatgtatgtttggatgcaggcccaaggtcgcttggccaaatattggccttgacaaaccaatttggcccatgtttagttggaggccaaatgttggccatgaccaggaaattttggtcgtgcaaatgtagatttgtgccaattcttggtcataatcagcgcggacaaaccggctacccaaatttggcttggtcgtattgcattttaaccataaaccaaacatccaaacttgaacccaattttggcttgatccaactttggccagctacctaattttagcatttctctggtccacaacacaacaggccctagtgcgagcgtggccctggcacgctaccctgccttgacgcgtgtgaagccttagtggcagcctcaaccgcaggtgtggatccggcggcggtcatggcgtgtgcggccctgacaatggccatggtgcaggcgcttccaacatggtcatggcgtgggacagcatgcggtcctgtccccagcgcatgtgttgccccaacacaagcatggctgcggtaaacaactttggcgagaggaagatggaaatgtgagtctaacaagtgggtctgcttataagtgtgtgagagagaaagttgagtggatgacatgtgggatctgctcgtaagtgagctacaataaacacg

SEQ ID NO: 3982 - DNA, 1087 bp, Zea mays
  misc_feature (1)..(100): optimal_loci_10387_G1, chr1:55511371..55512457, Cluster 25
tatgaggagttatttataaaaatatgacgcgggaaattgatggggaaggaatgagctaagttaggcatcgttgattggggctggaactattctagttgatcaatattaataaaaaaagcctattactccagctggaactgttccaaagaaccgttctagggcaaacgaagtcatgaccgtgaggtactagttggctcctttcatcactcatttgctccttcatcaggtactacttgtccgcatctggtccttggtcaccaggtacttgttggcggttggttccttgtctagtactagtctgcatgtgtttctgtttttttactaataaacaaatcgatttcttactgtgggctttcagacgcgatggcgagggagggctttcagatacggcaaatcgatcgaccgacctggcgacctgtgagggcggcatggccagcggactgaagggagagtggcacagctgggtttggcggccagcgctggctgggaacgcgtgtgtgtttgtggggggtggggtggggggagaacgcgcgaaaagaaggcgcgcagatcagtttcacttgcatttgacgccgaaacatcatttcgggagtttctgtgggcttgtcaaatgtggtaacaaaaaaaaaatgtagcaattttataaatatggcaacatcctttacagtaccactggagatgcattttatctaatgactccttaaaactcaaatttagaaacctttttacaaaactactggtgatgctcttaggtacccatgatcctaataagtatgagtttaggcacgaaattaaactcgagatggatcatgtatttttaaaacagatatattttatgttcatggatataagtttgtgttggcaaaatccagcgagtttgtgtccattgttatctctactccagcctgagaggccaataaaaaccatcactatatcaagctaccaaactaaaacgtaaggaactaccaaagttaacccacactagaaaaagcgaccactcattgatataagactagcatggttgttttagagcaaaggttggataccaaaggacatagctcggctgtcttagtgcatagacagaaaa

SEQ ID NO: 3983 - DNA, 1012 bp, Zea mays
  misc_feature (1)..(100): optimal_loci_10538_G1, chr1:56581445..56582456, Cluster 25
actttatgttatggtgattaatatatcttttaatcttcctgcaactcctgattatatctagctcttatatgagataagaagaaaagaggctacaacatcatatattcaccaatcatattttttggttgtgttgcatcacaatctctacttgttaattctctacctgcatattttggcaacacatatataatgttgactcgtgcgaataatggaactactaccggtgttttatgacttgcatatatattagctacactattgcgagtggtagtactatcgttacaaatttactaaactatttctggattaagctaaacttgaaaagatcgacctagattcctattaagcgagagctagccgtgcagggcaacgcgcgcggaaggggtcgtccgggaatctgctcgtgaaccggcatgcagcacctgccgcgcagggacgagacgacgacgacgcgccttgttgcggagtggcagcggcagtagtagtgttggaataatggaggaggagcaccgggcgcgacaatggcagatcgagatgaccgggggcgcggctggcgggcgaaccagacaatttgcgcacgtcatgtaggcaggcaacacaccaacagcgttggacatgtagtgatgtagcagagccgatctgctcctcctcatcacccacctccaccttgcattgcattgcatgccgagatgactttcaactgatcgagaccgactaactagctcatatatatatagtcatgcatgattaattagttcgtattatcagcatgcatcaattttgtctgtgttccactgcactatatatattattacgtggaacatatatatagctaataatttaacctactatttcgtttcagcagttaaatatttctaattttaattaattaaataaatatagtaaatatttatagtattcttagatatatttttttaatctttttttataataaacttattagacttactaaaatttaaaaagtttaatgatgcgatattatagcaatact

SEQ ID NO: 3984 - DNA, 1286 bp, Zea mays
  misc_feature (1)..(100): optimal_loci_10540_G1, chr1:56582868..56584153, Cluster 25
aatgtgcccccctcccattgctgttggaacctgttggaacttcaaatactacttcgtccgtttgaacttgtgtaagtttattctattgcaaacctagctaattttgacccatgtggttaatactgatttaggataaaactaaaacatcttaaagtatggaaacgaagaaatagtgtttttctctcagtcgtctctggtggtccctttatatagattgttgcatgcactatcgcatagaactattgcatgtacatctactttgtgtgcctcctgttctcatacaaagcagtgtatatcagcaactgctgcttcacacaattatatacactatcgatcgaattgtcttgacccaaagtacgtgttgcaatatcggcgctccggacctgcacactgcagactaggcagagctggccctaattaagctcacagcagagaaataagtaactttccctaacacgaaagcgttatttgctggacactttttcttcataagatcgactaatggaattatgcggttccaacggcagttgtgttagcggaacattattaaaagtgcatagcgcattaatatcaaatcaacagaggatgttcaaattaataccgtttgattcttgaagcgctcttctttcatagaatcatgcattgcatgcgcattattgtataacaatacacacgcgtactttaattatttgcctggataataataattaatcatcatgcatgcatgcatggtcgtcgatcgatctatttctagagaattccatcgtcgctgcttttgtgtagctggaattttgtcattctcgtatagaacagcatgggagttcaaaacatatatatgtgcatgcatgtgttaatactacacacgggagctttgtttgttcttgcaagctagctaacaagcgatgatgagatgtgcatgccgcagctagcacaaggctccaaaggaaatagtttcacgggggagattttgcccctaggcgccttgtctgcttccctcgtgctggcgccggcccacacgtgcccatccctacaaatggctggcagaaccaaaaagaaaaacaacaagaaaaacaacagcaattgtggtgttcatcatgaggtagcgtagcgctcgtttgttgtgttgcgttgcgatgcggggacagccgattaattgaactgccagtctaatcggactgtatgtctgtggacacagatttcctttcaaaaagaatgtctctgtgtggcaactcatcgatcgatatagtattactagctatacgagcttatctgcggtcatattataa

SEQ ID NO: 3985 - DNA, 1206 bp, Zea mays
  misc_feature (1)..(100): optimal_loci_111975_G1, chr3:124665764..124666969, Cluster 25
ctacatgcatccccaaatcataatcaaccttctgggattaaaatagtattctataaaatatacgacactacctcctaacacaaaagctaatcaccgaaaaaaatgagacgatggttcatgcatcttttgtcagcactcttaatttgtttaactttatttgtagaagttatttatttttaggtgtaggtagtattgaacattgccgtgatcaagaaaaaaatataactttcacgagtaataattcatagtatttgcacaatccatttgttttgcagaaaaaatatcatccacgatgttgcctatctactacctcccatggctcatgcacaaagttttttcgctcgtggatggctttgaccaggtcaacttttccatgtggcttggacccagcctctctatggtcaacggtccagtcaagccagcaagaaagatccaaaattccaaacgctctagaaacgaattctcaaaatgcagtggcattgaaaataacaacatagaaaacgttgacagaaggttagtaccatattcaacaatcagatagctcaacataaagttcgatctattttatcctattcatttccttttgaaacaagctactttaaatcattattacactaacctgcttattacttatctgcagcacaatgccaagccctgcaccttgatccgcttggtggtagcagtaacatctgcaggctgtcaactgctgcacgagtagacttcacatgcgatgttcttccactgatctgacttgagcctctctgtctctcttcacactcaacgtgcgtggccttcgccttcggttttgcaggcagactctctgatcaagttcctgtctcccagtgcttgcacggcgcaattgcatgcgaccaacatgccaacgcttgttgggttcagaggattgcttcattccaaacttgcagttgccatggcaggagctcgtggatgctctttaggtattctggttccatccatgattactggagaacttaccaggtcttggcattttggttcagctgatgcaggagtggcggtgagaacctctttggtcactccttcggtcattagaagcacgaatgctgctgcaacagaagacacacatgtcagatgtgagcaaaacaagaaaggatggtatgctgccaatgctggtcgcactcgcacaagcacatagctgccgagataggagtgtggtcacatcatctgata

SEQ ID NO: 3986 - DNA, 1269 bp, Zea mays
  misc_feature (1)..(100): optimal_loci_112423_G1, chr3:127119224..127120492, Cluster 25
tgtttgattgtggttgccctggccaaggtattccatgtactacataattcgttcattcgaacatcattatttgagcatgcatgcatgatatcaaagttgttcaaatgttacaaattaatcgaattctggaaagtatagcagcaggcaggccgcctagagaaagcaaattatagtaattccagacgaaggaagccctagattttactctatacattctaattaaattatacgatgtttcggtttatttagatacataaattttattatatacttatgtgtgtgcgaagtcagaacctcttataaattagaataataagagtactataaatagttatattcaagggcaggaattctagtatatcaattctaaaattattgtaaatcataatttgaatgaatgaggacagcagtagtaggtcactaagtctaaaactcaaactagctcattggcacagattctagaaaatcatctacaaaattcctacaaatgataactatggaaattattgcaagagcacgaaagcagactcctataaatgacattcatagtcatctagtcttgcaatcatagtagtggtcataattgaatcatggtaaatcaatgtagtcaatgtagtaacaaaatccttagaacatcttggcattaatttgttataactatatcaaactatgataactaccacatattaaatcacggtaaatttcctacactatactaactgtttcctctagatatcatggggtcaaatcctattgactcatatgaattatcacctcaagctattagaaatgtggctaatatgtggctagccataaaataactttattttatatttattacaacaatgtttgtacttatttaccaaaaggtgaatatttatttatgtcacatgtgttagtataactcatgatgatatttgtcattatcattgcataacgacaccaggttaccataggtaccgaaaagggacatgggtgatttataaggttcaggttatatgatgtgtaatactctacatcctatttgtgtaaggtgaattgatgtttatcgatataaagaagattacaagcttaaaactaagcacaatgaccacttacctctcccttctctcttggttctggtgagtgttctagatttattgggatctagttcccctctatctatgtttcctagaatcgacatatctatcctaatgctctaaagccacaaattaggctcaaagctcaaaggaaagcatttgaagccaaatgtcgaatccagaattggag

SEQ ID NO: 3987 - DNA, 1162 bp, Zea mays
  misc_feature (1)..(100): optimal_loci_118979_G1, chr3:166779916..166781077, Cluster 25
atattaccaacttgaaaggtcgatttactcacaattgttgatcgttcaagattgccaacttggaagatcgatttactcacaattattggtcgtgtgacttcaacatatgtagccctttgagcattttagtacatatctccattatctcttaacttttgtcgtggatggtggcgcagattgataagagcaagaggtcttacctctactagggaactgcaacattagctggtagtcattctaaagtgtcttggcagtttgagtgcagtcctttggtgtatggtagacttcacattttggacctcgtgttctttggcttcacacttaagtttgaagggagtggcttaggcagacaaagaacagtaaagtgtagaagttgttgcctccaaatataataacatgtgttactgccatgctcagtttgtccctctctaggatccttggtaatcgcaagttagtgaaatgctggtaaggaacttggctacatgaatgccctctcgatcgtgtcatcatcaggataggtcattcatacatggtgcttgaagctctattaataagtggtgggttacaaatgtttttgaagctataatagataggatgacatctgtgtatgggagcccatggaaggcattgcattgcataaacacaacaaaatgttgcatggaagtggtcctctaatggcatccacttagcaccctccacataacatgcattctttaatggctctagcatcctagaaggggtggtagagctgtgaaaaatgattgcaccaccaaaggtcaaaattttcttttggctttatttatatagtagatttgggaccatagaacaaaagcatagacacaacctgcaagatgataatcagtgtatgttgtgagcaaaaggtatcgaggcgataggtcacatgttggacaactatatcttctctagagagctttcactatgatctttcacgatgtatagtggtcatgctggtgccatcgatggatgttcagttggtgcactggtggttggattaccgagagctatcttctctagagagcttttgctacgatctttcctaatgtccagttagttgtgccggtgccattgatggatgtttaattggtacgttggtggttggactgccgagagcattttagcattcaaatcatgaaggtcttcg

SEQ ID NO: 3988 - DNA, 1027 bp, Zea mays
  misc_feature (1)..(100): optimal_loci_118981_G1, chr3:166782010..166783036, Cluster 25
tatcatcgcatgctcaaggataagaaaatgacactggcttcaaatttaccctcaagtagattctttgaatggcctagaggataacctacccgagtccgttcaatgaactacaactatataaaaagcacttgaacttgatgacatgaagcactcgatgaaaaaagtacttgcgctcagactttaattacaactaaccttgtgtatgattctctaattagataggggctcgggggctattgtcgacaacatggaccctatgtatcctcactaaagcaaataatgacatcccaataagggatgggctagtctgactactcgagaggcccaaccgagcgggggtacctcatctacttggtggacaatgcatatacatgatctataaaaatcaaagccatttttataaaccaactaggaaacctacttgtaaattgatcaaaacttcatctgcacatcaagttatataaggagtggtagtgaacccttgatcgacgtcatcaatccaaaataggtcctcgagccatagacacaaaaccgtgattccttaatgagaaaccaaccctagtgcacaacacatagagaataaaattgccatcgcacattacatgtagggcacctcatgcatgaattagtagaaaattttctctcatgcatgtgttaccaaactgatctactgcacgcgatacatcaattacttgtccgacaggtaaaaatgacaacacatctaattttataattaggtttcttgtttggaacctagctaggatatttctcttttacattagatatagtaatattcttttaataaaactagtgcacatgtagaaaagaaattgtgtagaattttttttacaaattcttacctaggtttgtaagctaagtgaagacctagagcgatcaacttcttaagtgtcatggtttctttagaaccgcacattccacgtacccatgcatactccaccacctgaagaaaattcttgttggatgtagtcatgtagggcataataagaaaaaagtttccaaacctctt

SEQ ID NO: 3989 - DNA, 1397 bp, Zea mays
  misc_feature (1)..(100): optimal_loci_120151_G1, chr3:174814975..174816371, Cluster 25
cgtcgtttgtctgaagtctgaactccatgaaactctagcttacgtgtctaactaattaattaaacgatttttcagtcgtcctgcgctgatgctgatcatcgaactagaaattggctgcccgctttcggtcacatatgctaggagtattatatactagcacgctcgtatatatattctctccgacctggaaaggccactcacgaacgcatgcgtacgtacgccggtgtaaagcgagattcattcggaatccgaaaggccggcaccgcgcgaattccctgtcagatcacggcctgattatctacacatgattagtactgctcttactaccttaactagtcgagagagagtgtacgtgcgagcattaaggctatgattgtttcctgcatcagtgcatgcgccattgttgttgcggcccatgtgatgccgggccccgcccggctgaaacaattcgcgcatccgtccatccatggtacgactacgatggcacaacggtctctctctctcacacacacacagcattaaggaaaagcgtgattcttgtcagcaacggtggatggaaaatactaaagtagataaatttgtcatgataatgttgatggaatttgtcatgaacatgattagtattgcccttaccttaactgtcatgtttttttctcaagtattatagcatgcatcttggtaccatatgcgagatgaaaaaaaaaatcaacctttgagttaggtatgagattaaaatctaaaatgactacctgctatattcatttagcaggcgaagaatctacaacttcaggagtcttacttcgtcacaataaaaaaaacatggctaagaacagaaccaacaagcgcttgtcttgttccagccagcaagtcttctaaaaaacatcatcatggcaaatatgaagtggattactaggttctgcaggaactgtagtaaccttatcattttctccactcataagtgtcaccgaattaatggacttttaaaaaaaaggcactctgggttggatgcctaatctaaactgaaagaactggtttgagcacagaaacaaagaagtggtgtgctttgtaaaatgaaaattaaccaaggaagaaaaaggagaccataaatgaagtcgtcactatgtgttgtttcgatatttaccctaaattcccaatgtaacaaaagttttatacgttgagttccaaccttatattaccatgacaattctagtaatttgaatacttaaaaaaaattctcaaatagaaatacttaatataaataaaggaataggaatacctcaatgttttaccaaagtattctagagtcggcacagcccactagaggagccgttctggagtaaactaacgtgacttgagaggagctcaagaccactcctctagtcgtcatccttttgccc

SEQ ID NO: 3990 - DNA, 1115 bp, Zea mays
  misc_feature (1)..(100): optimal_loci_121023_G1, chr3:179522238..179523352, Cluster 25
attcgagtgactaagtcaagcagattgtggcgtcttagctagaaaaccaaatatgcctactagtgcatagtaaaggtgaaggtggaagatagcgaaataaagattaaaacgtattggaaaaaatatattaggagaagagcaacgtgcataaaggtaaaagatatagagaaataatggtagatttgtattcaagaaaatgtattagggcaagaggagcaatatgaattggaaagtgagaagattaagtatctaaagacaaaatttgaacacaataaaattatctattttggaattgcgggattttattttaatttgtcgacgttttctttggaacacaatcattttataaaagatatataagttttatatatgaatcaatctagtttttttataaaactttattgagtaggagaaaaattctatattccaacaagacttaattttggttcttcgttttgttaaaatttgatagccgtggtcatatgtagtagctctcggattttggaaggatattgcgaatgtgacagtttgcgccataccaagacaaatctcatgaaagtctctagaggacgatgttgaagtacatgtgatcattgctatctcacaatcatgccctattcaagtatttagtgtaataaaactttgtagactaattcttttcaacactctaattgcctcttacaagttttgaatgagacccttgtgttagcctatttcatgtctacgaactatctctcttatttatatagtcattttcaagattctcatacatgcatgcaagtaggtgcatatgtttctaatataatttttacactcaaattttaatatgactaaaagccataaatagcacgcataatttgagtgacgctacaacagtttttgcagcaggagacatttgtgattttgatcaccatagatttgtacttggagatagcaggcttgtgtggttgacactcgtgattttggccaatatagaattgtacccggagataggcttgtgtggctggctctatgcatacgatgttttcttcatgtcttgcttggaactcggaaggattccatcatgcacgtcagggacggctgccacatgtcccttttatagaataggacatatc

SEQ ID NO: 3991 - DNA, 1084 bp, Zea mays
  misc_feature (1)..(100): optimal_loci_121117_G1, chr3:180004736..180005819, Cluster 25
ttacgccacaaggcgactggtgcaacaaaactccggaacagccctcactttgacctattcaaaagggttttaagaaaattacgtggagccgttggagcgctacttttttattggatttaatgtttttaagagattccaatatctatgttttggaagctatatttttaggacttgttagagttgctctaagtgttgcgagtcgtcgttctaattctcacatatgtttacctaacaaaatttaaaaaccccgtatcaatattttgtatgcgactctgagtgggtatcttaacgtgcaagtcatataaagtcgtttctcttctttagaaaagaaaaagtgtttctccttgtcagcaagcaaaggggcatagtttacatgtttgatgggccatatgtcgaaaggcatatgtggattcgatcttctttttcttaaagtgacattggcatatgtcgaagggtttatgttattatgtagcttggttagatcagccctttcaacttttcaagagcttagctgtgcctttgttagtttttcaagagacttttgctttatctgacttgcctaccagtgggcccaataacacacagtttcttcctcctgattttttatttttttttcttaaaacatatatttatactatttagtctctaaattctgtcaatgcatactaggggtcaatgttatgatctcaacgtggctttggcgcttcaagactttggtagcccgaatgttcaagtgtgttcagcatagcgcctatgcatgtgtggcgctgcccacgcgacgtgtgcatgaatggatgcactagctagctccttttagcacacgcgaaggacaacattagtgcatgggtggcactacatcaccctctcggagctgttgacatgcggaaaaatttgatttcagcagtagcaatacaatgcaaactctcgagttttacgaatgaggatcgtggaagatgcagctatttcacctgctttataatttagttcatgacatattttttcgataaaggaagcaatgctattaataacaaagatcagtacatcaagaagatataaagtcttggccaacttccagcttctgctg

SEQ ID NO: 3992 - DNA, 1364 bp, Zea mays
  misc_feature (1)..(100): optimal_loci_122327_G1, chr3:186221453..186222816, Cluster 25
acgaaggatgcatgcaaacagggtcgaagcaaccaatatggctctgtattatttgagcagtaccttgactcggcttaatataaatactataccaaaataatagttataaacaacaagattttgtttgaaagcaagaataatagaaaagattgagtgagttagaatcccacactatttgaaaagtaatgaagagaactaagagggctagaatcctcatcgttatagtgtgggacgacactcaatctacttcatcactcttgctcccagcgtccaagccccacgcgatgcttttacacgaattttcttacaccagtgtttgattttctcgcgtgctccgccactgcatacaaacgttatgtcatggggtggcgagacactgtcagaacgattcgtcgtccggttccttcaagtggcgcatgagaaatcacatgatcgtagtagtagaccgtttatttatgaagatggcggtacaaagataagtgtcagatgttgaatatttatgccaccaaaaatttgactagcgagctcatccatgcaccatgctttctagtactggtccgaattgtcgtctactttttaaactaaaccgcaataaaaataaataaataaatagagagagtagtatttataaatactagagacgagacgatgaaacatctggcgtctaccgctagtttggttgcgctctcgttatctcgccatgccatcaaatccatcatgtacggatctattcgaggaaatctgtcgtgaacctcgctttcgcccgtgtagctgcaccaaaactgtggtccgcgctcgattccgcgggctccagaggtgcacctgaatctggcgcaaaaaacaaacgctagatcaggggttgatcaatgattagaagatgatgagtgagccctacaaatgatttaagggccgggtttgcggcttgcctgatagaagcttgcaaaatattgccttacccaggttatgccctttgtgtcccaaattacatgtttgggatgctgcttggttgctgtctacgttcaaacaatttttacatatatgtttgggaaggccaataacaaatcacgcaaatcctacctgctctctgatctcggacgctgagaaggacgggcgagcgacgccctctggcctctagggaaaaagtccccaaggaaaacactctcccctcgggagtactgtagaggaaatgaccccaaacctctcggtctccattaatcagtactccctccgttcccaaatctccatcgtgtaagccatggtcgcagtgaccaagggacaacaaagaagtggtgatttgtttttaatggcccgacgtccattcattagtcccattaattataggttaatgctgctgaaaacgctgg

SEQ ID NO: 3993 - DNA, 1259 bp, Zea mays
  misc_feature (1)..(100): optimal_loci_123810_G1, chr3:193999940..194001198, Cluster 25
ctttaaatcaactcttattttgatttttcgaacttaaaatataatttttttgttggaaatgctctagcttaccgtttatgtgacgcgttatctattattgaaaaacatatatagggccgtttggtttattcctcatttaaaaaaaaactcattctacaaacttattattattagccaaacaatttcaggtttttatattgaattttgtgccaaaatctcgcaactcaaacataagttgataattgaatttacattggattttgtgccgtatccaacttctcaaaatctataggtaaccaaacaccaccgtactaatagagtagatagagagctaagatggtgttcaagtgtcgtgtcgtcctctgctgtgagaatgaggccactatgatcgctttatcagggattgaatctatggtatattatctttgtcatgcgtctacgtgaatatacataaggctataaatttcaaaaatccaaataacttatagattacaataaaggaagcaaacaaggcaagctaaaaaacatttacgtctccaaaacagtctggaccgaggggatcaacacgcactcaagaacataagaaattttacaaaacgatcaaacaaaaactacaacaaccgaaacggcttcaccaaatcaccaaaagtcttcctccgagtcatttctctttgatcatgtgaaagctgaccgggtatccaatttgttccctcgtccaaatatttcaacaacacctgcaagaagctgaaacacgagattctagacacagttcaaccaaggaagcaaggatatgacaaaactcttctcaacgaacattccgttacagagttgtgcatggtatccacgcgaccacgccacagtctcggtcccaaaactaagaccctgttcgaaacctctaaaaacaataattagctattaaaaattaatttttaggtttcaaacaccatcaattaatatcgtatggtggctcaactcagctccagctaatattttattagctgattaattattagttctagggttccagatatggtctaaagcacccaaaagcaagggcaaatctagcgccacatagtggtgcacaccttaacaaatatacacatggttttagaaatacatggtcaaaaaatatttagctaacggaaaacattattcaaccctgtgcaccaggtgaacgtggcgtcgcccctgcccaaaagttcatgattttgttattttaactagccactagtttgttttaaatgtattgcatacttttt

SEQ ID NO: 3994 - DNA, 1032 bp, Zea mays
  misc_feature (1)..(100): optimal_loci_125311_G1, chr3:202448880..202449911, Cluster 25
ttcagctgcaaggtagtcattattgaactataatgcagagcattggagatgtctgcatgaacttatgttcagaatcggaaatgtttctgagtgcagaggaaccaaattctctattttgtgctgtgactggactgccaattatgctgaaacaaaatttgcttagtaaatcggcttttggttgatattgtagactaccttaaacttgttaaactattttccctgctgttaagaagggctgtgttcacgaatcttttgtactcttggcatgtctggttcaaaactaggacatcgtcttgaatccatcttcatgggtgtctcccaaacattatttgttctgtatcaagctttacagctcaagttgacaaacacttgcgagtcatgattttatacggatgttgcgtcttactttttttcttatttgaaagttggaatatctgttgtaagtagttgacatacaactggttgagttgactgctgcccatttgcttttcctgggttggattatgtttgcaacttttcattcatgaactgatgggagatgtaacctctgtatttccaccaaatggatcatggattggttgtggtatgaaatcacagtccaataacttctctttggcctttcgtggggtatatatgatagaaaattgccataaatatctacattctttttttgttagaacatcaaatattttcaacttgtggttgtccaagtagttagttccctgtaatgtgcgtccattttcttgtcttctgaatttcatgttgtaagctggaacatggttggtgacttatttactttgttgtttcaggaacaaatttggggttttcaagtcgatgatgcatccacatgttagacaggtggttatgattaactatgtagctggtgatattaggatcgtgggtatccaaatcctaagagaaaggaattagatgggatatatctgcaacaaccagtgcagattgttgtgtgattctcatatgtggtctgagttggttatgtggctagagtagcacctcgtttgtcctacgcca

SEQ ID NO: 3995 - DNA, 1267 bp, Zea mays
  misc_feature (1)..(100): optimal_loci_125625_G1, chr3:203849781..203851047, Cluster 25
cgtcatatattttttagtcatttgacaccacatccaaatcatataggactctttttctaaaaaaacatatatgagtggaaccggtaaaatttctcgtaaccggtctgcttttttatgtattatggtttaaaatttgaaattttaaaaatgaaactttggtcaacaaaacggattttggaaattacaaaatgaaaatatgatccctagttgctcatcgctgacaaatcagtgcacaatgatgcagtcttggtactttggttttccacgtgtgcatcttctgtcgcacccattattttctattttatatgataattatcttattgcaggtggttgtggcctacccgtgaacaaaaatgtcgactactgactaaaatatttggtgtgctgttaggttcagatcgtgtagtttcctacgtgatagcaactgcgcgattattgagttgcagtcttgcaaccatctgcgatcggacttccaatttcaacgattttccacgctatgtggtagtcaatttcgaatgcaacatcatcaatcaaccgtccaacccagcccgtggcacgtccttttagactagctccaccttatctgaaatccttgtgacagtgtctatttcacaccacacaaacatttttgctagggttttaggtttttgagattatacaccgtaaaattcctattgtgaaatcaaacaaacttggattcagaacaaagagcctagactatagtgttatacttcctctactctaaattatatgatattttgttatttttaaatacataattatatatccaaacatataatgtatatgtaggtgcgtaacgaaaactatagatttcaaaaagctaaaagattttataatttaatttaaaacgagaaatgctatttaactaatgaccagtggaaaaaaactttaccagcttcatatgcatttaatattcaggtaagtaacaaaaaaaatagatgttaggccatatgcctgtctacaaccacctttttttctgtctctgcagaacacgcacaggcagcaggagtgcaggaccgccactcgtccatgtcattccgtggctgccccggcccactgcagaaataatcacgaacatgtcgtcattcagatataataggaacccaacatgttttatactgtatgatgataatgataggtcgtaacagtgcaatcaacacgggttatagtcttataaggctccggttgcaagtggattggagaggattaagtacttgttcggatgcgtctgtatcgaaagatatta

SEQ ID NO: 3996 - DNA, 1276 bp, Zea mays
  misc_feature (1)..(100): optimal_loci_125746_G1, chr3:204453165..204454440, Cluster 25
ttagaattataaataaggggaagataatccaaccaaccttatctctctattactttcattttttatccttgtaagattttctctctcctccattctattattgagatccatacatggtttaggttctatgataatctttcacctatgtaatctaatcttgtagcttatgaaacttattggaatggaggtcctaacctcctaggttcttggtggctcaagatcttgtgtagttttatgagttttccctttgatgccttgttttcaattgtttttcagtgttttgctgattcagttgatatgggcatttcagattcatttcctggccttcactagttgctaactccttgagatcatatatgtatgttggtttgatcaaatctcacacgagcaccaagttttaccattttatcgtttgtggtgaaaactcaatctagatatcagttttgtcaattcttagcgatataatggatttgatgggttgaaactctctagatgtcttccttgcctccttgagaagccttattctaagtttcacaataatcaatttgaaatggaggatttggagaatctttggaggaactgcagttaacgaaaacctactaggttggctttgacacccactcaggtcgccatcttggtgaggtcagccctgcatcctagccaggctagtttttggcacagccaggaagcaggcttaccaagctgaccctactttctggctatgtcggtttttcctgtgatgctacagttttaccatgttttcaagttctacttctctacttttcattttgtctgttctggtagcttcctaatacatccaagaacttttcaagtaatcaaaccactagtttctttgagtgatataagtgtgatctctctctctctctctttgtcttagtaggagttaaaagcaacaccttttctattttgttatgctttgattttccattgttgggagggctccattgtgttctctagacatattggagggcatcttgtcactagttaactcaagagatacttgtgttggagttttgggttttagaagcgttaattgggaagtggtcattttggaagaaaaaatattatctcccattcagcgcccccactcctttgtctcatgattcagtccatcaatgagtggtcattatggctgacacctacaaagatcaacaagtgtaagagtacatggaggagtataccatgttaaccaaggcaaactagcgatagactaagtcaagatggcaacactagaggatttagtgatcaggcagtt

SEQ ID NO: 3997 - DNA, 1026 bp, Zea mays
  misc_feature (1)..(100): optimal_loci_125797_G1, chr3:204633725..204634750, Cluster 25
ggctccttagctgtttgcatgctcctagtattgtccatgcacatagatggtgtatacattattgttgcaccccaacacttcacgtttccttcgatccagcctccaatagtggttgtcgatcatgcctagattcgtacttttcgttctcctcaagttgaatcatgtgccttcgtgtccactttagatcaaaccatgcacaagtaaagtttggctaagtatgatttaacaaggatagaaaaaggaacaagtatgtcttaatagaactataagagaacataggttggaatcagtctgtaattagtaaattgaaattgtactcttgtagagtcaatcatgtacttcacgagaattataatattttcgaacgtaacccatgagatatttgtttttatagtagattactaattaactaaccatacgccttatgtttatgcatatttactatatattcttatacatgcatgtataagatattgtagacaatagtaaatctgcaattttgatgttattatgctagtgcaactccattatgaattgtatacaatgtaattacaagaataaaaattttgaatgcgtgattactctagaaacatggtataaggtatatggacactttaaatcatgtgacttgtcagcttagagagtctcataattgtttctctagcatcatgttttttcagaatgaatgaatgtccggtaataattctgaaaatcaatatgtaccgtgactagatagggggaaaagctaggatgcttctaagaatgttttaaactaattttgcaccttgttacttgtttacatgtagtaaacttatatgcacatgagatgattcatgtaatatatgccttaagtttcgagaaaaaaaattatgaatgccttaaaagaaggaatatcctagaattactccgaatagtagaattgtttgttatagtcattattagaatcatgtatgaaaatttggctaccattgaagtatattgagactctgcatgtatgtttatctatatctatactaatctatctat

SEQ ID NO: 3998 - DNA, 1255 bp, Zea mays
  misc_feature (1)..(100): optimal_loci_126220_G1, chr3:206608930..206610184, Cluster 25
cggtctataaagagagtatgaagccacatgtcggcgtgtcagcttgcagccttttggccagtcccagttattaactagtacgaccgcgggaccgggttttttttgttttgtttttggtcatgttgtgcaggtgcctgaaatggatgcgttcgttcgaatctggccactgtgggggaacatgacatgatgctgctgcgataatggatggtttctcgtattgttttgttcgtcacctgaatcacatggcagagccggatcacagcgacgcagtaatcaactgaaaataagaggaacgctagaagaaaagtgatcgtcataactcttggaaacagcctgtttgtggctcgttctggtgctaaaggtcctccgggatactacatatataagctcatgctacacgaagcttatattacaacggtctgtggccctttgcgtacgttattattccatcgttggactctcccaccagcttccatggaatggaatccagcgcttggctcgtgctcctcatctccactgcgcgaaatatgcatcctgatcattgaataaataaggtgaaactatcactgacatttaacgatcattgaacgaggtcaaactattagcattttatcaaccaatcctgacagagctataaagacaactcccttgcagctttctgatagacctttcttttatggaatacgcgcgcatgaaacagagagatatatcattgtattataaggagaaaaaagagttacaaattcaaaaaacacacacaaaacaccccacaccacctctacccccactaacagtaacgagtcatttctcataggatgtaaatactcccttcattctaaattataaatcatttagaccatcttaagttttgcaaaaaaagaagataattaccaagacttacgatatcaattagatatattataaatctggtcaaaaattttatcgtaagtcattgtaactccgtataattttcgtcaaacttgagatggttttattatatagtacactatacaataaattaataacatatatgataccatacaaaactgagcgccacatccatggatatttgatattatatacgttattattttattatataactttgatcaaacgtgagatgatttgattctaaagaaattatattgacttataatttagaatggatgaaacatttctccctatttttttgttttcgataggagaactacacgtcatcgcattaaataaaagaagaaaaacaatttaaaagtca

SEQ ID NO: 3999 - DNA, 1064 bp, Zea mays
  misc_feature (1)..(100): optimal_loci_126599_G1, chr3:208455815..208456878, Cluster 25
gtgctctgccttacaaggttgctcgataagaaggctttggttggctataaggtttatagaccttattttgagtaccggtacccgacaaaaacggtctcacctcgggttcaggggtttaattcgtttagttgcatctttgcttgtgatatcttatttctttatttttgttgattcgtacaaatttgttgttttgtaacaagccgacaatgaacaaaaggttggaaaatgtcttatgtccacaacgattccaaactgtacacttaattgtttcacagaattgatgaagacaaaatacctgcctacatggtcgtcctaggtgattttaacacgaaggagaactcagaccaaggcgctcaagagcatgctttgcgatttgaaatgggttctctagtgcctactggttcatcggcgctggaagtttcgaactggccccgggatctgcagtcgcaaatttcgaagagatagcttgaacccgagagagtttcagtacaagcaaagttactgacaactaggatattcagaacttctgtaacagaagtagcatacgcatatataaccttttccacttactgcttgctattcgttgtgctcatgatctgttttttagtaatctaaaagtggaattaagtatgtgtatgtatatattgacatagcatgtaggacccggagagtgggacgtgcaatgtttacttgtttatacgagttcattgaagcagtacgtgtcgtattaggtttattttgaatcaaatgttacccattccagtttgtttttgtagttttacaacatatatggcatatattatgaaaaggtattttttggtaataaatctagaaacataagtattacattgtgtgaacctacataatcctttttttatatacggtcaaaaataaagatgtgcacagcatgtatgatttaggatgaaagatgcactagtatactaatgcgtaagtaaaaatgaagggagtatatcaacgaaactgagtttgaggggcatcgaaaagggatgacaatgttttcccctcagaaacagcgaacgaaaaaaccacacgagatccataga

SEQ ID NO: 4000 - DNA, 1019 bp, Zea mays
  misc_feature (1)..(100): optimal_loci_126657_G1, chr3:208765103..208766121, Cluster 25
cttgtgcagcatggagttctcaataattgggcttacgaccaaggcatatttgtcaggcatgtcgaagtgacaccaatggtttgtaattctaaaagtaattagagtttgccaccactagtaataaatcataggagatgtatccggtaatgtgactgcatcttgctttccttggactaatggccaccaaagatgatagctatctcattgtggacctaagggtacttgccattcgaatcagctccatcgctattatcattcttgttgttgttatcttgattatgatttgtatcttcatgtttcctaggcagggtgcccagtgaatgaaatattgtataccatagaaattctaagttgtgtgcttatgtaatggatggaaaggacattgtctatcaagcatatcgtctattgtttctcttggacgtttatttccatagtctacaattgttatcatgacatatgcttattgtttgctattctaatcaaattgatgataatcgtcctatcctttgatgtctcttcttttatcttctctagctagagagtacctatagtcctttccattgcaactaagattgtcttttacatgttcttgagctctagcatgattgtttgccatgtcaaagaaatattccactattttggtggtgttatggtgaggtgttccaacaagaatttgtctcggagaccctctttaaatgtgttaatggtgtggttttcattgacattgagaatttggttgtgtatgtgatggctggagttgttatgtaatcttagagtgactcgttgggcaattgttagacttgatttagaccttgtttcgtagttggttatatgtgctaaggaaattgactatgaatctcttgcaaaagtcatcccacaagtcgatcgcctcgtgaggaagattttgtaaccatctcaaggcatgtgttataagtataattggaacataagctaccatagtgttgtggtcacctcatgtcgccttgactaccaatgcatatacttggatccacatgtac

SEQ ID NO: 4001 - DNA, 1157 bp, Zea mays
  misc_feature (1)..(100): optimal_loci_128058_G1, chr3:215407031..215408187, Cluster 25
atatcaggcaaggattattcaatttacaaggttgaatactcataataacttgcaatattaacaaaccaaaaccacatttgctgttaaaaattgttcaaacaaaggctagtttcaatatgttatgtttgtgtacgtatgcatgtcttagagatacataactttaattttatttatatagattaccacgcaattagcaaactatgttatgtctaaatgtctaattatgtgtactactttcagacattagatagttaattaatgtatgtcccctttccaattttttattaaatgtgctttcttgatgttaacctatttagttactgacaagacatatcggttcactacatggaaacgtcacaactaaattttcatggttcatcctttcaagaaaaagtataattaacatattcctttatacttttctagctttacactttttaaattaatatgttttctgttaatagtaccagtaataataatttaacctcaaatacatctaatatgcatatcataagtatcaactttaattatgttgtgcttaagatagttgatttgcaactttgaatattgtctctatgtatatatttatgtgcatacacatcattgtcttcctttgtttccactcccctgcaagatcaatatcacaaatctgatttagcttcaaaaattcattgtaaactttctcgaaacgcatcattattttgtggtcattaaccaatattttgtttttatggggaaactttaggggaaacccctacaacaaaattttattaccaaagaaattaaagagaaccatacacctggaagagagaaaagaaaagagagagatatatgttacaagcagcctagagcgtagaaagtcaagaatgtacagcggcagaggaaacatgattcattctaagaatattcaacttaagtgtgttcaaaaaaattctccttccaagagttgaaagatggtacttctcctttgaaattttttccatttctttcctttcatatctcccaagcagccatagagaaaactttcatgaagaacacaaagctaaatgaatcatgtgctatatgccacatctgaaagaagctctacgagtgattccaactgtaaggaaaatgaaccccaattcattttattaagggacttagattgaagctctccg

SEQ ID NO: 4002 - DNA, 1101 bp, Zea mays
  misc_feature (1)..(100): optimal_loci_129585_G1, chr3:223346622..223347722, Cluster 25
tgtcatgcctagccacattgaaagactctacatgattgttgtcttaacgcatggaatttaaccattcatggagctcacgagcgtgaattgattcacacaagtcaccttgatgatgacaagtctacgggtagcataggcctcccctattttgatgctaaccacctcgagggtggactaagcctcccctattttggttattattcattggtgtttctaggcttggttgtttgttctgatgtgttcatgtcgatgttgcataggatggagcatatcatggctatgaagcgtcagagctacagattccagtataaatttcagaagcttgtattatggggtatatttggctcccaatgtaactttctatgaacataacattagccttatgagtcatataaaattccatgtcatatgacttctagaaatcaaactcaagattacatgatgtggagccacctaggtggttattaagttgtcatctagcctcttcgtggtgttgttctttagctaagcatcggtcgagtgcttcacgatgaagtctagtgtgaatgcgtgattgtgtgtgttgcatgttcttgagtgtctgaatagctttctccggttttatctctccaactacactttgatggtcattggatatgtcatcgtcttcttacttcatccttagggttgatgtcactttcccaaacaaggatctagtggctatgatcgtaactgcccatgctattgggagtgtagggcttgatggtcaagatagctaagatagtgactttggcttggtatgtaaattaatccatggaagagactacactaaaagaagtagaggtgttcttgagtaggtgaactcttagctaatggataatcttcccttgtgatgtgaaggtaagtactaggccttgttgagtgtttgtgagtgggacttctttctcatttccctcctctagtgcaagagtggataggataagtcttgtaaccactttatggtagattgaagttgtactcttgagtccaaaagggaggctaaatagacttcaactgtcttatccgatggcttggaagctaaattaggaaacttgttcatgtttgagtaagacttgagcatgt

SEQ ID NO: 4003 - DNA, 1069 bp, Zea mays
  misc_feature (1)..(100): optimal_loci_129663_G1, chr3:223674044..223675112, Cluster 25
catcagtagtcatccgaagcataatctctgaatgcatggctgatccggtggctaactgtccgattaatatctctgaataacgctggacagtggaagaacaaaacctaaacaaacaatcttatccccgtcttatctgccccaaacatgctacacaaaattgggaaatgcctgtctccatcaatcatggacgactagcacgcactccgctcaaatcttccccgctttatcagtggatcgaagattctgagcagaggaaaagcggtggcagcagcaacagactgtagttcgcgggacaggagataacgaaaaatagtctcgtgcatgcatggattcggttagctagaacactggtgttagggataggataacaatgattaaagttgtaggccacttcgcccaatccaaagcttcgtctccagcactaggcacaggctttaattggttgccagatttggcagttcacaagcttctttcctgatcgttttggacaaacagtaatgtaaggtcttgtttagatgtactatatatatattcacatcaatctacgtatgatgaagtggatttgagtggacattaatttaaatttcactgtaatatgcttcaacgcgtgtggattgatccgaatatatatacagccaaacaagatctatgctgcactgtaagacagtagtgtgtttattttaacagatagataagctgataaggctaggtatccatgaatgaaacgagtccatgttcatcgcttcacctccaccgctcgtttttgtatcatcagtaattaagaaatttccttgagatcattaatctatcataaaagtatttgtaatcgactaaatttcatttccacgtggagcatggtctgaagatataatctactctttttcatacacaagctgttgatataatctacagatttaatttaggcccgatacatagacagtcgtactgaacctcgatttttccggaccatgtagggttaaggtgtttggttcaacctccactcatgcacgcaaaactaatacaccttttttttttaattttcctagaaatactagggaacaaaactaat

SEQ ID NO: 4004 - DNA, 1314 bp, Zea mays
  misc_feature (1)..(100): optimal_loci_129807_G1, chr3:224473931..224475244, Cluster 25
gagctccctctctccataccgaaaagaataagattcttatttttcaatgcgtcaaataatctcaaatttaatcataatagatatcatgggattggttataatatatatttataataaatctaatttgaaatataaatattgatactagtttcaaaacctaattaaatttgtgattgtttagttctccagtggaagagatatcttttgtttttgactcacggagtaaagtacagtagaaaggagaaaactatggcctctctacaagcaatacgtgggatccttgtttgtttcaaacctagactaaactatatatgaggacgactaaaggaaattagaaaggattagagagagttttgacttgtactagttctccctgatcttcttcttagtttgcgcgggggggggggggggggggggggataatgaataagggcctcgaaagggagaatgagagatttgacggttgacgtgcgcggtcaattaccggtgtgctacgcggcgcgcgacgtaatgcacaaagcgttggtgtggttcttttgtgaaagcccggcactctatgcatgtgttgtgacattttcaatcattgaactgttatttgtgccgtttgatttttttccgtactgggagaacatgcattttctttttctcttttgacaatttgctcagagacgttttcgaccgtatgtccatgaacagagaccggccaaagcaatggaaacgtgtaatgcctttttgtgcaggccacttgttagtagtcgtttcgcgctgccttccctgatataagtaatggaattaatatatccggatgcttctaagctgcagcccccgcgcgatgcctgcaggctgcagattgctatcgttggggttacattattaattctagttttatgtcaagtcacgttttatttaacgagattgatactcccatgaaaactgcaccgagaattaatatcgtcctaacggtacgttttcaattctatttggctttcgagtcgtttgattcaaacgttctagcaaattctatccagtggctccttgtctcaaaagtagtgtggatggacattatgctgagacccaagcttagcttgatgtgaggagttcgaataatattctgcatggctcaatttttcaattgacctttgggtctccgcttttcaaattatttagagctagtttagaaactcaaaccctacttagaccttatttagatactctcatgttcggatataaattataaagtcgttacaccctaatatacacctcaatacatatagattgaggtgaacgagattatccaaacaaagccttatggat

SEQ ID NO: 4005 - DNA, 1091 bp, Zea mays
  misc_feature (1)..(100): optimal_loci_130675_G1, chr3:228527780..228528870, Cluster 25
aggtactctgggtcattggaactatgtttggtgcaacgacaaaagtggatatgatttctactaggaaaatatttttggtcgttttgaagtggcggtacttaacccatctttaattccaacatagatggatgtggtgataggtactcattggcttgaactaaagtttgttgtggaagaacaagttcggagggttccatcaaatacatcaagtggaaaaaatagttgttgttgactctgtttcagaagtggtaaactctaaacattttgatgggggttgctctgaagatatggaagaggatgatcttcttgatgattgtgagatgggtaacgttggtaatatggcgcctattatgcatcatactaatggccacaaggtgacagatattcctagttctactattcatatgagcataatgcctatcgattcctagctaggtaaaccggcaaatgtgtatccgtccaacagttttgaaacacctttggtcgaggaagctcttaagcaagttgggaggttagatggtgatcaatagtctacagtaatgagtaaccagaagctgatccaaaagaatgttgtggatgtcactcctactaagaggagtaagcgacatgaggattcggtggacgaggacactatggaaagggacaaaagattgactgccattaaaaaaacttgatggagaaaaaggtaatggttgtgttaattcttttatgtctttttctaaatctataatatcacataatttatctagcttgggtattttgttaggtcacaatgaacttgatgtttctaactctatagattcagtaatgcgtctagagaaggatagattagaaaataaaggcgttcaaatcggacaaattagtcatgacagggaagagggtgaggagtcggatgatcatgacgatatggttatgaatactcttagggaccttagtgtaaccttaatcgaggaaaccataaattgtcatccggttgaagatatctttttgtataaagcacttaaggttagaaaaataaagggaataagaaaagagggaaagggtggagtaagtctaatgtttcgtcatgaaaggaatcaattgatatggta

SEQ ID NO: 4006 - DNA, 1291 bp, Zea mays
  misc_feature (1)..(100): optimal_loci_131858_G1, chr4:3029427..3030717, Cluster 25
tgttgttaagcaaattaaaaagcatagtattgctctcctcctagctctcacgctctctatctcgctgtgtctccctctcctccatttgtggctccccgtcctatgccctagctgtcgtcctctccatccacccctatgccaacatgactacctctgaaccccttagcaagtctcaccacgtacaattctttttaaagaaaggaattttattcgttcaaatacattacatcgagatgatacaagtctttaaaagttactcctggcctctgcaacaagagcatagagctaaaaaggaaaccggacacacgcacaattgcataaacaactgttacttctaaatgatgttcattggaaaagatgatactacgtcaatagaacacaatgagtaaaatacacatgaagatctatatattttccgaaggttaaaccttgtagattactattagtagttcagcgaaatttatggtttacttcccatgtcttacatagaaaagcccttactaaatgttgactaatcctggacagctagcacttctatatggaagaaagtactgcatagataactttgtgtcagtcatttgcacagaactttgtgtcagtcattttatatatttcacatgtagcagataagctaagtattcatggaaaaatataatttatatattgtttgaaagaaaacgttatgttgaacattgaaactaagcataaagttatcattagttatttctatggcgccgaatagatatgggagaaaagatggctgtcttggtccgtgggtgagctcgtggtgggcttcatcaagttaagatgaagggttcaatcgggccatgaataatcaaatggcagcccgttagtcctttattccctttcttttgtgtttgtttaaataccgctaaatcatctgcttgatagtcagtatggttgcagcggttaattgattagcaattaagcgatttccccggccctccgctatagtggatttcaccgattagtattggtcgtttttggctgtgctaattagccctagagccggctcaaaattcaatcggtttaatttgctaacaaatatgttgagaccaatagagcccaagtggaatacaaattaaagtagtacagataaaagatctgtgaaattttaacagcaaaaaccgcttcagtgagtttgagatagagattcgacatgtactcaagtcagtatcaggaaatctctgcaactttaaaaaaacaatgaaaaaaaaaaacagaagaaaccaaatcactcctccgccatcattttggatatgaacgggtt

SEQ ID NO: 4007 - DNA, 1339 bp, Zea mays
  misc_feature (1)..(100): optimal_loci_131865_G1, chr4:3040088..3041426, Cluster 25
catgttgtcatatccttttttgatgcagacttcatagtttactaagcctcatagtgtgaaatttatcatgcactactttatgagcactgcttctaacgatatctcctccccaattagcataaaaataatatttatgtaaaaacgatatggtctttgatgatagagcatctcatgttaatattctactcatgaatgatgatgtgaatgggatcagaccatcgctcgaggacacctaatgcgctatccaaattcaggtgcatatcatgttagatgtcattaacggaagtagtaatagcattggaattgatgttatttttgcagttctgctacactatcattcaaggaacattgtctaaagctagaatgttcactgtgtgttcatagtaagaatttcatacattcacatgctcataacaccatccatagcctcaaaataaaagaaagataagcatatcttgaacataatttatcaaataccaagttacaaatgtaccttgagtaaaactaagcataactatatgaaatgaacataaattagttggtgcgaccactatagggggttggccaaccacccatatgggcccatcagtatgttagtttgccatgatccatgtgaatcactccaaagtgacccttcaccgtccgtggaccaaagttgtgtttcttctcaagggtgaaaaaaatgaagtaaccaaacaagggaatcataacacatactaaacaaggaaggctttgataggccccacaccaaggggataccataaaaggaagtgagagggtcaatcgaccccccttggtcggtcgaacaccctagtgggcccactcaactccactacctccagcgtgttcatatgtaaggaaacatacccttggtgcatctccaccattccagccatggtggtttcatccaacggctcaagatgatgatcacatggatccatggccccacttgaagtagtataaatagaggggtatacttccctccatattcattaaacaaattaagaaataaaataagctctcaagcttaaattagcttcactttatctttgtagtgggatagtagtgtgggcgttagaaatagagttgagcattgcttaggttccaaactctagtcttctggtatgatatagctctaacaccttttaatttttatttctcttgcccttcgatcatgtggtgtccatgaatatcacattcttattttccttctcatcttccttatctaccccttaccttttctgcaagcttgtattttgtgtgactagttaggtcacctagttcttgggtgggggtaactcccttcaaaccacctctcacaatgattagggaggcaagc

SEQ ID NO: 4008 - DNA, 1261 bp, Zea mays
  misc_feature (1)..(100): optimal_loci_132203_G1, chr4:4194804..4196064, Cluster 25
tccgttttttactataaaagatgcaagccttctaaacatctctgatttttttgacatacctggtaagacatttctgctgtttgaaacaaagagataaacagtggagtgattgttccggtggttttttttttgataggtacgtatcgtaatgaactagctaccaatgtactgtcatgttgagtggtgactggtttactattacagagccgccgtcggtggcttctatcaccggcgccggcaactgcccattcaccacagtgacgagcgtctccctgcacatgtgtgtcatactgctcatctagctcacctacatatatatacatacatgcatgttcctacaaatcaatcaaaccatgcagatgttgaatatatggcttgttaaagattcagagttctcagaaactagcaaacgcgtgcagggtcaattcaaagccatggaaaaaaggcatgttgcttagtgccgcagacgatgtgcttgtatattcatggcgatgaggatatatgaagacgacagcagtgaccgaccgctgcagccacaggggggagaggttccaggtcgtctcaacagcactacgcatgcaactctgactgcatggtttgctgtgcaacatgtacttcttctatacatgtgtatgccttgcattggccattggcacacatgtacagaacagaaggtactaacgacgagtagtggtggcctggccttttaccttggctgcgttgacgaagaactagacaaccttgtatgcatgtgtgccgccgctgccagttgaacacgttgatccagatcgcacatcgatcattaattgtgtgtcactggaacaaccggcagcagattcagcctctctggttaccctgtgttttttttcattgccttaagccctggactggctcgtcagctcgtggtatatatacgtatactgcacaacaacttctactccctctatagaagaaaaaaaatacaattctgactctttaaggaaccaaataaatttaattaaccaaagttatataaagggtaccaacacttatgagatcaaatattagatcaatcaatggacttacatagtaaagttatttgaagacataaataatgatactactttctacaaattaggttaaatatacaagaaaacacttggctccaatatagaattgtgttctttttggtatggaatggaatatttcactatccaattggatctaatcagttttgcttgacgatgcatgtcttactttcgcatacactttgttcttcctt

SEQ ID NO: 4009 - DNA, 1082 bp, Zea mays
  misc_feature (1)..(100): optimal_loci_132378_G1, chr4:4791803..4792884, Cluster 25
tcatgtggtcagtggtctaggtttgaagtaaagcaccaccataagaatgtctccgaaacaaatctataaacaaataatcgctcagatttccatcatcagtaatcgaaatccttcccgtacaataatcatcaaactgtgccttattgtaatctgtttgtatgaaccaaagatttgctctaggaaacttcctgcagctgcactcatcttggatatactggctcctatatatcagccatttctcctcatcggtgctgtgtctagtttgccaacctttccttcaaaaactaaactatacatggggataccgctgtggtcgtggatcgagttatgtgtgtcaatagcgttcgtcggtcttgcagattacagtccttcgcggttctgttgacgatgctagtggaaactgtcactgaatacatgcaggcgcagtggcactccctgtccctggaggaacgagagctgacgcgtggaaattaactgagtatccggtacccccaattctctaaagtagatcacagtgcccacagttctgctacgtgtatcctgatgcctcgaaagcctagcctgcaattggcatattagttgccactacgtacagtgggagtagctatacatgacagatgtttatttctacctgtcctaggatcgtcagcagcttgtttatatatatgctgagtgatagtttgagagcatgggaattgatgggaattgaaggggattgagggggacaaaatcctaatttcattagcttgtttatatatacttagacctagtttaggagcaaggaaattgaaagtgactgagcaagggtttgtttgggagtaaggagtgaaggggagggaatccaattactattcaattttgaatggaaaaccaaggtaaatggaaggctcctcatagtctatgattagttggtaagtactaggtctacacatctttatttcattacttccattattaccatgcatgattatttaatgaactattttgtcgtaaagtgtctgatgcggtcgtcagggattaaattatgtgaataaaacatgttcgagtacatccacagttagttaagttctgtgtgtgaagtg

SEQ ID NO: 4010 - DNA, 1279 bp, Zea mays
  misc_feature (1)..(100): optimal_loci_132816_G1, chr4:6523543..6524821, Cluster 25
tttaaattatctacaagtttcttacatctatccttgtcaaaattatttacactaggtttggaaattaggggacgatatgactattatatacaagaatcatcggaacaaatcagtgtccagaatatgttagagtattgcatcactgtcttttggtcgattgggtcgtatattgtcttagagcctattacggggtgcgtccaaggcatgtgatgatccttagactttatattcaatagtcattgtcaagcttaggttttgggtttcgctttacatcaatttgtcaatgaacaattattattatcagctgtgaaaccctagtttcaagtcattaaccatacatttatagttgtctctttcgttgagctgcataccttttgagttattgcatgtatgctttgtttcataggctaagattcttcttctttgcagggtcaactagattagtgacacagttgataactagagtcatggtgctatggttgtaaggttttggtcttttgatttaaagttggatctttgtggcgttccaccaaaatgagagttatcgtaacttgatggaagattgggaactccatcccattagtaatggtgaagccatgttgtatctccatgcaaacaggactcacattgatttatgtgttgctactgcataccgctcccctaggccacctaaaactatttgctctttgaaagtttaaggatgagatagggtctcaagggagtggataatccacaaccctaagtcctacacccctcaagagaatctactaagagaacccatttaaaaggaactatggatggctagagagagggattgaatagcctaataaaatttctacaaactcaaagacactaggcaaagtgtgttagtaaaagagataatcttaacatccattaattgcctagcctagtagatacaaagcaaggcccatacctaattctagttgcaataacaagtgattacgtactcaaccaaacaaccaactagaagaatcacctagaaacttgtgaacctaagaagaaaggaagtaagcaacactacgcagtagggataagctaagcaagcaactaaacaaactatataagtagagttaccaagcataacacaagcacaatataaatcaaataattgcaaagttgaaagtggaaatcaatgagggcaagtgacacaaggaactttttactaaggatcgagtgcttgttaacaacctatattatgacctttgttgaggtgggtccttagatcaccacttcgctaagaatatggtagatatatcaa

SEQ ID NO: 4011 - DNA, 1034 bp, Zea mays
  misc_feature (1)..(100): optimal_loci_133462_G1, chr4:9912310..9913343, Cluster 25
agagcacgatctaatacatattggcatattggcatcgtattcaccactattgtaagcaagttattctaactcgtataagcacatgtcgtaaaaccagattatacataagatacaaaagatatatagaacctaggtgcaatttggtgtgaggtggttagaagaagacaatagatatatgtacagatatagatgagaagagaagagattaagtttgtgcaaacaagacctttcatgtacttttctccaattttttctctgtagataaactatgtatagttagttactacttgtttgaactactccctacaagctataggccaaagtctttatatgtaaacgcaattaagtatgattctacatatttatgcaaggacattagactagtcttaaataatatgccattaaaaggatgtagacggcaagagaagagtgaatatcatataaaagttgttctataagcttacaattattactagagtaaagttgaaatttgtataaaagctagcatcgaagcatatatttgttctagctctaattctcaatatgtaaaccttcctaacaattttagttgctaatataagtatctgaatagatttcacatatcttagcaactacccaaatttactataaagaaaaatacttcttacacaaaagacctctatactctatagatactcaagcaaataaaaacacaatgctaataatatgaatgcacatgctagtgtgataacttataaaaccaaatcgggcaagagcataaatacaataatattatctctgagatccggttgtttgtcggcaacctatgtcctcatcgtggtgagtcctagctagatggtttatgctctatttggcatcacatgccaagcatataataaagatgatgtaagaaccactcttagagatgcactccaacaagccaactgtctctttatagttgctcttcgtgaatctcacacgggaaatgagcataagaggctaagagcccctcaaacaataatcatagttgacaataatcacaaaagacgctctat

SEQ ID NO: 4012 - DNA, 1042 bp, Zea mays
  misc_feature (1)..(100): optimal_loci_133947_G1, chr4:11835466..11836507, Cluster 25
agcgtgcgagcactatgagagaaataaagcgatgtgactataggaatggaatctcaatgtcaagatttgttgcctagcttgccacattttgcctatcgttttctattgaaagctaggttttcaatttggctggctagttttagtcaaattgtggtgcaattagccaataaccaaataggtgttccttataccatcaacatcgacgccatgaactatggcgctaagatactctaacgttgaggccaatatcttggcattagcgtcattgatctataatattacaacgctggcctgaggatccaaacactctgctagtttcgctagagctgtaaaaataaaatctctttcgaaaaaggagtcgaaatacagaaaatttggtgcagctctagacgtagaaccattacacgcaaatatcggagcaaagaacaagaggcaccgtaggtacccagtctcgaaacatttgcatatgctgttattagttttcattccaagctatagctatcacaaagcgaagcgagcaagagcgcagagtgtgtaataattattgggatgggccccgctgggaaccaaaagaaaaggcgaggccccacgcgggagaaggacgtgtgtttggtgcttcctgtgatgggatgcgactctcgctttctcgagcccaatgagagcgaaagaaccatttgcagtgacataatatataatgaattatatatagacacacataatattccaattccaaacccatccacctctgccgctccaagttccgccccctcgaattgccagagaaacagaaaaaactgatggacgcggcgcatcaaatcacccgctcactccccgtacgtgttgttataccattcgacgctgttggcgatgacgctttctgagattcgtatatttaaccacgatattaaagcgacggacaccagattttatgatttgatgcccggtttgttccctaaaagaaaatgttctgcatattagattattagaagaggagctacgaaattgcgattatctatcaaattttttcttctaacagattttg

SEQ ID NO: 4013 - DNA, 1144 bp, Zea mays
  misc_feature (1)..(100): optimal_loci_134544_G1, chr4:14707946..14709089, Cluster 25
accggtgtcactaccgactcacctctccatccgcctatcgccgcctcctttgagtatccatctatcctccattgaatccatgccccaaaccaccctagtatcctaactctaacgtcgctaaagcaaaacattgcaagagatggagaatatgggcccaagctcgccggggatggggaaaaggacattggatctcacggggagatagggaactacaagttggagaagggagcaaaaaatttggatgcaagttcacttcaaaataccaaggtatcttatctcgtttcgtttctttatccatagaggtggtcaaatgacatgcgaaaatgtgtggctaggtattgaaagaatttcaagaatttatttccacgcatatttttgtctagtgaagatttttaagttgactttagtcttccgagtgtccattttagtggagcatgtggggaactgtttgttatattggcgaaggaattaggtttggactcagcaaatcgtgttatgtatattactgatgatgcactagtgtattatttcaaatacttcaatagaaattgccaatagattggcaaagatgaatttagataaaactttctttgttttcaaaaaggaaatgtgtttctcctactttagaccttaaaaattagagacaacgaacaatctgtgcatcactttatgaaatgctatccttttctgttagacatactaccataaaagtagtaataagacgtatccaatccaatgggcagggtaggccctgatatattgctttgattttggtctcttgagtgcatccttatatttggttcacatcatgagatgacgtcttattgcacagtagacgaaggaatcttaagcacgctaatcatcaacaccatgtccattccaacaggaactaaaggcaaaaaaggctaagcttgcccactagcgattggatcccgaccaccactagcttctttgagccaatctattgttccaactccagttttaagggtacgactgccagacgtacatatagcgtgcaaaaaatgttttcaccataaaatgcagtgtttatagggtagagatcgaaatacaagagatggatgagtaagctgttgaatatagcctaagtaaattggcagaatatttttcttgtgcagttttggca

SEQ ID NO: 4014 - DNA, 1141 bp, Zea mays
  misc_feature (1)..(100): optimal_loci_1416_G1, chr1:7428017..7429157, Cluster 25
tttaagaataattagcttttccctcgccacttaaccaaaccaacgatgtcttctacgatgttgatcaaggaggaatttctttcatacgatcagacccagtcttctatgcaattcatgaaaaatcttggcattcttgattttattcctcaagtaactcctactttccttgcttttggtcttggctcactccttcctacaaataccattcgtttgtgatgtggccacaaacatagtatagtagagaatttggtgttatcgcataaacatttaagtaaagttgtggaccaactgtctaacatagagggggaaaacagtgtgacttgtattcatcgcccaatggtactcaaccgatttcaattgcttcacgatgtggttgaactcacttatatttccccaacattcaattgatagaagtagtagttctttcatttcaggatatgtattatgtatatatagctttcgtcctctagttcaaacgaactttatctcatgcttcgtttatttcacctcaaaatggcctaaagttcagtacgaactaatagactgaagactagtttggaagggaaagaaaaagggagcctaatcttaatggggggttttatgttccaatttctaaagttcacataagttgaagacatatgggtaggcacggagctcatggtactatttgggaatgacattgagattttttgcatcttttttttgaaatgcattgatttaggaatgaaattgagatagatgcaccaaagagactgtcgtcccacctaaaaactgatactatcttcctataatttggtttgtctgacaaatctcaaatactaactctccattttagagagctaatgcaccccacaatcatacttcaaatatttagtgtgtttcctctatacaagactagagaagtgaggtatcaaaaatttccattagcgtttggctatggtaagacattctaaaagcaaggaatcaaccaatgggcagtagcatggagtcttaatcatgacaaaggatcaagtgattttgtttatccattaacatgttctcttcttgtagatcttataacaatgcaaatcttatagtatggagtttgagtgaagattggcttgaggctgaagttgagggggttgtttctcctcctcaaacc

SEQ ID NO: 4015 - DNA, 1157 bp, Zea mays
  misc_feature (1)..(100): optimal_loci_143777_G1, chr4:68751867..68753023, Cluster 25
tatagtgggacagggccactatgctcctagtttatttttgtttagattgattccatatatggcgaagtggttctaaaaataaaaaaatatgttcaaatgttgaatcatttgtctcccaaaaatctcccagacggaaccaaacactatcttagtacctcatggggcttgtacctaaaatagttgtcacttttcagttaaagaaagctttattgatttcaggtaataattaaatcaaaattaaacaatcactctaagatcatttcttgaccactacatagttagggtgcagaaaaacgataattattaaagaataacactactaagtgatgcacctctatcaatgtcagtttcaaaagtaattggataggcacaacaataattggattcagatatgtggcactaagcatttgatctttaattcttggagcacatcaacatgaggacatgtctaacatcaagtcagtgaaaacaacaaatcaaccaagtaacaatgaagaacataaaggcagtaacaacagggtgtcaagatcatcaagtcagggaacaaggcatggtagtaacagtaggggtgtcaagaaaaacaagtaacatgtatcaacaacataacaacaagtgattgtactccaagaaaccatcatttctgttcattgtcatcaaagttttttgttccaacaatttaaggcaacaatcatagatatcaggaaaatactatttcatcacataattgtgtgccaaaaggatgtttagaagattacataaaccatcatagttcatgatgccactatccccacacatcacatggtatgaccaagccatatgacatacaaaatcagcaggtgtattagaaccacctaaattagcaccatattgttcatgatgtcagcagccgcacacatcacatggtgagactaatccctatcctatacaaaatagcatgggtttttgaaccacctgatagtacaccaaagtacagtttcgatggtgtacatacaccaatgagcaaacacaatcatagggaagtagtgttgttcaatgtatgcccaatatcaaataaaaaccactgacagaaagatagatccaatactgccaaaccaaccagatgatggtgggaggggaagggggagtgcaaattttcagacctggtctgtgcttgagaa

SEQ ID NO: 4016 - DNA, 1313 bp, Zea mays
  misc_feature (1)..(100): optimal_loci_15558_G1, chr1:85999364..86000676, Cluster 25
atgaccatcatgaaaattgaagttgaaggacatgctttccgaagaaactactaggactaagaaaaaataaaacgctagtagatgatgtcacaatcacagatatagtaaataagatctgataagcactagatatataaggacaagaatctatccttttctggtgtactaaaaaatctacatagaagacattcatgtttctagcaaaaactttagaacccttgactcggaaattagatcatttacctcaacatcagatgaaccatgcaaagagaacgattctacaaacttagtgcaacaatcttccagctcaacttcatttagcgactttaaagtttatgagatcaacaagaacgcaaaacccaaatatacttttgaatgcctgaagttcttcaaatccacttttcaacaaagtaattgccatatcaaccatatccaagaagtaattaacttcaaaagccattccaacttataaaatttcttcatgggaatcaattttatcaaagtgtttcttccttttaccttagtggtttatcggaaatgatggttcgacacccatttcagatataatattctttgatgtggccatactagaagcaaaaccttcattcctataattaccaaagtaattcatcatatcttctatttgctataaggtagtgtcaatgcatatagatggtgattgtaactttttgctcatattatttaaagcaaataaaatgtcatgtcaaataatcatacgaagtatgaactcaaaactatcaagtgcatgtagtgttcgtgtattcgtatccttgcgctgcaattgtaaattgtgttggacttcagtccccagactccagtagagagtggcatagaacaattgacgaaatgacgatgaaaccataaagaactgagagctccatagtttctttgtattatcgtttctttcctttggattcaatggtaggacattggcatgctttagtttttgtccttttgggggttttttactagacaaaaaagatactaatataggaaaggtagaaggaggagcttatcagatttggagatctacgacaaccggtttggtggccctctacccaaatctagccataagttagggttaggccctagttagggtggtgtgtttgtgggctgtggcgacaacgtgaggaccaggagatgggaaattcaccatatctaaaacacaagttacttccgaaatgggtcgtgatagcatcttattgatcataaaagtttcttattttcctaaaggatgtgcagtgcatagagttatttctctctctcctcttttataacaatatatacgtaga

SEQ ID NO: 4017 - DNA, 1227 bp, Zea mays
  misc_feature (1)..(100): optimal_loci_155814_G1, chr4:151517609..151518835, Cluster 25
caaagtgtgttctatagcaacaatctataaattaaagttgtcatagtgtggcagctttatttagtctctggtgggttttcatagtattaaatcaaaagatgcatgcttcaagggtcaggacttaggacgtactggctagttttacgtgcaattagagttgaaaaacacgtgaaatgttttaagactcgtttttgcgttgggtcatactatttggtgagatatgtaagacgagtattgttggcatgttttagccttctagctttagattacttattcgtttccaaaatgagtgtacctcctaacaaatcttagatttgagtcgaatttatagagacggtattaacatttatatcactaatataaatagattttaaaggaaagaaatcgaaacgtacactcgatagttctacagatggttctctagttttaacctagaattcggaacaattcagtgtgtgttcgtcgctgtagatctagattctagtatataagtgtttcgaatctagattatctccgagactctgaaaacaatccgagtgaatgaagaatcagaatcacttcacgaaattgtttggattgattgagataactgaaagagttttattataaaaatcattttttataaaaaacacataaatgaactatgcttcaaaaaagttgtattttttttgttgaataacaacttcaacacaaccattttaacacattgcactaaaaatattataatttaaaactatatatagtatcaagattagaatttgaaatcaatcttgtggcgttttgagtttcaaagaatacaacactgcaaaggttgcgtatgggaaccaacaatttttcataatatagaaagcaaaacatttggatatatagttgataaaatttatctgataccgaggatctctatgaaaccaaacatgacggaagtttctccttagattcatgtttgtcacagattcaacggtcgttagactatatccatcaacttacctatccatatgtcaatattcaaacatcactttgtgaacaatgtagaacaatgtaaattagtgttttggataactatatagataaactgttggacacggttagaatcggaactggttcagtcctcaagggccctatgtgtctggatcaattttgaagtcaactagactatggtagccacacaagttgttccctcaatggagttagagagccaattactttaaactgataatgactcttttt

SEQ ID NO: 4018 - DNA, 1096 bp, Zea mays
  misc_feature (1)..(100): optimal_loci_156007_G1, chr4:152444201..152445296, Cluster 25
ccaaaacaacttataatttggacctagagggattcaaatttattatagcaccatagcaatcaaatttattgtagtagttaacgaccgatattatatttattccttgttatcgtcattgatgatctcggccattaattaggagtgtgccgtcaccaggagtggaggacctaaaagagggccactgcagcagcagaagggatcacacccgcagagaaagggagtttgccaggggagggaccaacattggagtaagggtagttataagcatctagatggctaaaagatcaattgcctatttttttacaaaaaacaaatactagtacaaaattgattagtacaaccgaggttataattgaaaatactttgcactagatgacaacaccaacaagctactagttagaactaattacacttgagagcttctaatagaagcaactaacaactagttactaaactaagttaacctacaatagtaagctacacaagcaaatattacacaaccaaccacaagatacaaatgtaaagagcaaggttgaagtttgcaaactaaccagtgttagtaaagacacaagatttatcctcaaagttcggtatattttagataatctacatccttatttatgtgctataactagcacggcaagctctacccaaaacttgggtgatgcaagaatcaacaaagtggtgcactccaactggccatgagcatttcattagagtttctctttgcgatcttcgacacggggatgatcacagagaccctcacaagagcttgactcgagccgacaacaatcaccaatagcggttcaacgatccttctaaccctaagctggctaggtgatggcaataaaaaagagtaatataacaagagaacaaccatcagctagccagaccgcaagctactagtgccacgagatgcaagcataataatgggttggttctagatgtatcctagtcgttgaggaggcttgtgagcagcaacatagagctagctaggtcacattccgctaataaaaccaagagctttcatcgttccacacgtattatgtagcgaacggagagcttaattgtgcaagataccatgaacatggacatg

SEQ ID NO: 4019 - DNA, 1075 bp, Zea mays
  misc_feature (1)..(100): optimal_loci_157280_G1, chr4:158472395..158473469, Cluster 25
tcagaacctaattgtatgaatcatacacagctgaacctcgaatcatatgtggcaagaactcattttttctttagattttattcgttatacgatatttggtcgtaaatggattatgatcacatgacttgaataagatatttttcatattcattgtttatgttgtagctacgaaatgctttaaattatgttgtgattttttcgtcgttgtgttacaacaccttgattttaacgcgttctttacccatacacgtgtcgctgccacgacctgctccacgtggtcgagctgacactcgtgtcgtcgccgcataggctggctagactgctcctgctatggtatgctgttccatttactcctgcttcggtttggtaagcaggaagtggtcagccactgtcagaccacacacatatggtaggtgagtagccaccgctaggagtcgtgcctcatgccatactttccttcttcgtctgtataggggacgaagttacagtaggaagagaacagaggaggaagaaagactttttgccaagagatgggtccatgcattaaagggcatgatgcttcttcaatctatttgagtacttgtcccttttaatctacaattcagtttttttttcaatctaacatcttaaaggttaaattttaaaaaatagaagattattatgatagagatgctctcttaggccgtctcgaaagaaatacggtaaaactcgatcaatcatatacggatggagcacttttcttcaacggctttctctatatactccttgtatatggggagaaagaatttctctacttaaattacatcgtttatttatgatattaatcctatttaaatcttgtaacatgataataatattatagtagtataaataatgtatgattttttaaaaaaagttagaagtggtaaataaatgttaaataactaagttattgtatacaggagagttgtatagttagaatggagagttgtaaaggcagcatggttgaagacaccgtatatgtagagacaaacttttatttgaaaaatacgtataagtggagatttaaaaagacaatggtacaaatagccttatc

SEQ ID NO: 4020 - DNA, 1057 bp, Zea mays
  misc_feature (1)..(100): optimal_loci_157716_G1, chr4:161161588..161162644, Cluster 25
gttataagaaagaaagacttataacaagtgactccgtgatatatactgatagcatcgtaggtaggacggacgatcatccctgaaagcaagtcatcacagacgatagctcgccaagctagattttcgtgctgtcgtacaggtctaaaaggatccttttgtttgcctttttcttaaatgctattaatttgatatcgcgagatcttcacgggaggacaggaggatagtctgctttacacctaggttaagagcgacaaaggcttctgcaagctaccagttgttgcgttgggggaaagcactctatgtctctatccaggtccaggaacaaaaaagccacgagagtcatttcctttaaaaaaaataagaagacagatagtagtactagaagaaacctggtgctttattttaacaaaatgtcctgagaaagcagaagtaacgagatgataaatggagagctgaaaagtgaagggaaagggcgttttttgtttggtgtgaagagtgattctgaaccctgtttctttcccaaactacttccaagagggaaacccttttaactccaaacataaaaataataataatatttgtgttatataattagtatcattgaatggactatcgaacccgtttttacaatagctctattagaggtataaatattattgatattttctttatataaatttttaatcaaacttcaaaggtttggccagtatagcgatacttattactagaaaaggaatgtttattacttggccaactgtactagtatcgtaccgagtagcagcagctgtcatttgcttcgagaaaaaaaaacagagagtttgcataaataatgtcctgtcacccaaaagacacaggacaggagtatgctatgatgatgaagataccggacggagccaggtacagtctgtacgcattgcagtctcgtatcgtagcgacagtcagcccggccaagaaagaacaccctggcgccgcggctccccagtccccacgctggaaaggttttgaatgagaggcaaagcaaaggccccgccccgcggccgcctcgccacgcacatgc

SEQ ID NO: 4021 - DNA, 1218 bp, Zea mays
  misc_feature (1)..(100): optimal_loci_15964_G1, chr1:88514434..88515651, Cluster 25
tgatactattgattgagaatagcctaaatatggatcggtgatgtcaagactcaagacaattggaacgtggttcaatgtgtggaacatctgttgatcaccatcatcacatgagtaaaagcgaccagctgctggcaccttattagctcgttatcccgtggtccatgatatgttggtgttatcatttattagtcaaaaactgtttcagttcgagtatacactgtattatttctctttagttctcaccggtgtctccaatcaagatctttcaacgaaaataataaactactgtctccaatcaagattttattggtactagaattatcttccattagtaatttttagccaacgaaactattagctttggtttattcaaatctctactattataacgtggaaatctgttctctcgtcatcctgtttgcacccaagttcgctacaagcacaactacatgccttaccacctgaacacatatttgtttgtgttatataaagagtgacattataaatatatatacatactattaattagaaaacaaaaaaaatataatcatattttaataaatatatcatttaaataaggtatacctatatcatagaagcggtaaatatatggacgactaactagtataccattcatctatccttgttcttctatcgagatcagtgtatgcacgtagccaacaagaaacggcaactgatgttgccagtccaaatggcatctggttcctgtacattttcttcagacgagacgtctttaacttgagagacttggaaggcaggattgcatgtataaaaaacgttcacgtcctgtgcgtcaatagatgtggtcaaatcacgctgcgcccccggcgttgctgcaccaattaataatcaacatgaataaatatcccacccataataaagcgacggaccaagcaaccccccgccaactgtttaactatagtctatagctagactgatggagacgaaccgcgctaataaacgtttcgtttcaaaagttccaaccaccaataatcccacttataacggatgaaacatgcatatggtcgtacgttcacatcagattaataagagattaacagtagaactgtgcacaatcaaaaggcatgggtccgagtactgtacttcagttgatgctatgacatatatataacacctttttcgaatattttaaaaatggcttcatctcttgtttgcgagagacaacttattactatg

SEQ ID NO: 4022 - DNA, 1175 bp, Zea mays
  misc_feature (1)..(100): optimal_loci_165424_G1, chr4:204679197..204680371, Cluster 25
cgtgtaatatgctttggatttcgttcatgtaccggaaacaaacggaaaggtgacgcaatcaaggagccagccagatgaacatgaacacttgtatcccgtgattagagggattgtatctccgtgatgaggaggatttaacaatgtatctttttcattttcatagatcaattaacaatcaattcaaaaaatctagtaaaaaagaattgatatggatcagacttgttcgacgcaagcaggacggatgagataaacaactgctgtggtgccattttagtttgtttttcctcattaaattgactacatatgccacgccatttttgtaggtgccaggttggcctaacaggatagacggactccatataagtatataactaattaattcattgtgtctaaatagacctaactaataacttagttaattttagtagaatatctgatcaacggaagtttcactacttaaaagaaataagctaataagtagctagctaacaaaataggtctaaatcaattgaagctttacatgcctcgtccttaccaaacttatctttgtgtcatataaataatttgatcaagttgattatcaaatcaaataaaaatgacaagttaccacatcttggtaaatatgtcacggactcacggtgatcgatcggtgcgtaaaaggtccgtatggtacagcacagacagccgattgctgaatttttgttgcatgtcagatgggacgtaggaacagcttgttcagggatgagatggagaatcccactcagtcattgccagatcatggcgcacgtgatctgcacggtagtggtgtgtggtgaatggtgatagggaccgcgtgagaagtgcgtggctgtgacgaggaccgagcgtggtcgcaaagagctgccgactggatgacagtaagaccctacggttggagacttggagtaccgtcctcgatccgtctctatcgattgtctagtgatatatggtacggtttttattggtttgtgtcatttttctaataaaaaataaaaaataaatcctggaactcagtctataaatagaggagtgtttgattattcacacaactcaaactttgaatttctattccccctcctcatattcatctcatcctcatttcacctaagctaagcgttgttgtgatgccttcgtttagttcggatatcgacatgaac

SEQ ID NO: 4023 - DNA, 1381 bp, Zea mays
  misc_feature (1)..(100): optimal_loci_172493_G1, chr5:727610..728990, Cluster 25
aaagactctctctttccttgagattcttaaggtggacaaataagcaagagagcacagatagatgagacagatgttgtatatatagccctatggcatggaactactaattgtgcctccactcaactttcacgagctcatcacacatgtctagtgtcactagatcctcgcaccagatacatctagtaaagatttaatggctagtttttgaactagccattattgcactagaatatggtgcataatgggtggttcttatcagacatgtttggtggaagcattgcctcaaaatccacgaccttaagcctctctgaatttcctattcaacggggagttcggtgcaccaccgagcacattcgatgagtgcattggctcctccatacactttgcaagcttctattgagtgtcatgtttagtgcaccatgaatgggtgcacatttacacatcgatatgattgctttgtaaataagaaattgttcataattgatgcacatcagacatgtctggtgcacctatagcaccaccaactcatcttattcaaacactctcttgagttggatttgattccaaacttctctcaggcttccacaaatccatctagtactatattttatatgtctgcatcaccacatatcactagacttacctaagtaaagctaccaatccatgccctcattcatagtatggccagagaaaaaacaaagatcctatcactattctaattatttatcaactccatttaacacttagaagtagacaatccttacaaatctctctcatcatttgaaatttgaaatttaatacctatttttggtgaagacacaagaatacctaaggtatcagtgggaggatcattagggggagcggggatgagtcctagtaacatagagtgtgcctaccaaatcatgacatcacaggcttaacgacatgagggaacttgtagtggttccctacaccctctttttgatggtggttttttatgatgggtccttttttatgtccgatgcatggagtttggtgcacacggatagtattgtgctacttgaagaaacacaacacatgcatcaaatgtgttcgatgagctgttcaatctaagacatggtattctctgaatgtacattttcaacgatttctttgtgtatcttttagcaaaacgagttcttattcaaataagaaacaaacaaccaccaattaggactagtattagtgacctatctcaaagcctcaagatttaaaatgatttgctttatgctagttatatttttatgaacataagaaataaagcgggagaggggacattgtgtcatcactcaatcaaggtctcaactattaggaatgtgaaatgctcccctatcaatggatgataaaaacggatcctcgaact

SEQ ID NO: 4024 - DNA, 1204 bp, Zea mays
  misc_feature (1)..(100): optimal_loci_172937_G1, chr5:3163315..3164518, Cluster 25
gatcagacccatgcagtggcaaaatgaggtatgtacgtttggtttgaataatagaaatattttagataaggcgatgaatcgttagtttattttgtaaactgagtgaaatgtttttattccttacactactaataattattagtttctagaaaaataagatggctgtacatccatcaaaggctagccttgagctttgtgcagtgcaagtttttttttcactcgcctagacaacaagcccataacaatggtcatgaaaccaagcggtttatccggcttgccggccggctaattgataattggtgcctgataacaaaagtaaaacaacataatatataatatcaaataatattgtatacgtcagcatacataggtctactggagatagtttaacaaaatagcgtttggttgttttgatatcgttcgggacttgattttatggatgcaaaagcagccaaaacagtctggctcctgataacaaaaataaaatccatttctctagatcgatgtttacgggatacaagatattaacatattaattatgttgttagtatatgactaacatgattaaatacattgatatatttcaaagtaaattaagatttaatgggataaaaataagtaatatacaactgattcaagtaaaaatatatatcttaatacttattctctaacttaatttaatttaatactccctctatttcaattcatatttttttgttttaatatcgttagagactagattttatagatgcaaaagcagccaaccagtctggctcctgataacaaaaataaaatccatttctctacatcgatgtttacgggatacaagatattaacatattaattatgttgttagtatatgactaacataattaaatacattggtatatttcaaagtaaattaagatttaatgggataaaaataagtaatatacaactgattcaagcaaaaaaaatatatcttaatacttattttctaacttaatctaatttaatactccctctattccaattcatattttttttggcttttttaccaagtttgaatagcttcttttattctaaaaaatttataattattatttatttttattgtggtattgtttaacatatattattctctatatgtatctctatctcttctctactataacaaaacaccagtttcagcggtcattacacggatatttttatgcctccggtc

SEQ ID NO: 4025 - DNA, 1078 bp, Zea mays
  misc_feature (1)..(100): optimal_loci_173396_G1, chr5:5916546..5917623, Cluster 25
tactcctatcttgttttgtgttgctaaaaaaacggcacgccctatcttgttttgtgctgctaaaaaaaacgacacgccatagcgtcaggtggtcctggtgtgccacttctcacttttcaagttttcatggaggagggtcctgacgtgtttataatggcacgttgtcgtttcgttcagagtctggtggtttgccgagtctggttgttgacttgttgttgcctctccttaacccttacctccaaaaaaaataatgtacctgcatctgtctacgtcagcgcttacggcagttcctatgtcagaagcataaaataaggggcacttcagccgttgaagtttcgagttctctacttctctaccatgcacctgacgattcttcgcttctgcttgtgagcaaaagctgttacttaaagctgagtaatgaccctgtgctggtactctgatcgttctaactagctgagagttgggaccgggttcagctcacccaaaatactttttttagtgcgtagactgtattgttcctagagtaaagtttaaatacgagaataaagatagataagctactagaaatagtctaagatggaaatttcagatgtttctcttttagggtcaattctctatatgtcattgaaaaatataattgttctttatgtgtcattgaccccatatgtcatagacaccaaaaaatgtatctatatgtcacttagtgacatacaacgaatgaatataaaatctgaagatatactataaattttcttttttttctgttggaacctgaacttgttcaactcctgtacggttctaactgcatttcttgaattccccttgcagtttggaggtcatgcctgtgcacggtgcaagacgtgaggtcatgcatctctctcttatggctcgtgggcggccaccacgtgaggtaatctgtgacctggattgcgaatggggaagctgcgacgaagcatcggcccaaccaccagaggctggtcaatgctagccttgctttccttcgacgtgtaaagaggtgtcgtcaccgtcactgcaacgtgtaaaatctagcggatcgtatgtgtgagaaatttcagtc

SEQ ID NO: 4026 - DNA, 1127 bp, Zea mays
  misc_feature (1)..(100): optimal_loci_174030_G1, chr5:9886806..9887932, Cluster 25
aaggtataatgatatttaaacgaaacctactcgatcgatagcaaaatagcaaaacctacttctcgtagtggcaaaattataatttttctctaattgagttgtacatatccttagttaggcaaccaacaaagagagcaaggattggcttgctggtacttgggtagcatatattgtgtagtgtaaatgatgttgctcatttcgatcagagtaatttggggacctgtgttgatgtgcatcattttttgaacattgtcagtagtgtggatgtattttgaacattgacttagtaaaaatatatataattacatcgggtcatcgtaacaaaccttagctctattattattgtgaccggtgatagtaggacgaagtgtgtaatggttccaaggacatctaccaatcataatatatattgtaagaatataagtatcaattcagccataaatgtagttgcatagactagataagtgtgccctgttattgccaagaaatctggttttgttttgatccaacgatgttaatcgatagatgtataatggaaatatggtgggtgggttccttacatgcttcataattttgtggattgtaaaatgagtatttatcacatcgggtttgaatgttgttttttttctggagcaaccctgaaaacagttgatgtcatagatctcatttcccttctatgattgttcttttttttgcaagtttgtatatcaacataaatagatcactctaatagtttgtttaattgtcagaaacgtatggaaaaatttgattatttatatagatgaaaaagctttaaaatgatctagaactatttttttactatattccataccttgtctgttggcaacattggacggtttctctttccttgtgattggttgcggcacagtggcatcctggcttggcttggtcagtaggctctatgtggctcaacttggtgtttttgtttggttagttgtgcagactcgtgtaaactagacatagactttatttggttacttacactgacgtatattagagaaagatgcgtaagtaaaacttcaaatactatatagcatgaggggtctagttttgttcgtgaaaatcttacaaacataaatatgaaatcggttcgaggttaaatcttc

SEQ ID NO: 4027 - DNA, 1157 bp, Zea mays
  misc_feature (1)..(100): optimal_loci_174960_G1, chr5:15099173..15100329, Cluster 25
ccctaggacgacatatggcgctccatgaatggtctcatgcatacaagaaccaacgaaacattgttgatgtactctacttttagttagtgttaggttccagagtacggtgggactcatccaatccatttcaaatttgttgttgtttaaattggttctatatagaaccgttccatctcggaaaccaaacactagcttagtttttgctcgtgtgatccgcgggtcggtctggtcgatgcgtaagggatgaccaaactaaacggtgcaagaagatgcaacacatgctcaaacattcgttcggctgctgggtttcgcgacaacagctactgctagctgtcgcggtggaaaagtttgcagctacagtgaaagtttgcagccagagcgctggaaatatgcagccgacctgtactgtgtatgaaccaaacgtcatcggagacgcttttgttgttgaagataatgcatggtagtctccaaatggatggtattaattgtttgagttggccccacggaacagacggtgggtttcggtctcagaaactccattgcacacagcacattcatattcgccaacaacaatgcctttctgttttgtaccggaggcgatcgtgcgcagcagaagacatccggatcagcagcaaaagacaaaaacagttgtttaaattactgcagctgtaatttgtaaagataaaaccgctacagaaatggtataaactggtacagattaattaaagcgggcccagatactcaagacgaatttgaatactagtttgatatacgtactgcatgtttgtcgtaggcactatatatatcgtacgacaacaccagaaaattgaattcaggatgatctcctatatatttaccgatagcagatagatagcacctttctctctaccacttcctcacactgtcacacacctgcttgagaatcggctattttgttaccgcatatgattaaagtgtaagcatgcgattaactcttgattaagaaataacttttattcctctcctattaaaacgtaaaaaataatatgtttagagttagcttataagtagagctcgacccatttacaagctcttgagctagctcgaaaaccagggattaaaaagtatgaagatcatatatacatttatatgtatctatctgaagcttgaaaatacta

SEQ ID NO: 4028 - DNA, 1086 bp, Zea mays
  misc_feature (1)..(100): optimal_loci_175599_G1, chr5:18782242..18783327, Cluster 25
aacatcttataatttagaataaaaagaagaagagaaaaaggcttaaataatacgtatagtgctccactgaacgtgtgtgctgctcggcatggtaataaactgcctagctgcctctatgaatggggaattgtaacaaaattctgtaacaaacttctagagaaatcgtcttcttcatagagtcagccccatttctctcctattcatggctgttcgctttagattaaagccgattgtttagactgttgcaactacattttataaagacaaaaacattatataagtagtagaagtcggtacagattaaaatcaaacaaactagtgagtgccattatatttcgtgaaccaagcactatttcaatagatttcaagcgagaagcgacgatgaaggaaacactcaataaactgagaggactcgaagctcggcggctgaccgatgacaaatagttcagatctttggtgttagagtgcttttacaaggactagtactagctgtaactcaaacagctcgatgcgctaaagcagatgagatacgttgtggattactaaactcgatttgagaagctggctcatgaatttctccttcacaataacgctatgatgatgtttacttcgtcattcattcgctttgttacgggtcttcgagatgacattaacaacatgcatggtatcgttgcatgcccatacattgtggatagccaatgctttagctctatgaggaaccgaacaatactacaatgaagtgctttgggtaggatttcaccaaaggaaactgcaaatctcatctgatttagcagcacatgagtcagtaggggggagattaagcaacaatctcctcgtactgaaagtgatgacaaacttcaggtaatgagattttcccgtaagaagaacgacatctgattcaaatgctgtgacaaatggggctccaaccatacgtaatcgggacaaattcccctacatgtacaagaagagctactacatgcaatcgggcctagattctgatgacattgttctattccgaatgatatgacaccttagtggtggagtgaattagacaatctatttctcacatactgatgtctctgtttt

SEQ ID NO: 4029 - DNA, 1130 bp, Zea mays
  misc_feature (1)..(100): optimal_loci_176815_G1, chr5:24690969..24692098, Cluster 25
ttgaggtttcatctcactgttcacaaaactaccatatgttggaaatgttggtaactttttatttcataaaatctatttcagcacataatttttttattatcacatatctctccattggtttcataccgtgctaatttatttaatattgttgtggattcgtccacacaaaaataaatttctaggttaggatggggtcagcatattgttgtcgcgacggctttgttcttagtgagccttaggaagaaagtttagagtagtttggagagaactcctatatctagtatggtgttgatgtctttgttggtttcgtgagttataatgcagagcatttggctctcgtgcttgtgtgaggaacgttacaaactaagttcacataccttctacatggcggccttgtccccatgtatagccaaggagcaagagacatgttgttatatggatgtttttatgggatgtgttactcttgtctttggacgcatcactctacaagtgccttcctaaggtatgccgcgatgaatacgtctgcttcatcatccctaagctgacccagccatccttaagttgggcgaactgtgggggtggttgggtcatgtatgtgtccaagttcctgtcatggggtacacctctacaatcagtgcgggtatttttccttgtagttttctccctcttgcttctagattgtttagctctgttgacttttttcacctaagtcagagtgattgggtaatgagccatcagagtcctttgcattgttcctgctcctatcttgcgctagaggcatgtgctaaaaagttagagggtcacaaatggtgtagccttatatgatcccttttattctgctcagtctgtaagggaagtgtgacgagtctaggaagtgcgactagcctaggagaaactcgactggcatgttcaagcttgggattgactagtcgaggatggaatcgatttgggaggatctgggtcatgagggaccttggccatggttgagtttgatttggtcggggtaaccaatttggttctagcatggtgagaaggtctatgtcgggggaattttagtcgggttgctactactgggatttggttgagatgacatgaccaaggacatgtctagatatcgttcatgttagagc

SEQ ID NO: 4030 - DNA, 1171 bp, Zea mays
  misc_feature (1)..(100): optimal_loci_177462_G1, chr5:28118926..28120096, Cluster 25
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(163): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
gtgtaaccaaacacctccaaaatcatagggctcgagaatctccagagccagccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattgtaagaactgcaagaaaaaatgtaaaaatttggggaggtgttttttcttcttaaatttagctcgcggacatctaggggttaatctcacatagaccgtggaaaccaaaatcccaccaactggaccagaatagtgtggttttcaaatcttcggcgggagaagggggctattatcggggcacatttaatacccgggacgaaaggtcaaaccttagaaaaggccgggggtaatttttagcggggccccgccaacacccccaaaatcataggggcgaggatttcccaaaaaagccccccccccccccccccccccctgcttcccttccttcctttctatctttctttcttgtgaaacccttttcctcgtcctttttgtcttcactttctctacgatgatgatcatggttcttgtttccctcttagcttgttgctattcgtcagtcgtcacagtgtggatgttaggccattactgctgcaaagtgcacctctgtttatggacgaccatgaaatcatgaataccagttgactattatatctatctatatctaacagaaaaaaaggtatcccatttaaatttgtgatttattacgaaaatgtaacggatggatgctgacgctctaacgcaccggccggcatatactattacgttccctttccaagctagacgagactactactacgaatatatattctctcggttctaaattatatataaatcgtttgaacctttttttaacgtacctaatttttactgtatataattattatacatgttagtttatctatatgtaataataactttttaacagctaccatgcacgcactcgacttgtaccagggttacgacgatgcgtgatgactatattttgatgtgatttttttagtagaattggcgcagctaaaaaaaaatcggatgtgcgtgcgtgggggccgggaagggatattacacccagtaatttctgcaacacttctcaaaaagcatccgaatcttttcttcttacaccat

SEQ ID NO: 4031 - DNA, 1276 bp, Zea mays
  misc_feature (1)..(100): optimal_loci_177464_G1, chr5:28123309..28124584, Cluster 25
ggagagagacctttttcaccgggcatgatctaatctgaaatagcaaaactgtaccacacacagttttgtttattccgacaggccccgcgagaacgatataaattgcaccttttttcctaatgggaaaacctgtgacgacgttccacccctaaaactacgacataactttgaaaaggtggcaacacaaaaatctagctcactttttttttgagccaccatggaatctcgcgtgggttaagaaagggacgtctccatcgcaacggagtgaaagtgatgttccggagagaaagctattaacccatgcgacgaaacgactatatatgatcgctctttgaacatatgttcacaacatgttcgcgtgtttcgaaaattctaggttatttttaagatataatattcctttgtcactctctggtcgttctttggacagtattatttgtgagatgtacgtaacataagccatcgttgcacatccactaacactttttcttctccagtatgtagtccatgcatgcatttgtttcgaattatacgttagtttaaattttcaagatgcatcgttttactatatgtatctagacatagcgtatatctagatacatataattatgaatctataaaagttaaaatgtggtgctatgtaagaatgcatgccccgctattgattcatggccgcctaagccactttctctagtacatgtggtgcagtgctcccactgtagatccagtgtctagcaacttagagcctctcttgggggcctgctacatgcaaagtgagatcataatcatgcagctattgggtttggccatggttctatcaaggccaagcaaattagcaagaaaggcttacaagacgatctatgaggttgggtcgaacgcttccaagttccaatgttgaagcgttgagagttctcttgtaggatgttagaaatgagtcacgctggcaaccgcgcggatgcgcaagcccgctttctaggtcatgtcgttgtctttatcttggtttatctaccatttgtccatttgtgtaatatcaaatttcgaataatgtatatgccaggatggccgagcccatatgattgttattctgtagatcttctaggacgataatatcgtaaacacgctgtctgttaggtccttgattacaataatactcataattccaatgtattcgagaaaaccgccctctttctagaacctagagtgctcaaattatactaagaaaaacagtggtcaaaggcacgtggaagaccatgtcatttttgactgggcgcgctag

SEQ ID NO: 4032 - DNA, 1035 bp, Zea mays
  misc_feature (1)..(100): optimal_loci_177471_G1, chr5:28190080..28191114, Cluster 25
tccttacagaaatgattgagccaatgctttgatcttgattacctgcaagaatttttttaagtgcctaacttttgagaaagtaaagggatttaaattttagaatacaattaagttatttgttgatatactgccgtcacaattgcaggaatctggtgtcagaaaaaagttaatacaatttggaaaataaaataatggaacaacatcgatggaaaaaaacatatggtatatgatatgtgattttcattttacaaaaacatataggatttagttgaaggacatgtttagctttattaaaaatttcataatattctctatagatatacacaagcaatctctacctaataaacataattttgctaaaagagttcatactgtaggcagatctagctcaccccgctacaacaacaatgggtttgaacattatttatttagaggttctattcttgttcaattgtaaatcaatgcaagaaaaacaacaaatttgtagtgctcatttatgatcttattgaaaagttgagtgttcatcatcttcttaatcgactgcatttgtggcgtgaacaaaaaaagatgaaagttttgtgagagatactcaattaggtactggggcctacaattcataaatatgtcacactttgcacgattttgaagcatatatttaaaccagtattgagaggttctattcttatattcaattgtaaatcaatgcaaggaaaacaacaaatttgtactgctcatttatgatcgtattgaaaagttgagtgttcagtatcttcttaatcgattgcatttgtggtgtgaacacaaataaggatgaaatttttgtgaaagatactgaattaggtactaggacctacaattcataaatatgtcacactttactttacacgattttcaagcatatatttaaaccactattgagtgtttcttgatctccaagtctttgcaaatccaaaaatagatagaaccaactactggagacattcaatatcatgattccatggaatggaagtagcttctcaactggcaggtttatag

SEQ ID NO: 4033 - DNA, 1013 bp, Zea mays
  misc_feature (1)..(100): optimal_loci_177647_G1, chr5:29064229..29065241, Cluster 25
cctaaggtgatttccttacgggtcacatgggcacgtatgatatttgtgactatagatattggattatatgccacatgggcgtgttgtaaatggtaggcatcatgtccctctgtacattattgtatgttatggtacattttatgttcattcttgtggctataggatcgatgcaggtactttatagtgttctcgattgtcttatagcctaactgtgtgtcatcacaactagcgaggcatataattttgcccattacacatttaatatgttataactaatacttatctagtaagctatcgctaagaaatactccattggtccttaagatatggatgctactcctagggccatacatctacaagtgggcttgacaaatcttctatcatgagacatgtttacacttagttgaccagagccctcaaactctttgagggacccctatctcagagggctatatcccaacctacttcaaagtatgaggtcaagaactctaggatccccatacctaacaaagggccccgagcggctaagtacaacaagtgttcggtgttagactacattaaacaattatttccttattaccctaagacataagaggccctggatatttataccaataagtgtctcaaatcatggggtgccccgaggacctagtagtaccttgacacatgaagtaccttaaggaacgtctatcaggtgcccagggcacgagaggccctaggtaattatacttgcaagtgcctcggggcccgtgacaccctgatgacatagtctcatgggagcctagggcacaaggggctccaaggtcctgttttcgggttagtgcttcgtagcacatgctgacttggagacttataatattttacccttagacttagaggttatagagtgcttatagctatgtgctttataacagacttgaaagaccaccgggccatcaacagttaggtcaactcttatggatgtccctatatgatgttacttagagttgggtctctcgtttgatcaaggcagg

SEQ ID NO: 4034 - DNA, 1283 bp, Zea mays
  misc_feature (1)..(100): optimal_loci_177649_G1, chr5:29066463..29067745, Cluster 25
cacaaccgagcaaattccaaggccgaaccgaaccccggcttgtctctatgcgcttgaacccaccgcggtgacggaatccttgtcccctccggccgagccgagcccggcaggacgcacgaaagcacacgcacatggatgcagtgaaaaacagtgccaactgtgtagtagtgtacgtagtataatatgtgctcgtaaaagtacgggtttttttttctttaaaaaaagagttcagagaaaagggaatctcttttaatagtaacaaacaaataaaaaaaactactagtgctcctacgtgtattgatgtattcgtgttttgtcgtgtggtcgtcgtgtaacctaacctcgatgcgtgctattttaatttttgcaggaatagaacaggatgaacacgtggccgagcatgtttgcagtctcgaaatggtaaaagaacattatagtgccagtatctgtaccagaatagaagatgtagggcacttttcgcatcgtaaaccggggaaaggaagtgtttgtaataaattaaactgtccgtcgtcagagtctacgcgagatctgctgctctatttgcttattagtaggttgttatacctccaaactttcattgatagtaactgaaataataaacaatcgaaatatttgtcgtataaatttcgttcaaaaaaatatttgtcgtataaataaggtacctttgtaggctttcaaaaaaatccaccaaacaacaaactcttctactctctgcataaagatagcgaagatggaagctcaaaaaagaggcttcttcagttatctcccgtcattccctcctccctaaaaatagaagtgttgtatttccaaccaaatgacgtgctcctccaagagagatcctactgaaaataaggaagatgctatatatttttccagatgaactagagctagagctcgagctggagctgttgatgcaagagtcctaccaaaagaggcctaaatactcatgttaaggctagcacaaacttgtgaactagtacttccttccttgaacgctatactacatttgagtattttattctttagtggcactcaagctttttaccaactacatatctatggcggatctaaaaacatatgctaaaaatcactcctctttcttgttttctatattccgtctcttcttcttctaagcttaagtgattaattatgaacttgtaacagaggcttatgagcgactccattcatccgataaaagatagcatccccctactaacccagtgcgagatccgcctctgtctgacttaacatctttctccttt

SEQ ID NO: 4035 - DNA, 1248 bp, Zea mays
  misc_feature (1)..(100): optimal_loci_179383_G1, chr5:37948926..37950173, Cluster 25
acggtggatctttatgttagaggtgttacatatttttcccaaactttagttgactggatgaagcaaattgtttggaggtactgtgggaataaacacaaatggcacacatggagtgcatttcaggacatacaacgggttgattgaaggaagaggaccttttatttccattgctgcttaaactttctagtgagtctgatttggtatagggaggcttatatcatttacagaatgctgatgatactgtgatcttccagaagttggatgaccagaatatcgacactaagttcttgcggttatgctttgagaatatatctggggcaaaaaaataatttataaacaaagtttttgtattggagtgtcagaagaagagttgtagtcattttcgatgataaagtgggagaatataatatgaagtacccagcaatatatataagaaggaagaagtatctgagtgatgtagatttttataaaaggaatagcagatatggttcccaattttttcagaggtttgcattggattaaaaaactattgcaaaacttgggtgagtggtccgagtttatgttttagaaaaattttgggtgcaacagaacaattagagtgccaagaatttggggagttaatggacacaatggaatgagtgagggtgaacacataatgagctgagctttggaaaaatctggattgttttctacatcctcagattacaaggcactggtttttttccaggaaccataaatacaaggatggtaaaaatgtagaagccaaatttgcccataaaagtaaggacctttctgtgcaatgtcatttatgatagaatttaataggcagagaaagtgtttaagaagcattgcacattggcatggagtattaagtgtaaactctgtgagcaaccttatacagcaggccatgttatttcttggtgtccaattgctagctttatgtggagtgtgtgcaaagacgggatgggatggcaaattctcctaagggtgtcgctggatggctgagcaacctgcttggagcagggcaaatgcctttagaaactttgaaggggcatgattttaggcagcactctatctcagtccaaccaacaaaatttggagaagttaaatcattatgctgtcatttaagcatcagttatccaaaagactcaataatcataaccaaataagagcaatatgcagagtcttataacaaaggctaaacgcactctttgaatttatcatagtgtatattattttctcacacca

SEQ ID NO: 4036 - DNA, 1178 bp, Zea mays
  misc_feature (1)..(100): optimal_loci_181591_G1, chr5:51861814..51862991, Cluster 25
cagaaaagcgtcgggcagcgctgcagagagattccctccggcatggcatgtctgtcctaataactttgtggagtcctcgaccacgctgccatgacgactgtgcggggagatttgtggggggaatccttgctctcccggaacacatacgagagttgttgatacggtgaaccgttggactccattcggagactgacaacacacggaagtcccgacatattattgtcttgtttaattaaaagttcgcaagggtctccaaaaattatgtacatctttaaataactatctatttttgtaagatctagcgccatagcccttgctgttttattatttttaatactatatttgagtttttttttaaagtagtatgaccctaaaatagtttccaaatatctgagagaaacgcatctaaaatccaagtttggaaaattattatatacgatcaagtgaaatccgaaggttcaatgacaaagcaactactcaacattagaaagaagaagataattcttccgttctttatttaaaaatgaactatctgggtcaactatccccccctcccccacgggccacggtggaggcccggaggaacggcatcatgggccgaccggcccaacgggtctttatcctctccgctcctttcgacattagaaatccgtaacaattgttacaagtctgaatttactaaccgtgacaaactatagcatggtttcttctttcttgcctaccacagaaagagaagactggtgatctgaggaggccacgaaactaaccgaatgtttcgatgaaaaacattttcatgatttgctgaatactgtatgcgtttcataagtgaagattataaactttagacctacatgcagtaatgaccattgaatcttccctcaagcacacctttgttagtacatgcagagcaagacatgattctcgatggttaaataatccttcatataccattgcctcagagtcagagcctttgaacctactcacatgaggccatgaactttctgattattgaagtattggatttgatcgaagctgaaggcttgggtagcatgaagaatctggttcgtgctactctttgtgagcaattcttggctcacagaatttaatatattttccacaatttatgatacgatctgtttcggtttaaacagtcattgttaggtgggctgatcttcata

SEQ ID NO: 4037 - DNA, 1181 bp, Zea mays
  misc_feature (1)..(100): optimal_loci_18343_G1, chr1:102234784..102235964, Cluster 25
tagaactaatttaatgacatcatactttatctattataaaataaggtattcctccgttctaaaatatagaacattttgaggaatataagtttaatcaaatataaataaaaaaacccatattcatatttatagtatcaaataaatattatcatattaatcgtgttgtatattttttaataaaaaactagttggagatagaaataatatgcaatcttatggtgaagcgagagagtattaatgttacgtactttgtggttgtgggtagaaaagcgacaatgacgtatcagacaccctgactctaccgttgtctctgtgccgtcgttgaatgtaggactcatcaaacagccagctgatggtgatgtatcgtttcgtatatttatagcagcactgtagatcctagctgggacgacgtggatgatgccggccgagtgtgcgtgcgtgagagcacacatatatacgatttgacttggcgtggtgtacctgtgtatactactccacctctccattctagaacgtcgtggtatgtataatgtatggcgtctcttggtcgtcgtcgtcgtcgtcatatcatgcacgtatgtgtaggtgggcggtgaccgccgccggccagcgaggtgagcattcaaagggtcgacggcgacacggtgcagtgcagcataccgacggccacacgcgctcaacctacagctatctagcggctggtccaactctactcgaccctaccagctggcagcaggaggacggccagatggacggggcctccggcctgcctgcctgcctacctggccgtgcataatgccgccccagccgaatatactccaactaacctgcgcctggaatgaacacgtcttcgcaaatagaaaaccgacacctatattaattgccgagggcgtgtacacgtacgatgtaattgtccatgtaggacgagcttgcttgcatgctttttctcttcaaactctaaccagatgcttctttccgtatactgacatcctaaattataagatggtttatctttctagatatttttttaacaaaagatacacaattcagtctctatatccacattaaatatatacataaccaaaaggcacacgagctcttatattaaatttcaatccctagctaagagcataaagcaacaggaaacaaattgatcagctaagaaaaaaaatttaaaagat

SEQ ID NO: 4038 - DNA, 1230 bp, Zea mays
  misc_feature (1)..(100): optimal_loci_185589_G1, chr5:80840622..80841851, Cluster 25
gccatatgagtatacgaaagctgatgaaagatagttagtaaacatcaagataagcatgatgtatagttgtttgcattgttgcatctaaccctcgtcatggctagaaaggataagaagtcaatttaatgggtagtggcacatgaatacatgaaagctgatgaaaggtagctagtaatgtaattatatattagctaagaagaaaaaacaaaaagagttcgcatgggtgtatgttttttgtcttttatttatgccatgacgcctatataaatgaatataactagcatgtctatatggttttgtcttttatttgtgtcattgaattaatatgtctgaggtaaataagacttgttacatgcccatctaagttactctaccgcacaaaagataaacaaagtatccctaaccacaattatatacatgaaaacaatcaacaaaacatagcattatattactgttgttacaagtattagcgaaacaatcgtgaaatagtcatcatgaactactcctatgtattagtattacctatgctcttctttatttttaaggactacctctcatctcagtattactattagtaaacctttaatacaagtgtgacatatatagtcatgcgcggttacactcaacccttgtcgtggctagaaaaaaacaagcattgatttaatgggtagtgccatatgagtacaggaaagctgatcaaagacaattaataaataccatgacaagcatgacatataattgtttgcattgttgtatctaaccctcgtggtggctagaaaagacaaggagccaatttaatgggtagcggcacatgagtacataaaaactgatgaaatatagttagcaattaaattatattagctaataagaaaggaaaacaaagagagttcacgtgggtatatgtttttgccttctattttgccacaacacctatataaaccttaagacaagataagtgacatataacaccttgtacaatctatctgacccttataaataagacaccaatttgatgggcaacatatgagtatacaaaagagttgatgaaacataggtagcaatgaaattataacttggctaaaaaatggcaagaaattgcatgggtgtgtagtttttgtcttttatttatgccattgcattgacctctcatcgcgatgatctgttacatgcccatctagaccactctagctaacaaaaagataaacaaagtagatctaattcacgtgtgtg

SEQ ID NO: 4039 - DNA, 1093 bp, Zea mays
  misc_feature (1)..(100): optimal_loci_187451_G1, chr5:92361897..92362989, Cluster 25
aacatgtctttgcacatgatcaagcacgatatgcttcaatcatgtttgatattgcgcaagtagccaattgtgttgatactcatacatataaatagacacataatttagattgaaatattatctaagtgttataagtttttagttgtctcattaaaaacttttctagattaaacatcatgagaaaaaactagaaagaaaaagggcacaccctagctcaaatgtttaatgcatacattacatgcaattatgtaacaacctacatgctaagtgagccacacattaataataccaaccccttatgcttttatccttgcttcatttaaaaggattatcccaagaatggtggtatggaatatataagccatatatattggcctaacccacactcaacatccaacactacttcataacacacatatccacctattactgttaggattgctagagccagtagtgaatttagttcattgttgggttcctaagactaggatattgacaatgattggaatccattgacccaacagtaaagctcattgtcattgtcaagtcaaaccatgacctagcaataatatatacctagtaggtttagccatgagccagcagtggtatggaagatcacactatcagatcaatccatagaccaattctgataggccaatagagtcatggcttgacccaatagtaggcacacgatgacggtgtcatgttgtggatagactcgacaatgtcctaactatagtgtaaaacctagtccccttcttgttcctctttccttctcataccaagaatagtcatttagttttccccactattctctctagtgttggatccatttttcacaaaaatgtttatgaacaagcttagttttaatggatggacatgctctcctacattaagatgggtaagtagcataccttgaatttgtagtttgttttattggttagattgtttttattctcatgattgttttttcttcattacagagagcatttttgtcgattttttatgaagactgttgcgcttttgtgaatctacgtggtacctatgaatccattttatttgtatctagttttcttcatcttgttttttgatt

SEQ ID NO: 4040 - DNA, 1076 bp, Zea mays
  misc_feature (1)..(100): optimal_loci_198016_G1, chr5:162749326..162750401, Cluster 25
aggggttttcatttgtcattttcacatttcatattgctcattcgcttcaatgctccataattcccattagtttctttgtttgcattgtcattaatgcaggaaaaatataataagtgtggatgaatataacttcacccataggtgcgcgggaggttaggatttgaattcagaaaatcttgtatccaaattccagaggacgagattaaaagaaatacccaataggcaaggtattactaagcgtagtggtggtagaccagtagtgaaataggttgaggtggtattgaagctttgaaaaggcaaggactaagaatgccaaagaagttggaaaagagattaatggtgaattaagttcattgcgggttgttggcggtgtttacccatgagaataaggcaagcacactatggtagatatatgagtatatgacaataccattggccgtttggggagatggaagatgtgggatactaataggaacatgatggttgggcgtggttgttgttatcaagaatgggaatgttaaaagagggtagatatgttgttttagtcattcctcattacaatttgcgacaaatatatactatatggggtgtttctatatccactaatgtattatgtaagtataattggcaatattagagttgggagtacaaggtatgatggaaaaattgactagacaaaatctatctatatatattaaataaatccactgaaacttaggtttctctacgtgagtcctatgttatacacctattttttattgaaacaatttatactcataaattttggtactcctccgtaggtgattgagccaattggcaacatgtgcgatttttcacaagctagcacctcataatccaatatatacccgaagatccctatctgtaccagcatcgaggttgaaaatctcgctcgagattcggggaaaccgtcaccttttctcagtcccggtgcacattggaattagttcccggcaaaagttacaattttttgcttgaaaatttttaatttaaaaaatccataaaaattcagaaaaaatgtatacaaaactagaggttctcatgagtttagaaatata

SEQ ID NO: 4041 - DNA, 1210 bp, Zea mays
  misc_feature (1)..(100): optimal_loci_198224_G1, chr5:163726769..163727978, Cluster 25
tggcaacggtgacgacgaaccatcggtgaatcattcctttaccttgtgtatcctctataaagctggtcttgtaagggtaatgcccaggccatcaccatattttgcttgtaaatgtaatgatggctcatggaaccattactgttgaatgtgctttgttcctcttttccttgtcacaattgcctagtttgtacttcgatttggtaccattgtactaggcttgtgagcagatatgaaacccaaatcagaccagctttttccatcgacatcatgttaatcaactaggattgtctcttttagttagtgtcggtagatcccttgattagccccacatctgattcattctcctctttttgaaacaaaatcatacataggtcgtaggactagccttagccaacaaattccaaccatttgcagtgcgccttggccatggatcctttagacacatttcttcactgtgactttgagttccaagctcccatattcccaaacccatggtggtataaggatctagtgcactagcccatgtccttggcctgaaggtaagtacttcggtcctccccaaaattggactagctttaattaatcgtatgttattgtacttctagttcaaataggccctagcaactggcatcctcctcccttgttcaaagaacccaaaagtctttagtataaattgctggaagatccttctaaaattatttttgtggaagttaatcgcattccctttgttgctcaaactaatgactcgagctaatggtctgactagcttagagcctggtccaaccacatggaaggatggatcgtctattatgagatggtacatcaagttcatggcccatcctagcataatataggacttgtcgattctctcttcctttctctctcccccattgtgaagcatgtgaatattttgagaaccatcaactatttatggtactataccttaaatttcttctttttggtcatgctctgatgacaccaactatgatggacgtaaccatgataactgggctggatatcagttccccatgccctatgttcacccttgcgagctgcacccacaagatagttgacaaggccaccactaagaactagagtcaatatatcaatatgtacgccaaaatcaagggtctagtagatcaccatgaacatattgctttgctaaacctatggttgatcactttgtcttatgttccttggctctcactag

SEQ ID NO: 4042 - DNA, 1140 bp, Zea mays
  misc_feature (1)..(100): optimal_loci_199360_G1, chr5:170170196..170171335, Cluster 25
ccactactaggggccccatgcctcgaggacctcccatgacccctgctaggaaaagggcctgcaggcactaggtaacttgctactgatgcactccaaataggaacaactacaccaagtcacgatcagagagactcggtggccctccggaccccaaggcgctctgatggttgaggcccctagtgctctaggatcttcaaaggtgaaataatataagtcttcaagggcccttattccacgaggcactaatcagtgatcgatacaggccctcggaccccttgtgcttcagggcgctcatgagagtaactcctcaggcacctcacccccgaggtgctcataggtccaagtccttggggcctctagtactttgagatgttacaaaaggctatgggtactcagggtagtccatcattcgagcactagcgtcacttagatgctcaaggacctatgtcggcccttggccttctacaagtatctagcctcgcatcgtgagaccagcgagccccaaacccttatcgagtgttgcacctcctagatcttgccttaatctctactgttctcgagtgttgtagtgtaggctaaacctgtcgtctatgccatgcagtctacaacctaaaaatccttgatttctaacaaaattcaaaagaatggttttgaataaactctataataaacacaagagttacaacttaacttggatataaaaacggtgattctctagttttgaattataaatgttttgacttctatgtatatatacatgcatattgtatatctaagtttataacaaaagtatatatatctagaaatatcaaaatatcttttagatttggaatggagggagcaacaaccattaagttaaaaatctgaattcaacattagtatccatatgatgtcatgaaattaatatgggatacaaccagagctaccataacgtatgctaattaagattagaactaaaatttatctaagagatctgaaggtgccgtgcaaagggagaaaaagctataacatttatggtaataaataagtagcattagatatttgatgttataatttttgtatattttttgttaaaccattaatgctttaacttttttgggtaaaataacttataatagaactaggtaggtacccgtgcgt

SEQ ID NO: 4043 - DNA, 1265 bp, Zea mays
  misc_feature (1)..(100): optimal_loci_200944_G1, chr5:178815991..178817255, Cluster 25
  modified_base (173)..(173): a, c, g, or t
  misc_feature (173)..(272): n is a, c, g, or t
  modified_base (174)..(174): a, c, g, or t
  modified_base (175)..(175): a, c, g, or t
  modified_base (176)..(176): a, c, g, or t
  modified_base (177)..(177): a, c, g, or t
  modified_base (178)..(178): a, c, g, or t
  modified_base (179)..(179): a, c, g, or t
  modified_base (180)..(180): a, c, g, or t
  modified_base (181)..(181): a, c, g, or t
  modified_base (182)..(182): a, c, g, or t
  modified_base (183)..(183): a, c, g, or t
  modified_base (184)..(184): a, c, g, or t
  modified_base (185)..(185): a, c, g, or t
  modified_base (186)..(186): a, c, g, or t
  modified_base (187)..(187): a, c, g, or t
  modified_base (188)..(188): a, c, g, or t
  modified_base (189)..(189): a, c, g, or t
  modified_base (190)..(190): a, c, g, or t
  modified_base (191)..(191): a, c, g, or t
  modified_base (192)..(192): a, c, g, or t
  modified_base (193)..(193): a, c, g, or t
  modified_base (194)..(194): a, c, g, or t
  modified_base (195)..(195): a, c, g, or t
  modified_base (196)..(196): a, c, g, or t
  modified_base (197)..(197): a, c, g, or t
  modified_base (198)..(198): a, c, g, or t
  modified_base (199)..(199): a, c, g, or t
  modified_base (200)..(200): a, c, g, or t
  modified_base (201)..(201): a, c, g, or t
  modified_base (202)..(202): a, c, g, or t
  modified_base (203)..(203): a, c, g, or t
  modified_base (204)..(204): a, c, g, or t
  modified_base (205)..(205): a, c, g, or t
  modified_base (206)..(206): a, c, g, or t
  modified_base (207)..(207): a, c, g, or t
  modified_base (208)..(208): a, c, g, or t
  modified_base (209)..(209): a, c, g, or t
  modified_base (210)..(210): a, c, g, or t
  modified_base (211)..(211): a, c, g, or t
  modified_base (212)..(212): a, c, g, or t
  modified_base (213)..(213): a, c, g, or t
  modified_base (214)..(214): a, c, g, or t
  modified_base (215)..(215): a, c, g, or t
  modified_base (216)..(216): a, c, g, or t
  modified_base (217)..(217): a, c, g, or t
  modified_base (218)..(218): a, c, g, or t
  modified_base (219)..(219): a, c, g, or t
  modified_base (220)..(220): a, c, g, or t
  modified_base (221)..(221): a, c, g, or t
  modified_base (222)..(222): a, c, g, or t
  modified_base (223)..(223): a, c, g, or t
  modified_base (224)..(224): a, c, g, or t
  modified_base (225)..(225): a, c, g, or t
  modified_base (226)..(226): a, c, g, or t
  modified_base (227)..(227): a, c, g, or t
  modified_base (228)..(228): a, c, g, or t
  modified_base (229)..(229): a, c, g, or t
  modified_base (230)..(230): a, c, g, or t
  modified_base (231)..(231): a, c, g, or t
  modified_base (232)..(232): a, c, g, or t
  modified_base (233)..(233): a, c, g, or t
  modified_base (234)..(234): a, c, g, or t
  modified_base (235)..(235): a, c, g, or t
  modified_base (236)..(236): a, c, g, or t
  modified_base (237)..(237): a, c, g, or t
  modified_base (238)..(238): a, c, g, or t
  modified_base (239)..(239): a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (1138)..(1138): a, c, g, or t
  misc_feature (1138)..(1237): n is a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
  modified_base (1143)..(1143): a, c, g, or t
  modified_base (1144)..(1144): a, c, g, or t
  modified_base (1145)..(1145): a, c, g, or t
  modified_base (1146)..(1146): a, c, g, or t
  modified_base (1147)..(1147): a, c, g, or t
  modified_base (1148)..(1148): a, c, g, or t
  modified_base (1149)..(1149): a, c, g, or t
  modified_base (1150)..(1150): a, c, g, or t
  modified_base (1151)..(1151): a, c, g, or t
  modified_base (1152)..(1152): a, c, g, or t
  modified_base (1153)..(1153): a, c, g, or t
  modified_base (1154)..(1154): a, c, g, or t
  modified_base (1155)..(1155): a, c, g, or t
  modified_base (1156)..(1156): a, c, g, or t
  modified_base (1157)..(1157): a, c, g, or t
  modified_base (1158)..(1158): a, c, g, or t
  modified_base (1159)..(1159): a, c, g, or t
  modified_base (1160)..(1160): a, c, g, or t
  modified_base (1161)..(1161): a, c, g, or t
  modified_base (1162)..(1162): a, c, g, or t
  modified_base (1163)..(1163): a, c, g, or t
  modified_base (1164)..(1164): a, c, g, or t
  modified_base (1165)..(1165): a, c, g, or t
  modified_base (1166)..(1166): a, c, g, or t
  modified_base (1167)..(1167): a, c, g, or t
  modified_base (1168)..(1168): a, c, g, or t
  modified_base (1169)..(1169): a, c, g, or t
  modified_base (1170)..(1170): a, c, g, or t
  modified_base (1171)..(1171): a, c, g, or t
  modified_base (1172)..(1172): a, c, g, or t
  modified_base (1173)..(1173): a, c, g, or t
  modified_base (1174)..(1174): a, c, g, or t
  modified_base (1175)..(1175): a, c, g, or t
  modified_base (1176)..(1176): a, c, g, or t
  modified_base (1177)..(1177): a, c, g, or t
  modified_base (1178)..(1178): a, c, g, or t
  modified_base (1179)..(1179): a, c, g, or t
  modified_base (1180)..(1180): a, c, g, or t
  modified_base (1181)..(1181): a, c, g, or t
  modified_base (1182)..(1182): a, c, g, or t
  modified_base (1183)..(1183): a, c, g, or t
  modified_base (1184)..(1184): a, c, g, or t
  modified_base (1185)..(1185): a, c, g, or t
  modified_base (1186)..(1186): a, c, g, or t
  modified_base (1187)..(1187): a, c, g, or t
  modified_base (1188)..(1188): a, c, g, or t
  modified_base (1189)..(1189): a, c, g, or t
  modified_base (1190)..(1190): a, c, g, or t
  modified_base (1191)..(1191): a, c, g, or t
  modified_base (1192)..(1192): a, c, g, or t
  modified_base (1193)..(1193): a, c, g, or t
  modified_base (1194)..(1194): a, c, g, or t
  modified_base (1195)..(1195): a, c, g, or t
  modified_base (1196)..(1196): a, c, g, or t
  modified_base (1197)..(1197): a, c, g, or t
  modified_base (1198)..(1198): a, c, g, or t
  modified_base (1199)..(1199): a, c, g, or t
  modified_base (1200)..(1200): a, c, g, or t
  modified_base (1201)..(1201): a, c, g, or t
  modified_base (1202)..(1202): a, c, g, or t
  modified_base (1203)..(1203): a, c, g, or t
  modified_base (1204)..(1204): a, c, g, or t
  modified_base (1205)..(1205): a, c, g, or t
  modified_base (1206)..(1206): a, c, g, or t
  modified_base (1207)..(1207): a, c, g, or t
  modified_base (1208)..(1208): a, c, g, or t
  modified_base (1209)..(1209): a, c, g, or t
  modified_base (1210)..(1210): a, c, g, or t
  modified_base (1211)..(1211): a, c, g, or t
  modified_base (1212)..(1212): a, c, g, or t
  modified_base (1213)..(1213): a, c, g, or t
  modified_base (1214)..(1214): a, c, g, or t
  modified_base (1215)..(1215): a, c, g, or t
  modified_base (1216)..(1216): a, c, g, or t
  modified_base (1217)..(1217): a, c, g, or t
  modified_base (1218)..(1218): a, c, g, or t
  modified_base (1219)..(1219): a, c, g, or t
  modified_base (1220)..(1220): a, c, g, or t
  modified_base (1221)..(1221): a, c, g, or t
  modified_base (1222)..(1222): a, c, g, or t
  modified_base (1223)..(1223): a, c, g, or t
  modified_base (1224)..(1224): a, c, g, or t
  modified_base (1225)..(1225): a, c, g, or t
  modified_base (1226)..(1226): a, c, g, or t
  modified_base (1227)..(1227): a, c, g, or t
  modified_base (1228)..(1228): a, c, g, or t
  modified_base (1229)..(1229): a, c, g, or t
  modified_base (1230)..(1230): a, c, g, or t
  modified_base (1231)..(1231): a, c, g, or t
  modified_base (1232)..(1232): a, c, g, or t
  modified_base (1233)..(1233): a, c, g, or t
  modified_base (1234)..(1234): a, c, g, or t
  modified_base (1235)..(1235): a, c, g, or t
  modified_base (1236)..(1236): a, c, g, or t
  modified_base (1237)..(1237): a, c, g, or t
tcaatagtgatgatgataatatctcttacacaaagttcacttgacgatgattattgttcatggtcgagctatatgaaagggatgcttctacaagcccatcatcattttttgcatactgcttcatattacgacgaagtgacactaagttataacgaaattcaaggcttatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttatcgttctatcctctttctcttttctcgtctactagcatatcactttgaacgttatcagttttatatggggaacttgtgtgttatggaacacaattttaggtttttccaatgtggggatttaattttccatcttaaatatggaaaattttaacgtaattcagaaggcaaaatgtcgactgaggcatgtcatactcttcactgtccattcgccctattcacaaccacctttttgttgcacatcacttacatttattcctggtttatttcttctctgtttcttatttgcaaaaatattcttcttctctgttacacaaaaatttgttttctatatacatttttataagatatattaatatgtttcttgcatcagattgtatgaggataaaagaaaagaagtgaagataaggctggatatctttgaaggagagaacacacttaaaacatttgaaataattagttacctgcctttataatattgaccttattcatctgttcataaatcacttaacagagcctatgctaaatatatatgtgtgatggttaaaactgagtgtcaacttgactggattggaggatgcacatattcctcctgggtgttttgtgaggggtgttgccacggggaattacatttggattcaggggattgggggaaggcagaaacatacaaaacctgggcaggggcccatctaatgggctatccgtgaacaaaaggcaggcaaagaatgtgaaaagggtcaccctgggcaaaccccccaggcaaaatcaacttcccggggggggggttccccgggcgcgccggtgtgtttggggggggttctttttttttaaaaaaaaaacaggatttttttttttttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaggcgacagtagatcagagattcgt

SEQ ID NO: 4044 - DNA, 1189 bp, Zea mays
  misc_feature (1)..(100): optimal_loci_203706_G1, chr5:194842834..194844022, Cluster 25
cgctcctcccactttccttgtcacacgtaaccccctgtaacagatttcggctactttacaacccccccccccctcttcccttttttatgtggtatcgccccttctccacatatgtctcggcctcgcgtgtactttcttactcacgtagacatccattgggcccaccacttgtcatgaccaagcctccaccattcataggctaacaagtggccacttgtcttagtcatctgtcctagatacacactatcacctcagataacatttacattcatatgatacactaccccatgtctattcactcggctacattgcgatagcaaggcccaagtttccattcagccatggctgcgtcactcgtgtaggacctcttggccaccctgggttcctatgaatgaaccatatatgtgtagttgtatttatttaccatcttaccttctcaagctttctaaccaattattaaccactaatgcttacgaatctattatggagatctcactaccaccttctatttttacttttgtacttattttttatatcaccttttctacctaatctactcacttctccatattgcttaatacaattcattcatttttttttttttttctttatccccaaactaccctcttagtaagtcatatattttctattccatattcgcatcgtgaataactcatatattactacttcctaatcttcatatcctttattttcctcatcctactcttcctctttctacgcattccaaatcattcctatttgttctctgctatcatattcttcacttaattttctcttctcccctagatcctctatttattttctcttttaaactacattcttatgtattcctctatcccctcctctctacctgctcgacttactcacttcctctactgcaccgctttctaccccttcatactcttacaattttcattatatttactaacttgctatcaatataactaactatacctgatgtcttgaatcattacaaatgtgtacaactaatgagaagatcatctacaatacattatcaatattcgttcgttgcactagattctctctcttattctactatacatcatatgacaataccttacttatcccttatatattcatcaagtatatttattaaattctactacattttcacacattctcttgcttttacgtctttacttatgac

SEQ ID NO: 4045 - DNA, 1297 bp, Zea mays
  misc_feature (1)..(100): optimal_loci_204453_G1, chr5:199200274..199201570, Cluster 25
taaaagatgctctctttttagtcgcccaatgtatatcgaagttacatcgtggcttgaaggaggaaagttattgaatttgagttgtctctctgtttttttttttttgacaaagccaacaaggggcatagagatattttgatttgctagagatttaagcacacttaattctctttttaatccatatgtattgagattaaaacgaacatgccaagaacttgataatgtgttggaagaggagaacaaaaggtcgataataataacatatcacctatataaacttccataaaatagcgggtgatcaattaatctgatagagatgttcttacatacccattatttatatgctgcatttgtcgtatcatggtatgaatggtttagaaatattacattacatatcccagcatcggcattccggcggaggtcgaacaaagaatatagaatttgatacttttgtttgaatctagaacatccaaatcccaggatgattgtcgccatggcgacaacattgtctatctacctttaggccctatttggcagagttttagctcttttaaaaatggctccgactttggcgtctttggaagaacagctccctccttaggagctagtgcctcttacaagtctgtttggcaaaatagttacttctatattttgttgcattcagcaaaacttgttgcttgatatattcaaatttcaaaatgcattctgagaacatgcaagtctagtctacctggaactttctgaaccgaactgctacagtgctacttgctgctcgctgaagcgaactacttgctgctacttgttgtttcctctacttcaagtgaccgtggtcagccactggtggcggcgctggctgagatgcaaacacgcgcgtgggagagaaaggcacggaactgtgcgggagctagaattcatggctccggctcttgaggtcaaaaatggctacgctcctaagacggagccatttcgaagacgctatttggaaaggctccggcaaggaaccggagccgcctggaaagccctcccaaacgtggacttagctttgctccatctcccatgtgaatgcacgtacggtgttccggtttttgtttccgtgataccgaaccgcgctagctttacagtcgtcgtctctacgtatttatatatgatgatccgtgtccgtggtcacaacggcacgccgcgcgcgggcattggcgctgtgtatatacgtcgtcgtctaggtcgcatcgcattgaacgtacagcaaaagttggcaattaattactaccgtcatgtggtgatgcacttcattaccttt

SEQ ID NO: 4046 - DNA, 1220 bp, Zea mays
  misc_feature (1)..(100): optimal_loci_204727_G1, chr5:200670725..200671944, Cluster 25
gacttgcatggtgacttggatcgcgcgagctagctaggagccgacatgcatgcatgcatgaaaaagtcactgtatatgccgttcgcatcgaatcaagatcgtcatcgataacgacgtttccagtctcattcagacatatgctacggcactaactgacacgcggcaacgacttgcattcttcaaccatcgaccaatgcaaggcgtgtattctgagtggacctgctgttctgttcgaggatccggcagctagtgccgacatatattgcaagtgcgcgtaaaacatgacaccaccaaagtttgcttcgccaaaacacggaagcgctcacagtcctttgtagtagtagtagtacaacttatgaccgaactagtcatgagtacaaaactttataaagggagtacaaaatttggatctagtcatgagcctagaatgagcaaaagtatgaagatatgatcgcgatctcctattattggtcagacaggtggcaagaaggttgggtgcccgcccatggcatgcttttggcgatccgttgtcaactgcaggtggcaatacgaagatatcctttctttatataaaaacatcatatgtgcacgctgtgccggcatggtcttaattagtttggatcgaggtgtgtgtgtgccttacattttgatgtttgattggagtaagtcgcaatagatcaagctctttcaaaactaggaaaatcacgaagcctgaattatatttagctggagtgtttcgtaaccgattgatttattggttttatttgaattcatgtttgttgcagagagcaaatttaacttgagtttggagatcatgtatatacagtcctttgcttctgagggcgtgctgaggtccacttgcgcgtggcttaaactttgacactactgcctcgctggagagaaagtagagatggaccaaacatcggttatgttacttatgtaatgcctccgtcctaaattatgtaatttcaattaatttcctcgaaaataacttaagactcactaaagttatatgacaaaattagaatatttggactatccatttttttaaataacatgtaatttaaaatggatgggacggagagagtgctaaacaagataaaattctgagaggatctacgcacggtcaattagctagggtaattgaaatatgcaaaatgtattttggtgcaccgtctcctagagctttcatgcgcgtactttcccggtgctcgctcgat

SEQ ID NO: 4047 - DNA, 1205 bp, Zea mays
  misc_feature (1)..(100): optimal_loci_204969_G1, chr5:201979084..201980288, Cluster 25
ccgagaagatttgtccaagggtcaattccagctctaaccccattcccgctttaagatttgtccagcaaactatttactcttcaactctagttttacaaaaactgagcttgtctgaaatatgtactactgcaggtgtctgttttggtgggttacagtaatccacaagatttagttgagaaacaaagagcccctggggaatcttctgcagagttgattagtgccttgaaagaaatcgatttcccagaaattactgcaaagtttccatgcataaaagttggtgatgcatcacctgttgaactgtatgaggattctactaacatgaagtttaaagaagctgcactttctgaaaagctcacaaatttcatccaaggctcagctcgaaatttggagtcagcttatgaattccataatgactgtcatccattgaatcaaacacccacaactgcaggtgatctttcaatcagtgaagagatccctctcattgaaccaatagttgatacgaagtcccccgagtcattgtcagatgctataacctctgacaatagtatactggataaaagtataaggtgcttgcctggaacaactagtaggcaatatcgccagctagaggatggtggtttccatacggtatcagctgtcaagctacttctttcgtatttttcttttgatttggtaaaaacaggaaaaaaactcacctcctcctcttttataggtccgcaaattattgcagcattttcctcggacttatgcagatctgcaaaaccctcaaggccccatagaatatgggcagtatattatgttatctggtactgttatatcttccaggtaattaaacattacgcattagagatttagagctataaaatacattcagaaggaacataatgtaagagaaaaggagtggacggtttagttcatcagatgaattggattgttatggagcaaggaagaagattttgtgaaatatgcatggaatattttgatataatcgcgtagtagcttaaattgcatgggagtggaactgtttccttcaggattatttgggtatggcctcgtcaagaatattaaatatcaattagtcttgctgccaactcctgtaacttcaaattcattgaagttggtcatgattcttgtatcaccacttaattcaagtaatgtttcttcaacagtttttagctcattttaccgcctttgataatgaagca

SEQ ID NO: 4048 - DNA, 1126 bp, Zea mays
  misc_feature (1)..(100): optimal_loci_205132_G1, chr5:203030337..203031462, Cluster 25
tgtacgagtcattactctatttagtcatagtattgaccacagtagtattgctggcccctcaattattgaattataagtattagatgcaaagcatatttatgatggctaaggattagatagttttaaatgtcacttcatgttggggtgcccttaggaaatcctttttcgtagcataaaggggactaaaatgagtagcttaaccttaggcacaaccaaaagtgttaggttaatgcatacttgtgaaaagcttgaactaggtagcacaatagtggcttaaaaaggataataattcaccttggaacctaaataagttgaaattgattgagtgtcaatgtgaaatatattttgaaaacaacaacttaaaaagacaacaaattgcttgaaggccactagatcaccatgtgacactatccaccatttactttagcacaatgcaagtctttattggtcatcatatgatatggtaaatgatacaatgcactagcggatcatcttgtggcactattctaggggtaactcgaacttatgcaactcttatcataggtgatccaaatggtgcctaggtgacgcacgacaaatggttgatgaatcatgacaaggcaaagaagaaatccaatgaaagtttctagaaagcacaagatgatctaatgagtgcctagtggcttacaatggattgatgatgttgtctcttatagtagccatttgtaaatgtcaaaggttcatgaacatagcgtgatccaatgtgagataatagtgcaataccccaacccatcagtgttttggtttcgaaccagtgtggcctatgtgttgtattagatgaaattagtattgccttggttgtctaaatatgctcaatctagcttatattctttggtgttctaaatgtaattcctccaaggatccaagttaacctttctccacgaagtgatggcagaagtgtaatagatattctatgatatgcaagatcattacatgtgggagtttggacataagaaaattttggaagtgtgattcatatggtattcagagcgagtactctcactgcatgtgtgcatgcgtgtcacacatggaggggacatgaaatagaaattgtcgaagacgatgcaatgtgatacataatagtgca

SEQ ID NO: 4049 - DNA, 1222 bp, Zea mays
  misc_feature (1)..(100): optimal_loci_208070_G1, chr6:679020..680241, Cluster 25
gttttgaataagttgagctattatctatgcatatacatagctagcagcatggacaggaggacagatatatgtctcaacatgatacaaaagatgatgtccagccggtcaacagaacacaactttacaaaatattattcgttggaaatagttatgaagaatgtctctctctctttctatcgctatagagatatcaatcctaaactttagacttgttgtggatgtttgtcaactaattaaaggacaacacatgcaactgcaatgcatgattgatagtatatatatatatatatataactgatctgatgatgaatgtgggagaatcaacctctccaacaagtaacgcaaggtgtcttggttgccgactgcgacgttccatcttttgcaatcagcatttgccgccaaaggaaatatgccatctgtgaactgctttctgctccttggatcattctggccggtctaaagcaagaaaaggaaggttatccctgctgattccaacccatgcatgcatatccttattttcttcttcaagaattaagtacgtagatgatgaatcataaatatcatcatcccaaattaaattaaattaaatgactagttactcttgagacagctaagctactagttggattggattgctatgtatatagtgttttcaggcgtgcactgcaatattcttcttggcaacgacgtgcatgcatccgcctgccgctttagtttatactcgtatctgcggctttcctagcttctacacttgatgcacctcaacatcaaacttttttcgcggaacattacaaaaagaaatgagctacccttccttagcttccttcctgtgtgaacgaagctacttgattgctaagcttcctgcagctagttaacggtatagatgaacacagccctggttgtgcggcctgaggcctggctaggccatgtcaattagcctgtctttagtggatcgggtaaaatatgggccgacactctagataacaatgtttgtagagtaaagtttgtatccgaccggctagtcgatatacctagtcattgaaatgacatttccaatatccatgctatgaacaatgacacaatattcattctggacaagcaaatataaggtttaagacaaatacaggaatcctcgtagaagttttatggtttcatatgaaacatatttgtttcatataaagatcacatcaacaggcttatagctcctagccacaacagaaat

SEQ ID NO: 4050 - DNA, 1037 bp, Zea mays
  misc_feature (1)..(100): optimal_loci_208398_G1, chr6:2715270..2716306, Cluster 25
gcgcataataaacaatcttcaataattaaaaaacctagtgtttatacttattacttatattcagcacttaacacatgtatcttaaaaaatgtagtaaagtttatattcatatatagacttgcacatccctcgtgatacacatgatacatacataccaggtgtataagcctcttttttttctcttttattcatttttgttggagatgtcccgtgtcttgacagccggtcgatctcgaggtcataagcgcctgagcctaagcgctttcgatttcacctttattaattacctgatgcataagcgcctgagatcgaatagaggaagaaggtgacgcagatagcaacattttaatcttgcggtctgaatgatcggaaacgagagcgaaagttgagtcatcactcggcaaaaaaaggagggtcacatctcaagggtaggtaacagatagccttgctttgctacataagaaagaaagaaagggtagcatgctggctctagatttcttggagcacttgcatgcagagacagtgcatgcaaccctcctagctagcttaagcttaagcttgacctcttcaagtgtcccatcccatccctcgcgtgatctgaaaagcttgctattttatcttagcagcaggcatcaagtcagaaacgcgtgcgtgtgtctcccttttctgctgcaacaccaaggcagcggcctctgctgtgctggcgactcaccccctttttcacggggatctataaattgagaagatgacagacaacacggcggttttcccggattttttggaggagcttctgacttattagaatgagtataatgataaaatgttacaaaatgcagaggtgaagaagcgataataacgtggcgttgtgccgacctaaacactgaaccgagaaaaaaaaacatatgtatatctaaaaaaatggatcagcccacggggggttgaccatcgatccaactcgcgtaaacctttttggacggggatctatcatcgtgtgacaagttcaggagatgacagcacagtttacttccggtgcggca

SEQ ID NO: 4051 - DNA, 1110 bp, Zea mays
  misc_feature (1)..(100): optimal_loci_20899_G1, chr1:119660926..119662035, Cluster 25
taccgcgggtgcgtgcgtcccatacccatacggtgagcccgcgcccggcgtggtctacgacgctgcacgagcgggtggtggctccgctcgtccgcgcaggtcccgcggccgcggctccgcgcccgcgccggcaagccggcctcgtgacccgcgattagcgtgttgatgcatgttgctgtccactcggggctaattaaaactctacttgcggtattttattagtgctagagtttgataaacaatccctaatcgcatctgccgtgccgcctgtctgtttgcccgcttccctcccagcggctgacgcctttagatggtgaattataacagagatcaggtagcgaaaggcagctgattatgtcgtctcctataactttacttgcacgtgatgaggccgccaacggtcgatttcggtcatcagagtatatgctttctctaatctatcgacatactctcgcgtaccatcttaagtatcatgttctttaattttgtggccttgagtactggaggactagactagtttgagaatgttattatataatagacacttgaactctctttattttctatggaaactacaggagtctttgatgcacttgaactgtcaaagttcagaaaaaattctgaaaaaaattatacatattgtcttcattttgctccctccgtctctaaaataaatttcaaggcttcaaattgtcccaaactccgatatactcatttatttcattatagttttcaacggtcaatatattcatttatttctcttggacatcaaaatatcaaaacttattgctccagtttctcagcaaagtggtgagtgcagttacagtttttttaaaaaaagatataatatgagcagtactgtgttttctcttgtttgctaaaatgttctaaacctgttagtaatttgttctctctggacacggagggagttaataccatgtggtcaatttgtttccaagtggagttaataccaagtgattaatctgtttcttctatgggcttgtttgcgactgctccataaactccccctacaaactctatcgtgtggagacttgggacgaaggacgaaccaaacctcgagcattctacactggttgcatactaaccttg

SEQ ID NO: 4052 - DNA, 1108 bp, Zea mays
  misc_feature (1)..(100): optimal_loci_210852_G1, chr6:17976805..17977912, Cluster 25
ccattagtttaggatatagtggttgtgctcatggactatgtgcactgtatgcacggctataccacacatgtgtgcgtaaaactgccaaaggctttgttgacggatgcaacgtattgccctgcagcgcgcttcagttcaaggcaagttcgtctctataccacacgtaagtaagaaaaagctgagaatattatcttctccataccaacaaccgatagcaacctctaataatagccagttgagtcgtcgactgaggcagaatattacttgccgtatgggagtcatttttgggatcaactcgacaacttactgccgaaaataattgtagctgtggttgtggatgcacgtgtctttgtgttcagcctagagccctagacgactaggagtccagttaacaactattcagcttggcgtgacatctgccagttcaactacctacatatgtgctaaattaaggcgtgaggttgctaggtcatttttcaacgggccgggtcaattttaatgaaaactagcaatgtcattttcatcaagttgtaccatttatttcactgagtgtaacttttttgtattcagcggagaacatttcaccgaggaaagaacattgaatttattgacccagaatatggatttttattatgtaacataaactgtccctgtataaatttgttgtttttaagaaattgtggattggtggttcactaaaggaatgcccggacatcaacaatcaatgaggccttaacatataaagctacattcactttggtggagtcagtagtatctccaaatatttaattttgtttgatatggcacattatctcagcatcaacaatcaatgatgccttaacatataaatgaagatgtaataaatggatgaagaagatataggaggcattcattgttgtataaaaagcacaaataatgtatacaatatggtcttacaatatgttatttactccttcctccttttcttgtttaacaaacgattacatatatatctttagttttgtaagaatacaagatcaaggtagaaggagtacaactttgtaggcagagcgtcgtttctctctatttatagacacgtggtacaaattcagagaaattacaactgcgt

SEQ ID NO: 4053 - DNA, 1138 bp, Zea mays
  misc_feature (1)..(100): optimal_loci_212844_G1, chr6:31429962..31431099, Cluster 25
caaatgcgtaaaactgaaatatgaaatttaccaatgaagatgcatttgtattttagaccaagatgataacgagtgccttttgaacttgacccttgattgtgagctatttcagctatataaagatgagaagattgttgagttgtccatgatatacattacttgtgcctacaagttgttcccttgagctctgcctccatagctttttttctgcttacttcaaacttaagcgcttcgttgcatagccacatttcaaacttttttagatggctctcatttagacgattgtttcagttcccactcctaccacttctgtagccctttagttggataacatgtggagaaaattgttgacagtccattataggccaagaaaagtgagccctagtatataagaggccccacctcagggcctcgtgatcaaaagtcgaactatttagatattgagacaagcaaggaaaatcaatttgggagatttggttgaagcatttgcttaggtatcttctagtgacaaaaaaacaatagacatggatgtactactactttcactatatcggtgtgctcatttttcactacaccatgcgtttaatggtaacaatgcatgaccctcacttgcatgtgatcttgattgagcatggtagatatgctaatgtgtgccatactaacatgccactaactagctatataagtaactaactacattatagatgaagttattaatacataaaaaaaactcatcttcgccggtacagagggcgccatggttagggagggagagcatgattgagttggagaaaaaatcctaggcaacacgatctacccctgcaccacgatggagaggcccactgccaccacatcgacgtgtgttgggtgggcgtgcgtgtgtgcaaggcgagggagcaagcgagggcgcaattggcggggctggtcggtggagacgcggggtgggcgggcgagcaggggcatggtcggtggctggcgttgctgggctagagaaatagtggggtaaaacatgtgagctggaatagagagagcaacgagaattaatgatgataaggccagtaaaaaaatttacggtgttgagatccacgccaagatccatgattctactataccgaggtcggcgtcaagatctacgaaa

SEQ ID NO: 4054 - DNA, 1001 bp, Zea mays
  misc_feature (1)..(100): optimal_loci_217438_G1, chr6:63962005..63963005, Cluster 25
aagacaatgtgcactaacttaaacttgtaaggtataattatgtatctcatgtaatcttgccgacgcaagaacgctagtattctcttcaatgcatagttgtgataatactacattgtttttattaatcgccactaaatctatgaagcccatattttaaaccccctctttgcgatatttttggatctccatcctagatgatatgaaatagtattgcaaactgtaaatagatataagtaaaccattgacaaaagaacacttacaaaagccaggaagtgattgagagaaatatcgagagcctttcacatatatgatagttatcctcgaattctagtcacatgtttttaacaccattgaagtagtcagtatctttgatgagcacaccaatacagtcctcttagcagcgaatttctctacgtacaactcatagaatatgtttatgttaaaactttttttgagtagctctaatctggctagaggcttgttaggcctatacttggtagcacatttttttttatcataccggtagatttaaaaatgtctccatgttaatatcgtgttttggatagtttattagaaattaattatggtttttttatcgagctacatgtattttcttagtatgtttctgataattttttccgataaaacgactaatagaatagctttgtttgatttttgcacggctcacaaacacagactgatcgccatataagcgcctctctacatctcgatcaaaccgccgacgaaaaaactccaccaaaatcctcatatatttctccagaaaacttaaatcctgatgcttcctgtctcagccctcacccatcacctcgatacggttctttttcctgtctcagccctcacccatcgcctcgattcagtttttttttctctggtcacgagcaaccacgttgctcaagaaaaaaaaacaggagaaatctttgaacaccactctaattttattttacgtagtgtcttatttattatcgcaaatcgtatgagag

SEQ ID NO: 4055 - DNA, 1011 bp, Zea mays
  misc_feature (1)..(100): optimal_loci_223677_G1, chr6:102242035..102243045, Cluster 25
tcagatacctaaatgtatttttttgaaaatagtctaaaataaaaatttaggatggtgaaacaccaatatacaggatcaagtaacgtctaatctctactatataaagcacctgttttcacagtccacggtcaccctttccacattcacacatacctaaccaatagacacctatattttggcgttctattaaaacaaagtctatccacgtgatatatagaaaccgtagcaatgtatagatatttgaatagtttaatactattattgagttcatgagttggtccccataaaatggtcttcagtacgacgcgcaaaagtattagactgcacaaacaatacgactaatgaaattatagccgcacatacatatatatatatacaaagataagtttgaaaatttttgtttcatcatcataagtcgatggtcatcaccaagcattgcctagcatatattggcatctatgtttcagctgcaaactcggccttcaacaactagttttcagaaagaagaaaaaaaaacttggtcatcaggatttgccaatgtcttactatatcgatcactatcgacagcaggactacattatattgccgtttaatttgtctgtctcattgatgcgcaacctaataaagatccattgtatttgcacccccgccggccagatcgatgacccagccaatgactggtttgacaaaatgtcgtcgttgcatcaatcatccattaatgtgaagagtcgtcgattaataagtcatgatgtcaaaatgtgtatgcaaattcagctcattactgtctaatactgttcgatcaaaagttgatgaatgggcaaataattcaccgaaatcattcaagaattggtgagctaagcattatcaaaccacaccgaaattcagtgcatgcaccatgcatggtaccaattgatgtgctagaacgacaaaagttgcaactctaaatttttttaaccccccctagctaataataacccaccaaaacatgcatgtgtccacttgggctttata

SEQ ID NO: 4056 - DNA, 1331 bp, Zea mays
  misc_feature (1)..(100): optimal_loci_224264_G1, chr6:105103048..105104378, Cluster 25
agtgattcatgcatgaaccggctctgtgagttcacaacttcacattgaaagtccaatgaattgatataaaatttcttgacgggcactaaaattataggcaaagaccaaaattgttggaaaatcgtcaataggcactaaaattttatctattcaacattataaattatcataactttctctatactttttttgtcaaagttgagatggtttgatataatttagaatcgaagagtattgaggagagttttaggtagataacaaattttgagtcgtacgtcgttacctgctcctgctgcatggatgcctcgatagataattactaaccagtaattcatgtatgaagccgctgtgagtcacattacaagtcaatgtttagagcttgacatttttctcgaattataaattgatataaaattcttgatggtcactaaaattataggcaaagaccaatgaattaatggactatcgtcaataggtaaaccctaattaactatatattaactcttcaaatataatgttatatttgttatctatcttaaagctaactatatgttctttgcatcctatttccggtgaacagttattttagttagatttaattaccgaacacaagtggttcaaacagtattgctgatgactaattttttttacaactacgtatgtatatcttcaaacaaaaatgaaatgttgggactcagagcatatgaggtggtggcaaatcctttcgttatcatcgtcatcagactcatcgatccgagtcactcttctctttttcctggcctcaagaggagggctgatattggcagtaagtgtttgagacttaggggctcgatcaatagattttttttaggaaatagatagggccttgtccatcatcgtccttagtcgcccaactaggactctacagaaaaaatggtgttccagcatctgaataagtatgaagaatgattcatgcaagaccgatgattttaagaagggtataagcaagagagttattgaagatatctcatggcaagactcgaacagggtgtaagcctccatcaagcaatcttcgggccagttgtcgatggaggtaaaaagacattgaatttgggccttagtcttcgacatgttgatagacttggccttggatttggataggtcctcgtttttgccatattcgaaggtgtagttcaccttctcgcataaaggagagactcaacattgagttcaggtaccgtcaacatggactgccatgagacctgaagcctttaactattggattctgttcataattgatgagatggtatctatatattttagcagagggtctttcgtccacttgtattgag

SEQ ID NO: 4057 - DNA, 1022 bp, Zea mays
  misc_feature (1)..(100): optimal_loci_224853_G1, chr6:108080863..108081884, Cluster 25
aggttgtacctgttttaatatagaagcaattcacatgcttaaaaaatacagtcgagagctagcgaaccaaaccgtccgggcgcccttgttgtcaattctccaaaggcgccatagctttctgtgttgatgtatcgagaagcccgaagacgcacaaaagttgaccactttttggagaggcgaaggacgacgcgcacgctacacaggtgtgttaaaataagcgcttcaaaactaggggtcgtctggatcttaagctttttaaaaaaaatcagaatttacttaacgagctccaagcaaccactaaagctcggaccaaatcgtgccaaaagattagaaaatttaattagttggtcgtcattttccgtaatcccgtggatgggttcaagtagcagttgcagttgttgaagtcgttcaacaagcctctccacctactccgctcctctcccaaaaagaagaagaacaaagaagttccttatagttgctgacatgaagataggtcacgcattagctaacacctagattgttcgagtcgatataggctgaggaacgcagtagagatcgagggcacgtgttgacactcaaaaacctttcaaaaattcgcagttaattcatcagactttcaaatgaggtgatccatgtacgtatgttttcaatcagctcgacgagagaaatccaatgatgcaatccattctgtcgtttgaggaagtcggcaaattaataacatccgacttagatggttcgttgtttgagctcggtcggccctctggagtcgttttcttcgtctcgattttaaacaaaggtgatctaaatatgttttctagtcgccttggtgatagaatcatgatgaacaaagcatgttacacactttagataattttgagtgttgacacatgccccctggttttttagtaaagcttgtgtgccaaaaacatccttgttatggacttctcaaagtgatgtcctaaactttctcatttaattattgcatctacataaagcgatcaactgtcaccatccaaggtaaa

SEQ ID NO: 4058 - DNA, 1276 bp, Zea mays
  misc_feature (1)..(100): optimal_loci_225345_G1, chr6:110270602..110271877, Cluster 25
gggtgtgactgatattaagagttggtataaatgactttcaaataatttggttgtataatttagacatagtattaaataatttgactgtgatgaaaatttgattaaatacacgtgtgctgtgctaaatacaatttaaattgtgcagcattgaatgccaataattatacttaaattaaaaatgatttaatccaatgaaattaagtttatacaagatgaaatacctatttgtacaataggacataatagaatactacgattgattcataacacaataatgttagtctcaagttaattctacatgtagttatggtcctaacaacttctagaggtggccaccctatcgttgactgtatcatagatgtgcacaatcaaagtaaataaaaattattctgtttttccatactaagatatagcattttctatctattatatctaagaacatcttacaaatcttaatataattgtctatagcaaaagagaacccgttagtttgacaagctatcgtgtattatacttcctttattataaattattttttaatattttatatatagctttgtctatgcacttagatagacaatatatctataaataataaaaataatatatctagaacaactaagatatttataatttataatgaagagagtatttttaaaatatatcagtctttattgatggtgaaacataatttaggccatgttttatgaagtcttcgtctaaggttgtctctactgaatatctactgaatagtggaaaatagaggattgtattgtaaatgacactatttacggaattaagtttaaaatagcggatataatagagaatgtgacagtgccgaggggagttgacttccacccattgctatagtagccgtggtagccagtgaacaaaaagagagaaaaacttcgtgaaccttggcactatggcgttaaaaatacaacaaaagatgaagaaattctatcgaagacgactttagtcattggtaatattcaggtctcatttgatatggttctaacaactctggcgtctttttatagtgtgcatagaaactagtgaaaacaaaagcagtggcttcatgaacttctagtatatttgagagatgcgagatacaaaagttccttacagtagctcatctattgcatacatcatttataataaataatatgaaactacaatcacgtagcacatgctcctcacgctggattattctatatttgcctactttgttttaccttctggcatgagaatcggcttctgacacccaattgtttcg

SEQ ID NO: 4059 - DNA, 1121 bp, Zea mays
  misc_feature (1)..(100): optimal_loci_228961_G1, chr6:129767249..129768369, Cluster 25
tatactaatgttctcggatggaagccgtactacagtagtagggtacgtgtcgttctaatcggtttatcccttgaataatataaatcggatggctgtcggctggttttgcaaaaggagtatagccgaatgataacgatattaacatttctaattcgggtacatctgctgcacgggtgtgattgtataccgaacataaacatgtatgtgtggtgttgattgtctccacgtcatgttgacaaatgcagcattaaacaaatctgattatattcttttttttcctcataccaaatcctctgaactagccggacaactcggcgagaaggctttgtagcctccggaaaagaccagacaatcacccaaatgtgttcgaccttattatacaaacaaaaaaagaagcaaattttactcgcgagaacaccatttttatgtgacgtttgctaatgcacactgtcaatactcgattttgcccagaatcattataaaagaaatggaccttcgtcgtttggcacgacaaccgataaaatatgcatttagttgacactttctctgttttaaatcaaattctaatacgttctaactttttaatatattgtcttttatgatttacatagacatgacctttactccatctgtcgaatttataattagtttgattttttaccaagtatgaccgattcatcttatttaataatttttacgaaaatatgaaaaatatagagttatacttaaagtttattatatgttaaatgataaaacactataaattagaaataattatgaaattttttaataagatgagtcagtcaaacttaaagtaaaagagtaaaataaattataaattaggacagaggaagtatataactatgtagtaaaagctatatttagaaaagaaaaaatgaggaagtatcaacagagtgaaggagtgtgaaaggtctactttatcctccaccctatttatcttgttcttcgtctctctcccttctatttctatgctaggagactgagtacaacaatatcctctaatttccccctatactgtactatgcagccatgttacccagattaaataccaccccctacttttctcctttccatagtggttcctctctatattatccttc

SEQ ID NO: 4060 - DNA, 1031 bp, Zea mays
  misc_feature (1)..(100): optimal_loci_228993_G1, chr6:129875018..129876048, Cluster 25
aatctacataatacttaataccaaaattttatttaatctgtcaaaggatcatgactgactgagagatctagaatctaatcgacttttttacatctattactcattttgctctaatttttcaatcccttattgattgttgcatctcttgttgatcctcgaacaacctcagacatgcatcccaagttcttatgacaaaggacatgttccaaattggtgtaatcgatcttttgataagtatcattaactttggagttgcttgctaatgtttggtaggttgtgtgcgacctcgatatactaacacttgttggtgtgtgatccaatttgatgtcaacatactttttggtgaatcttctcagaaagaaggtcaatatgtgttcaagatgcataaagataatgacaataatgggatcggtgatttcatcgatgcctccaatgggaagaacataatccatcctacaactattgatcaacttctaaaggagctccacaagatggtggaggagaagaacactactaatgcggtggatgctctagtgggttgcccaatggagtaacgatgaagtagtgtggcaatacaattcaagcacataaatgcctttactcttggagctccaaccatcgctgcacctaaggtaacaccccttgtaggtgattctcttctatggttacttttgagcaagtgcaaatttttttgaaggaatgtgttggtcacttattaaagtccctgcaaggaaccataatagggcaacacagttaaaatgatgatacttcccccttgccaatggatacaatgggacaagaggagaagggtaaaaacaataataaaggtcatgagcttagttacaatataaagggaaataatcaaataaatagcatcatggtcaatacaaccttttcttttgttataaagctcgattacatgataccattcggaacagacgctggttatccgaagataggtacaacgagggaactttggagctaagccttcgaaggtgaaggaagtatatgtaagttgttacatgtcaccc

SEQ ID NO: 4061 - DNA, 1224 bp, Zea mays
  misc_feature (1)..(100): optimal_loci_229150_G1, chr6:130260713..130261936, Cluster 25
cccacgagaggctctgagccccgttcatattgctcgaggtcgaggaccctagggacccaaggccgatagaggtccttgggcagctaagtgtcccgcgaaatggaagacccggtcacataaatccttcatgggcgccccgaggcacaagaggacccaggggcttaaatccttcctgagtgccccaggacacgaggggccctagggacttagattgttctagatgataacatcccaaggccccgggccttaatccatccttacatactggcactaaattaggctttaaaatgcatgagtccctaaacttgttaatgcaccactcaaggtcaaaatcttcctaatccacattaacttgcttatgtggcacacttaataagtttagagacctataggacaccatgagacaagttgaagtactgcaaatgcattttattttgaaagaaatagatagaacataacatgggaaacttctgcatgtacgaaacaaagggacatcgcaacacgggaaaaattaaaggttacgagaattaatagtacacctgtaaagtaaaaggcaatgaagagttcaagttgcaatcctcaggtggatgaaagatttccatagggcaactctcatcttcgcaattcagttttggggccctggtgttgccacaaaatctcattaatcattcaccaatgagaaaacaatgaaaaaaggagtatttaacacaaaatctgaaggtggtaagttacatctcatcacgacttccatttataagtgggccccttagaacagctccaggtccaacctaaaaaaataattacttacaaattactacaatgttcttcgaaaggctaaaaagtatcagacggcctaactgcaagaatgaaatattgaactggagtagtcaaagacctatcacaaaacatatttcctatgttatggttgtacatgggtgcagcctcaaaggaaagcaaggaatagaattttgattgcttcagttgtggaaaccatctaaattcaacatcttaacttagatatgtcaataccatagcaaagaacactataaaataaaaacaaacagccaaatcctgtaaaaaaatgccaacgagtgagcaagttccaaataataacttcgtaacaggcctaactttatttgagaatttaagatataaaacgttccccaacctatttgaaaccactagaaatgtactaagaaaggtacaaaggcatgcaacatgata

SEQ ID NO: 4062 - DNA, 1258 bp, Zea mays
  misc_feature (1)..(100): optimal_loci_229363_G1, chr6:131410069..131411326, Cluster 25
atgtcgttcttcatgcatatatatggaatttggtagatctgcatgaacagaatgtcgaaaaacaaagacggcatggttatctgtgcaaagaaagaaaaatatttttaacctagaaagtcaaaacaaaaaataaatagaacctatttttaatccgtagtttacaaaaatcttggtagaccttacaggaacaacgacaatattagcatggatcgttcactaatagcaaagagtataaaccaccttaaacattttgcatttttttgtcataattaaccgtcttatatattatactattgaataaaaaagaaattaatttacgtaatatgtttctacatatgattttttttgttgttggtgaaggatggttaatgaattccgaagcacataatttacgtaatttacatgcctcatatgtgccagtcacaggttaggacgattgaacccatacgcgaactgcacacaccaattggtgtaaatatataatttttccacgtcctttttgctgcgccatcatatgattttttcgtttgctcgctggatttgtatacacatcaagtagtgacgattcactagccatgccatgccaaggcatgcaatgcaattgaacatccagcgtgtataaacgatctacgtacgttcattatattcatcatactcattttcacaagcaaaccccccgaggaaatagaaataatggtgagtttttccatgcacacgacgaatatcaatgcaaaccccactagaatgaagagggactcttgcctggtgtccctgaattttaaatgtacaaactcaaaggattacatatatactcatttattcatctctcattttagtaagattgatacaaatcaagtaccagcaacataggaaaaaattcactcgatctcctgtatgtatacaccataaacatgtgtagatctagctagcaacgactataccaaagctagcttgcatgtcatttttgtttatgcgtatatatatgagagacagtaagaaggtacacggtgagctaattgtggtggccgatgccggggctcggaaccgatccctcgacaacctccatgattatccgcctactacggttgttagccatggcgatctcggccttgtctttgcctttggacagcacaagagtcgttgacgaagagatcgacgatgaagaggaacgagtgctctccttctcctcggcatgcatcatcgtcgtccttgcgtgcacgagagacagtcctgatgccaacagaagcaaggataggac

SEQ ID NO: 4063 - DNA, 1363 bp, Zea mays
  misc_feature (1)..(100): optimal_loci_229373_G1, chr6:131472162..131473524, Cluster 25
aagcatttttttcctaagataatatcctcggtcgatatatacaatttgaactgaaaactgaattagtatgagcgtgatgtgaaacaaaaaaaaaggctgatggcatatgatagacatcggatcaggaataataaaatctcaagaactcttgcagctcatgaaaataaactctatatctaccactcgaattggtagagaaggaaaacggagttgaagaacatagtctttctgacttcatttcttgggtccatcccaagataagacagtcaaccatggcggctctctattattcagtttcgttctccaaaagatcactcgatgatctcctgccctatatatagctagctgattgtccactcataaaagcgtactcaaggacagaccagaaaaactgatgacctaattactgaaccaccgtacatctaatatacgtgtttaaaaattaaaggaccatcatctttacgtgtgggggtgcttccaaaacacttcataaaaaagccttaatttaagctctggaagaaaacatgtctgtagtctttttttaattattatctcaactagtaacttaatgctattatatttgtcaaatgtgcaaataacattattctactgcgaccatatatgaacgtgctagctatatgcagctcggttacaaaaataaattcacagttatttaaaagacactggcactatatattcagcagagacctgctggctgatataactgggtataaacccgtcgcaaaataaatacaccttgttcttagtgtggcgtttgttttctaaatgttcaaaaacatatgcatcttgcatttaatagacatatgccttggatttgtatataaaatacaatgttatctttcctcatagaaaaaaaaagaatgaaaaaggtcgtagactgctgatgcttcctcatattaatacatatatgcatgcgtaggttatggccatgttgtgctgggtgcttgtttagttttgctcatcatcaaactccatttgaaaactatgagttggatcttttctgaccctgttatcttcaagctgattcattcaatcacattatttggaaagccacacacacacacacagaaaggtccctctcgctacgtcataacacaaaaaaaaacaaggccaaagaaaaacgtcaagtgcattgcatatcaacgtactgatacaataatagatatctcattatacctttttatcttcagcattcagtggagttcgatctgaatttcttttaaaaaaatatatattagtggggctaatttatgtggttcctggcatgcatggttgctcaaaatgcatcacaggtgtcatccgaaacttttgcacagtacgtagtacaagcgtggtcgccatt

SEQ ID NO: 4064 - DNA, 1107 bp, Zea mays
  misc_feature (1)..(100): optimal_loci_230335_G1, chr6:135487079..135488185, Cluster 25
gcatagcagggaatcctagtcgagaccctctataatggttttgagtacatcaaaatctatttcacttccattgcattgagggctttgtctggttgtagtttgtccctgtagacagcgaggatctggttggaggccccctacatgatgctaaggtcctggtcagtgattgcattcgtaggagccatctacagtgccaactaagagaaggtataggctaagtaggttccctatcacctaaagtgaatagtctacatctaaaacaacatatcagtgtagtagcaaaataacaaagttggttaggaaaggacagtgattatagatcagttgaggagaaggatggattgaacaaactcttaaggagcatgcataaaccaaccggttaggctaattggttgagatcccacaacccccacatccatccacacattctatgattgaacatcaaccccttattaaccagtagggaaatggtctgctagtttacatatcatggagataatagaaatatgaaaagcattatttttgccactgtcttggtaggggcaccgagtaatcataacattggtggtgtttctgaacttccaacatacctggaccaagacacaatcacctagtgagatgatgactccaacattatgaaatactagcatcaacacaaaagtgacttatcgagtcctttcactactttctaaaggcattgaactgcgcttgtcccaaccttttagatgatgacttcaacatcataaaccctaaaccatcagaacaaaagtgacttatatagtccttttgttacttgctaaagatttgaaactatgcatgtttcaaccatttagcgatgacttcaacatattgatctaatagcatcagcatagaagtgacttatatagtcatttcagaaactaatacttcaccacatgatctaggataaggacttagaagaggtcttcaataactttatcttaatggttgacatttaccaaatgattctatattaagactttggataatttggtcgttattgtagatgatcatgtcctgccaagacgtgatgcttgtatggttaactagatttgcagtgccacaaccttgatcaattcaaataccatc

SEQ ID NO: 4065 - DNA, 1250 bp, Zea mays
  misc_feature (1)..(100): optimal_loci_230857_G1, chr6:138452338..138453587, Cluster 25
atataattctcataaaattattatgtttcaaagaaatcctaaatggtcttatggtaggtacccgttgtgtatgtaccatgtgccatctctttcttgaaaaaaaatacaattctagatttagattaagttcgtctaaatctatattaatattattaacaattgactctaatagttatagtgtaaagtgtctagatttagacatagtcaaactcattaagttaatttatttaataacgtttgtaaaaagtatggagccgcaaacccgcattctcatctaggaccatagcgtatttgaaaatcaaattcgaagaacatccgtttcgtggtcctatttagaacctctttggaatatattcaagtgttgtagatccattaaaatcagctctggatttcatttgtgtatgcaaacacctcaactctatcatatctaaagccatcaaaaaactgaattttggaaccacattcatagattctatgaacttatggagcacctcaaggggtgctaaaaaatgtagatttcatacatcctcgtgaagttgccagtaattagccaccatagccatcaataacacaactcatgcacgtacttgttcacggttttcccttctattccaatctccctcctcccaacattgatttccctaccatacaataaaggtagtgcgaccaggaagccatgatgcatgtttcctctctatcggtgtacatcctcagttgtcaatgattatcggaggaggtagatctgaccttctaacaccttcccacccctttctttctcaattccccaccgggaaattggttctgagggttgggcttttcaggtttttgtcagtatagttcgtgggtggcagaccgcagacctcttttgaagctcttccattctctagtggtccggagtgcggcctcctagtttggcacaagtggggcatggtcacctagctcagcatgggtgggggtgtatccatctagttcgatgtggatgggggcatggccacgcagtccagcatgcagacaatggttttccctagcgcatttggaagaacgacgacatttaggctagcattgcatcttgggatgcaactatagaaaaatgttggcataacaggcttagaacaacatgagtgggtatagcaaggtctctcccccaatacctccatttcaatgtagaacatgtgcttcggctacaataaagagggcaaagaaggacgaggtatgaatatctcatacatttttgttggataaattttatt

SEQ ID NO: 4066 - DNA, 1392 bp, Zea mays
  misc_feature (1)..(100): optimal_loci_233209_G1, chr6:149077983..149079374, Cluster 25
ttctcacttgtaatagtcctacaacattaagagcttgtagatctttgcattccaatgaggaagactgaaacttatgagagtgagtggcaaccattgggagtagtaaaattggagcagattaaaggatcaatggcgtcgaagcaagttctagggaaagggctctctgaagaaagatgaaggatcagttgcagaggagcatttggaagcagaaaatgaaggctatatgcatgaggaagttgaagcgccatgggatttccctttatagaggtccataaaagttgaagcaacacgagattgtggaatcttaagccattcatgaatggatcgagttctgagctctaaactaaatccatgggcttgagggttgttgaaatgagttagtgactcagtcaaagatagatttatttgatcataataacttaagtcatttcagaagatacacagaagagtctcatttgtgtgattcaatggctcggctaaattggactcatgggctattgttagttatatgtaccatgggtactaaaccaagtttaataatcaaaagaagcatatccaagagaagagataggcaggcgcttaggctagtccaaaagcaagtacgagtggaagggactatgagctcggcaaagagcccatagactcggcaataagtctgggaggaagtcgtagccaagaggtttttagaagcgcgcaaatattgcaaggatctcaaccgaataagagataaacttataaacatagagttggactcatgtgcgactccataaccgactcgatgtctaaactattgtccctctttaggatttgaactccctaaacatcagaagatacaatgatccatcataaacatgatatagggtattatatcatattaagataccgaatttttataaaccctcgtgtctcttgtgcccaaagtttcaactcccgatctcatggtaaaccccataaattcgccatcgaataatcgtggacaagtttatggaaggttattttttctcgttatttttccttgactactcaagtaaaaaaacagaaaaccaagtaaaacgatagaactagaagttgctttttaacaagcagccgctttcgtttagaaccattttttgtagcatcttgtaccatgcttttggctttcagcttttttgcttttcacgtggatgaaaaaaaatagaattgtttgtcagatgttcaagggagaaaaagagagagaatatgttttaactaaaaaattttttgcagcacgtacgtagctcacagtatttttttatagctcgtaatagattttccacaacttctaacatccgccaggttgttttgagatcaatgaaaattcatggcgggaatcctttacagacgaccatcaggggaaaaaaattattgatgctc

SEQ ID NO: 4067 - DNA, 1245 bp, Zea mays
  misc_feature (1)..(100): optimal_loci_233287_G1, chr6:149334883..149336127, Cluster 25
gaccctagcattgacacgctgccatcctcgtggatctcaataatgactgtcgcttaagtgtcaatggactaggagtgatgactgaatggccaaaaagtgatggaaaaaattgggatgggagagtatatgattagggttttagctcgttatatgcaaacactcggaggtgaattgttgggatgggtccttcatgggtcgacaatgtagagggattagcttcttttttgggtccccactagtacctcgtgggtgaaatctaatcctcgcttcaccatccccgtgagagggattttcggtcccatcctcactctattcggggcgggtccccgcgagtgaaatttccacccctagctccatgtgcatacggataaagggagtccaactccatttcttttgtgatggggggtgttgagagattttgtcctcttctccgtagattattaaaatacttaataagtttatatagaatctaaaaaaccagtgcgctttcagatttatttgagttgtcaccccatgctagataacatgagtatcatagccttatccttgagtaaatataattaaaaaataccactaacatttatggtgtgcaataagtacgtaaaatatttttttcgtaataatataatcctttttagagattcaaattgttgataacaattttacaaaccttgaccatctaaataaagtttgatctgatttaaacttataatggtattgttttgggcgaggaatggagttacgtactttcatactagaatttggctttttaataaccattccccgtacgtggttcagagtagcggatgtgttaaaaagcaatcggccttcggcattacaaggggtgtcctgtgtccatggcatgggttttaatcactgacccacagtattgtcccattctagcagctaggcatagctagccttattaacatcagtgtcgcccgacttttttttttcgtttgaaacccttctcgttgagtgaactttagtttgtggttccgccacgtcagtgaagaagctgtattattattggttaatcaattaacacagaactgatggaggggcttattattcatgcatggcacacaagttaattaagcagtgtgggtgcaatcacaactcagcacaactgtcgtgcgtagttggtacgctacacatatatatacggtagctagctagtatcaacacaacagcttgcaggattattgttgtgctattcatatctgtattatgagttgaatggtc

SEQ ID NO: 4068 - DNA, 1110 bp, Zea mays
  misc_feature (1)..(100): optimal_loci_234611_G1, chr6:155434570..155435679, Cluster 25
tgttagtttacaagctagaggcaatgctatcttttccttttatattcttgttgaataagtcatggtgacatcgacttgctttagccatcttcaccacgtgcatgtcaataatccgaagctttcagcttcgtccctgcagttatgatggctattcattgtccctaaatgaatatatctttcggtatctgtcctgcttcatttaaaataggctaaaaatggctggttagtaaatattttaaaaacctaaaaggaactaaacagtcccttacacgaagtaaaagtgtgtttagaatgctaaatgcattcaatgtcgttgcattcaatatcatacacttaacgtttatatttgtaggcgattttttcatttggttttttagtaaagtttgttagcggttcttaaaattgtttaattgaatcgtcccagtactagtaaatctatttaggttcttaaaaataaatatcccaccgcttcctaatcacaaaaccaaaataatgtacttctatatatctagataaattattgttacgttagtgaaaatgttactgattaaaatcagtaacttcacctgacctcaaatttaaagcataaactacataacattatgaaactagcataactggatcacatgaacgaactttcggatctaaagttattaacaaaataatgcttaatacttgttgtcctatatagtgacgaaaatcaatcaatctctaattttgtaattaagcaagatccataaaagattactattccaaccttttttggagactaaattgatcccctaataatgatgtacatggttctaactaagagtaccaaatcagtctaagatcaaagtatacatgcaaataatgaacaaagcaagagaaatgagattaccacattaatctagcataatcaacactttaatctctaaggtttatgtgtacaaagtgctctccgaaagcactatagagtttcccccaaaatttctaaaagctcgagattaatctaatctattagatctaattgattgtaccattatagtcttagattagatttccaagccaatacaattcgggcagcccatctcatcctcctatcatatgggattcgcctaatctgttgtc

SEQ ID NO: 4069 - DNA, 1106 bp, Zea mays
  misc_feature (1)..(100): optimal_loci_235855_G1, chr6:161533082..161534187, Cluster 25
caaagcagaatcttgactgcactacaaaagcgctaactgaagcacgagggagaaaccgagacttattgacaagttttgaggattcagctaaaaaaatcaatatgcttgaggattcacttaacaggttaggtttcatttgttacaagcatttgtgatttgctctttgcttgaggatttgtttcttctttactcatagactagaagaatgcacagcagagaaagactctttgttggcagtagaaagaaaacaaaacaaaacgaccaaagaagaactggccaatgcccagaaaacaatcgatgaattagtacatgagtcacagcagtcccaggaaataagaaatcaattggaagataccatcaagaggtctgatgctttttcttcagatgatgtgtccgaacttctttcttgatatcatcattacactgtgatagtgacttttcagtgcggttttgaaaggtttaaagcagaatcgactgccagagacacaatattattatcagagaaacaggcacatgagacgaccaagaaagttctaactgaaattcagtcgagaaatgaagagttaatcaagaaaattcaggattgtgataaaaatattcttgagcttcagctaactgtggagaggtccataatcgtcccttattgtctacctagcaacctctaggatattaattctgtcagaatgatacctattttaatttttgaatcaactccatatctatgtcatgagtacaggcttcaggaaaacacatctactacagaggctttactgttgagagaacgagaacaaaacaatgcaaccatgaaggcacaagctgaaactcaagaaataaatttgcagttactgaacaagcttgaggacgttgagacaaaaattggtcttcttcaaggaagtgtacaaaggtactcttaagtctgttgttatatttgacagataagtaaccctgtcttcagtcaacctcattaatactattagttgttgattctatcataacagaaggacaacaccttactcctttgtttgacaagctttgatcagcaaaagtaggcagtaagtattagagaagtatcgggatggaattccatagtcattagattaaaggga

SEQ ID NO: 4070 - DNA, 1368 bp, Zea mays
  misc_feature (1)..(100): optimal_loci_237793_G1, chr7:3475803..3477170, Cluster 25
cattatgttgttagccttcatcgtcaatgtcaaaggctagcctcaatatccaccttaattgtaatgttgggggcctttaggcacacggagcattgccaatattggatgcttttatgctcgttatgagctatactgtcagccaaagaaggtcactattaatggtattgtgaaggagggtcagtttggcaactactcgcttatgccttggtggactcaaaaggggtaggagtacatgatctccttggctgacaataataattgcatgaatgattgggaccgctactaaatctatgtgaagataccaagggctacctctaaggattcaagagtccaggaagtttttagttcctcttagtgtccaagattgagaagatgaccctaagacacacattaaggctaaaagatgtgagggatgtcaagcttgtgaaaaagccttccgatacattgttcgttattacgaagggcaagatctagttgaggatttcattactatccagattttgcccttgggttggttcacctagaaggatcctacttttgaaatggtgtacgtgacaatattcgaagaggttgatggtataccctttccaccctttagccttagtaggaccaaaggcgagacaaacattatacttgtcgtgtgcgctaagggctcaacatgtgtgattcttagtgacatttctaagagagagtatactacttgaatttgtacggtgtgccatatgccccgactgaaccattttttaacttggcatgaaatatgcccctacgaggtctcgggaaacttgtgaagattgttttggagaaggccaatggtgtggaaaatgttgtgctaaaggttgactcaagcaaggctaaggcaaaaacaaaaggttgttttgagtgccctcgtgaagagaacaaccttagggggaggtgcttcagtgaaggtcattattgttgcaaatgatgtagaggacatggataaggcctttgaggatgattttggcaaaatgggggaatccactaggtgcatgcaactgtagagtttgtagggccatctatggtgaccaaaggtattaaacgattatcgacatatctatcacaaatgtttggcgtagtaatatagagtttagtatgccaaacgatgatagtgatagtggttctaaatatctattcgtccaaagactaccagataagagagggatcttggaattcatgaccaacgtcagtcaacaaaggttatgctttcgaaggtggacctttaggcttgagaaaagttctttcgagtaaggtggtggatcatcaagctttataggtagttatagtagttttctctagtgggggattctgactccatcacatggttgggtgatggcttgaaggttt

SEQ ID NO: 4071 - DNA, 1154 bp, Zea mays
  misc_feature (1)..(100): optimal_loci_237867_G1, chr7:3659654..3660807, Cluster 25
tatatacaatgtcaaaaaaaattcgtaaaaaacaggcataagtatacggtggatattttagatatcttaaatatgtctaatatataaaacactagtttccaatgttgcacgaaggacgtgttgtccatattttaacggtaaaaagttagaattatgcgtaaatggagattcaaaccatggttattgaatccaaatctacattcacatccatctaacaaatataacacatatctttattttatactacatactcaaacataaccagaaaccgtagtccggatatattgttttgacgtttgtaccgagagaaatgtttacgatttttttgggtgcatgcaacactttctagctagggcacgcgatcacgcgagggagggaaggattaccgtaccatatcatgctagttgttgcatttgtgatttgacatgggtaagaaatatgctttgtttatggggcctatatattagctacttcttgacgcgcccaacaaaagggaagtccagattttctgagatctagtagcgcatatctgtcaggtcactaggtagtagtgaccggaattctgctcctacgaccctagctccattgacatctggtcaatcatgaattgcctacatgactggtataagggccaatcatcaatccgtcttatacgatccaaacggtttcatctccttgctagtggaggtgataaatccatatgaagctaaaaatataatagattcatcggtttttagttcattgcaaggataacataaaaatagctccttgcaatagtgcaaaggagagttaaaggcgaaagccagaggttttttaatacggccttgaagcgggtggtgtacctagggttagcttgctatatataattaaatttaggcctcgtttgccataccttcactttattagtgaatccattttttattgcttcaattttatgagctgccttagtgaatcttttggcaaaacattttttacatgtcaagcctttaaaacgggaacgtatcggatgaaaaccaatcacttggtacaaaacgtgcaagcagttgtgaaatttttaaaacattcctctcaacgtgcatcagtttcaaaacaacccttttcaccttccttggtatatttttaaatacacccttccaaccctaccaacgtgttga

SEQ ID NO: 4072 - DNA, 1356 bp, Zea mays
  misc_feature (1)..(100): optimal_loci_238241_G1, chr7:5532122..5533477, Cluster 25
cacagtgacgagagattcaagtgcatcactccaatgatctggagatcgaactggactcaagcttagggctctcaagggtagtgaatatatattccggtcatgctatttatttatttattctagtaaagtacagtatattttttgttgttgttcataggagtatatataggaagtgcatgcaaatgattgtacaccagggccttatatcttttattcaaaatgctcccttatttgcgattacatctttgttatattattggcgatcgatgtgtgaatgtgtgatgtgtgtctatctcgtggaacctgatgcctcagctctcggaatccttttgaacacgccacattgttatatcaactatatcattcgacatgtctatggagtgataaaaaaccaattcaaagatcgatcacaagtccacgccacgaagattgaaagtgagattagctcatatttaacgctgaaagtaaagctgtcctccattattagatatgattaataataagtcgaaacaagtagatacgaatcgagtttgatgcaccgacaagttcgtttaaaatcttattattataccagagtttttcatcagagctgatcagtgcatcctgcaggaccaagcttttgccttttggctctctgattgtcaaatgtcttatctagggccagcaagacttcgccgtcgtgtattataggaatagtataatacagtatatatttagttttagtacgagtcaaaatagctgtgcagccgttttcttgacgatagaataatgatcactttatacatagtcctgtcaactgccgatgcaagttgcccatgctggtgaatctatctagagaggaaaaggtaggcacgcgcgcatgtgtattactgaattggcacacgttgggcattgatttagctaggtcaggaaacaacacgggaaaaaaaaagagattaagtcagacttcttaacgtttattagtatgtacgtaattgttaacataaataacatacctaggtcctgtttgatcacatgagctcacttaactttaggccactttatttcttgaggtttaaaaataaaagatctaaaattctactagaccgatcagactatcgaagcagagtctgccgatcaagcaaaaaggtttaagaggaaaaaaaaaatgggatgtcagactagttggatgtcggactgtatgggtgtatatatgcaatgatcagcaaaagctagtcctgacataatacaaaaaacaatagtcattgtgaggtgtccaatggtgtgcaataatctgatgttgttgttgtcagacacgtgtacagtgcctatggagggtgcaacgactatattcctcgttggagctataagcccccc

SEQ ID NO: 4073 - DNA, 1317 bp, Zea mays
  misc_feature (1)..(100): optimal_loci_238965_G1, chr7:10180506..10181822, Cluster 25
aaggtcatgcatggtttcatgtccgttctagaatacattattacgtccaagcccgaccacatctccaacgggttaattatacgactgctccgtggagatcaaatccgctcccgatcatcacaaataatcaagagatgtcaattcacgatataatatataatgctacacccacaccctacagtcatgtcacttcgatgatggatagcttatataataaatgcattgcgtactttggagaaaccagttttacttcatagcagaagcagggttaacttccatttcttttagtgtccgaccatttccttaactcatcttgatggtatcacgtgtggggttgttctgcttaattaagtcgtcacgctacctgaccttcttgtacgagttagtattgactcatgaattcggccactgtacacagtcctgcaaatggtagtgtgtatatatatcaatgtgtcttgaaagaaaaaaaaacatgagtgttcgattgctcgagttttggaattggtctcccaaattcaaactatgcatgctcccactatatatattttggaagaaaagggcgtctctgtgtgcgcgctacaagttgttggtggtaggcttggaaggcagcaggagatcacatcgctgggaaacatgtgctaagggtaggcattagggacagagatggacacaggataaaatatgactggggacatactaatagcgacgagtaacgaaataatagagtatggacatctaaattagactgagtagaggatcttatggtaaaattctacactctagtacttagaacaaagaaaagaaattagtgggggcatgtgccatcgctaggctctacttgggtccgtccctgattaggaatgttcggtcattctccatgtcaatgagagagctgggggtggaactccacagaaaacgttcccacactttcttttttcagttttattggtatgctagcttctgcattagactaattacgccaagtgtatccgggcatgttgccagtgcgcgagtgacatattcctacaaattgaaggcacactaattatgatcatttttttgtctcgtctcaaaattaaattcagctaaaccatttatttcatccttaaactatatgggttagagggattagataagatttaaaaagatttaaatttacagaggacttaatctcctgaatcccttccaatataccctgagatttcacaaaacaaacatagccttattaggcatcctactagagaccacatgatgtccaccctacatggcttttcgaacatgtgccccatatagatcaaatctaaatagtatttacac

SEQ ID NO: 4074 - DNA, 1335 bp, Zea mays
  misc_feature (1)..(100): optimal_loci_239193_G1, chr7:11676321..11677655, Cluster 25
tatggtaattcccggtataactaatatttccttttgttgaaatcctaatacgatgattgtatgggtcactacgcaagtaaccaaacatactgagataacttgacatgaataatcatatgatgattgtatggggatgcacttgctatggattttattattggattgcaaacatggtgtttgaaaactacttttcttaccaaaggagtacaccattgccatcaaatgatgtccacatttgatttttttgctattatgcctatgatgaatgccatatttgatgtacagttggagcaattatgtggtaattttgttggcaatgaaaggtttacatgtacttgactaggataccaaacatcccctactaggttgtacctatttatttttattctggtgcacattcttcctagaatctttgttgtggtgcacattctccattctgcatcaatcccttttagctgcacattatctttagtatctttgttctggtgcttgatttgtctttgaaccactagacgactccattatgtacaaatgatgattagctaagttctgaggtgatttaaaaaattatttacattctaggtatgtcttagtatgttctttttcgtggtcgtggaactggagtgtatacagactggacaatttgcaaagaacatgtgatatgcttcctcggctgctccttcaagtgctatgagagggaagaagaggttgacgagcatataaggcattaatagaatctacattagattgtaatagacttaaactcaaaagtacggttaataataagaagaaattaggatttaaacttactaatgccaaatacattgtcattgttatgtagtttgtaattatcatcatcatcatatgctaaattgtcatgtaactcgataaaatggacgaatgaattgtactaatactttctataatgcaatggtaaacactttttattcaaatggtaatcactcattcttacaaacaatagtgtgacacagtccaacaaaataaaaaccttaactcaatatacacctacatgcaaatacttagccaaaatcttcaaaaacatggtccgacaagctcaaacaaacaacaattcaacctaagccaacctcatagcccggtagcaccaccttgactcagatacaatcaaacagacctcaatggctatatctagttaggctacgactgacctggctagatggctagccagctaaatatgtccatagccattgatctactatcacaccagtgcagggcccacctattagcaggaaatcacctaggatagcccatgcaacgtttctcgacaacagttaaccttgtacctaggtctgggca

SEQ ID NO: 4075 - DNA, 1265 bp, Zea mays
  misc_feature (1)..(100): optimal_loci_239625_G1, chr7:13988302..13989566, Cluster 25
taaaattgtctaaaatggattgttttttttggttatattctccattgcaatggaggagttgatgtacgatgaccaggcatatatacatctgtacagagaggaagttgaagattatattagtcgcatgatcacaaaaacatgattgtatagcttggtgacggtacaataatcttaggatatatacgcccgattgtagacattattagttccatttctttggccaagacaataattggacgtgagatctagctagagagagacggtgtgagttttgggggccggggacagaagtatatgctgatgcatgcatgccagtccaggcgactggtgagacggttctagagatgtcagtagcgcaaagaacaaagggacaggaacatgactacacatgagtgcttgttaaaaaaatcacgtccaaaactggaatctgcggagcaaactagaagctttcgatttttgattccctctgcgtccgccttcgatctcgtgcatgctgcaatttgtctgctaagctaaaaaacaattgtttgattattgtggcctagggccaggtcgtcattgatcttttgttttatgtgtgtcaggtgtacgtgtgctctccagaggttacgaaggagctagagcgagagcaacagaacgatgattcctatgtgcgtgaaatacgggcaaaccgtgacctcgctccttaactaatatctccgtcacgcactgaaaataactcaaaatatgccacacctaagtttatataatatcttagcatgttgaatggcgaaccaacagcaataatacagtaccgcagccacccatgacaaactggtttcaattcaagttattttaagggtctgtttggaacgattttacacgatacgtgcatagattttacgagataatgtaatagatttaatagaaatccggcatagattttacacgatcgatgcgtgccactaaatgtatatatacatgaatttattcgtgtggattttaaatatcaaacccggtatacacacacaaataacgatttaaattttgaattaaaaaagatagttatcgtgaagtactgtacttgctactcctgacatcatgttactttagacgcctttcccacatatacaaacattttacgataaaattggaagttggaacacggtttcttggccggcgcgtgtttatcgtgagatttctcgtgcacccgagatgtcgcctcacgagacatggctattggctaccagcgacaagtgcgggctgcctgctatatatctcatgtt

SEQ ID NO: 4076 - DNA, 1350 bp, Zea mays
  misc_feature (1)..(100): optimal_loci_239881_G1, chr7:15053774..15055123, Cluster 25
taacctatttttatctgtctaatctcatctctcttccacgtcagcatgcatctcatttggtatttgcaggctcatataagaacgtaggcgtattatatcatatatatgattttgaacttgtgctgagtatatatgtcgatgaaccgccaatcaatttcgtaaaagattaatatggataggcctaagatttcttttctttttaaataaaaggctttacaggtgtgcggggggagaattgtgcggcgtatcagctcgaaaggagcatggaggtgctattctaggcccaccaaagccaattgggtcagttcgcgttgttggatcgtagcggagcacaagcacagcctacaacaattcaggcgagggcaggtttgaaaattgaattgtcgccttcaaagtggttcttacctcttgtacaaatagtgctctcattagatttttttttatatagctttttgtaaattttatcaaatatggaaaaatatgaaaccttaaatatcgaattgttgtttgtggtaagatggcatcatagtccatgtaagaacgaccgcaaccgagagtgaaccttagacctgtggtttggtgtgagacagacgaaaggatttttttttcatgtccgattgtccgagtaaagaatcaaaaaatccttctctttgtgcggtgcaactattcgtggatccataatccattgccgtgcagaggactgaacttacaaccttactgtgaggtgaactcatggtgttgcaggccaaacgagaagagttgcatgcagattgaagtttgcgtttgtcgaaaatcaattgcagaaaattgtgctacctggggttctgttcgttggctgtttttttcttctaattgtacacgtaaagtgttgtagggttgagattacgaacaagaggacatgaataactcttctaattataatcacattggtcaatcaaaacaaatataaaattaaactaattggtctagcaaaactaccagtctctgtctaagttaggcaactaaaatgcatagctagagagacctcacatacataattttagttagtaaggtcacacaaacctagagtgagacctcgaatggtgccactattcacactcatagaagacgtcggaccatactattcacaatgagtcaaacccttgatatagagtctgacgatcacatagaaaaggttctagagtgagaaacagggcatcagactagtccaacggtagatgtcacacaatacaagcatacccgatggtcagtaatgtctagtgatgacatattactgacacaatagccgttcaatagccgttgagatgtgttggacccttacatattggtctaatgatacacaatgaggca

SEQ ID NO: 4077 - DNA, 1095 bp, Zea mays
  misc_feature (1)..(100): optimal_loci_240293_G1, chr7:17245125..17246219, Cluster 25
actgacatggtttgctccgagcacaaggacttcttcaacagtattttttgaacggaaagcttattacatcctaaaattgctaaccttttgtttttgaaagaaaagcttatcctgttcgttgcatcttgccacatgttgagaaaaataactagtattcaaaataacaaatgggatttctcgaccttgctccatgcacgcccccccccaacttgtttgattttcaacaattacaatggccttttctttcccttgtttcgctgtcgctagttatgatgtcgcatcacttcacttctgcgagccacacacaaactggtgttggtgaagttgtttcgtgtgccgggacagtgatggatcacagaaaactttgaactttcttacactagtctggaccagaccgatggtgaactgatggtgctgctagctaggggcctgtcaatgctaagcatcatcaccagcatttaattacctgaccagtgattatagtgagtgaatcatgtgtggattgcattttttttttttgcttgcatgctaagccgagtagtttgtgtttccttgctattacacggcgttctagaatcatatcaaagaataaagaccttcgctggttcacatctggacctttcacttttttttatggatgaatctgtttgaacctttttactcttctctgtttttgttctgtcgctgccctgttgaaagaatataaaaaatctcacaaccttagtccttacacgtaaatggtaacttagaagtaactatattttctctattccttgatagatcaactcctagagtttcctcaagtcgaacttctttgtatctgacaaaaatctataaaaaaagagcacagatatataaaaaaacttattccaaaaatatattttattctgagtctaatagtactggtttgatgtcataaatctttgcttttttctatcaatttaatcaaacttattgtttttttaaaagaaaaataatttattcagatagagagagtatgtacaacaagggacggctattcacttgtctgcatctcatcagcaggacaacatttacgttttctttgctattacacaacatccttcttttctgaac

SEQ ID NO: 4078 - DNA, 1114 bp, Zea mays
  misc_feature (1)..(100): optimal_loci_240299_G1, chr7:17271936..17273049, Cluster 25
ggtttatttattacatgagttttgactagaagtttttagaggccttagtttgtaaaacaggttgtctaattcacctccctctctgatgtcgagtgtcccaagtagacctttcgggcatccttcaagatgacccaagggtaaaatagcattggaagttaaagctcctagggcaagacagccttgtgaaatataatctcagtgccatatgtgccctgtgtaggattatcattcggtaccaggcaatcaggataatactcatgtcaacatatttaatgtgatggactaccattgcgatcaatgatgagcactatagcaacgacaacaacatatgtatctacagtacgtgtcatcattcctatatccatacttaaatgttcttgtatatctacaaccatgtacaagcaactacaccgcttaccaactatgtaatatcagacaatgtgatctctaatacctgccactagtacaaccaatatttaccacttcaacatgattaactcaacaatgtaacacctccaaggtgtgtaacatgtacgactccatgcttcagacaagatagaaatacttaagcctctgtccagttgggcctgctatccgataggtatgtaactctctcatcacttgttctataaaaaggataggtagagcaacatagaaagggctctcgatttagaggttggctatatgtgatctagcgaccacttagtctagaattctcaccaagaccaaaaaggaaagggagatctggtcagtcatctagcttgatgaatatcttagcatgtaatcttctttgcctcaacactcaccaatcttctcacacaacgaggacatagagtattacacatatgtggcataaatctctattaaatttctcatttactggtagctaggcagaacctaggatgcagtgcgactccaatctatgtccctcatttgatcctttactcatcaagcttctcgtgtacctatgtgagctaaagaatgatgagatacaaactcatgttcatcgatgattgtatttttacgaggtatatagaagcgtgtatgcttcccctagtctttgttggagctcctttcaaggatgctctcgccatggccaagctcttgactaggt

SEQ ID NO: 4079 - DNA, 1166 bp, Zea mays
  misc_feature (1)..(100): optimal_loci_24242_G1, chr1:146744112..146745277, Cluster 25
ctcatccactctcaaaccctaagcatagctgatttgagcggcgatgatgcatgatgacggcctaacgatgactctgctcatgctccactgccacctgcaaggtctagaaggggtgatgcatatggaaatataagaccatgctattgaggttgagtttcttgggatgtgtgattggattagggattcaaatgatgttaacaaggttagagattcatgagaagaagttgtttattcatactggttcgattgaagattcattaaatcatagggattagattgaagtagttgtttattggtcagtttccatgattttacttttttgggatccatttagtttgatttatttgttgtgttcttccatagtttagtatggattgtttggatgttttgggtacactgcaagttaggtttcactacaatggggagttcatagcagggaaaaagctacattactatgagggtagtgaggcattttcttacattgtccgagacaaatttcattatctaaatttgttggacacttgaaggacaactacattgttggggaaggcacactaccgcactggttatttcctataaaggaggttagaaatggtttgtgagcagtagtggatcataaggcctgcatgggcataaaaatgcacaactgacatatatgtggaggttcaagtaggaatgtaaagtcagatgatgaggattcataaggtgaagagtgttactatgaggcatatggaggaagggatcaaggatggctctaaggaaggtagtgaggataactttgaggaacaaaatgatggattaaacattgataatgatgttgttgaagatgctgactttgtcttaggtactagccaattagacataagacggcgtagttaaaagttcataatgtaactaagactgtgaggaggttttgtagtcctagaaaagttcaagatgagtgtaatacaattgttgccaaaggtcttgcaactagtttaggtgctagttttgagtacaatggatttattcctagggatgatgagtcctcatgagaagatgatgagggaactaatcaaaaagtttaaatagtttaataataaaatgaaataggggagtctacatagttagatgatgtgattgttgagggtcgtaaaaatcaaatagttgattgaactattgtacat

SEQ ID NO: 4080 - DNA, 1020 bp, Zea mays
  misc_feature (1)..(100): optimal_loci_251856_G1, chr7:95517569..95518588, Cluster 25
tcaactcttcttggaaggttaattcaagtgagaagatagaaagtgttaaaatacattattaaaagcaacatgcaacttctaatagataaaatggattactcatctgaaagcatgtaatttcgttccttacaacacatcaaatgattaaaaatatacctttgtttatacaatcaaaggcacgaagatgaagaaaatacacaacttcgtagtcggagcgatttgattcaatctccttgactttgttccttttattagcttcggttcaatgacgaggatggacgtgacaaagctgatatatacaaaggtcgatcctctccccccaacataccggcaaatgctactatgattaatttggttggtccttgggctgcgttttgggtggttttggctcacaccagatgccctgcccctgcgatgaataataatgtaaaaccgaatcagagaaatgtttcgaaagcttatgacgatgctgtagctcgaagttcaccaacagcactgcaaacgttcaccaagtccaggattcgtgtctgcaagaggtgctatggttttatctatctgacgtgagaggggaagactataagtggagatagaaaggtgtcgtccagggattaacaaaaacaacgcggtttgtaagctagcatgggagcgtgtttttaaattactcacagacaatccatttcagttaacacacgccgagagcgatgacaatgttgtgagtaggctaggctagctatcagtgtattacgtctagccgctatcgccttttctcagctctcatcgggtggtgtttttatggccggtagaaaaaaaaaatagcagcaaatactacatcaaaccaaccattggtcgtcgttgtaagagagacaaagttcaactatcggttggtataaatgtgtcagcgtggatatgactgacttttgcggtcgataaacaatttgtactgatcgatggcggatcctcctccatcgctggagttgctgtaagatgtggtgtgtgtgtgtaggcgaggattgttcactg

SEQ ID NO: 4081 - DNA, 1109 bp, Zea mays
  misc_feature (1)..(100): optimal_loci_253521_G1, chr7:104869219..104870327, Cluster 25
aatttaccatccgatgacttgatctgaagtcatctcgcaaccttcgtctctttgcaagggagaacactgaagcaccgacaaaaaacaaatgtggttgaactcgcaaaaccatcacagaaacaagatgaatgctacaacaataacaattttgttgggggtcaaatgatgcacttgggccttgaagtggtaaaagatgtcacaagaaaactatagcaaaggaacattgaatccttacatgaagtagtcaacaaagataacaactttgttggtattgggagaggagacatcatcctccccttttacagatcttcacttagtgagttccttcagcatcaagaatcctttgtcaacaaggtactctgtatccttcttgttagagatcaacgaatagcattgtgggtatggatagaactctgctttcttgctacttctagtggtggtgatgacagcgattagtaggaactattttgaggcatctttctttggtataggcttcttctgacccctcaccgttagggatggaggaggaagataaatgggaggagaagtttgatagactggaaccggtaggtcaaagcgagtaagtggtgaatgactattgtgtggtggcaacgagaagatgaagggtcacaacctttagttgcttatataattagagcatcgatgatggtgggacttatgtgtcatatcttattggtctgttaaacaactcgtaaaatagggtaacccaaaacatgggtcgataggccgatccatccatcaattgactagaaagaccggatggttcaaaaactcggatcaatatcctatggacgtactatacattttcggtttttgaacttgtcgccctgtgccatttcggcccacaaacttttaaagagtgttaacctagtccttaatcgatggtcgggtcttagttaagtccaaacgatgatctcacatgtcagcatatgtatctcttttatctctcttttccggttctgtctcacgagacaagcaaaaaagataggaattagatacataagctgacatgtggggtcgatatgtgagctagacgtatactgtatgtcttaggctatcttcatcagtttacctatcctcatacttat

SEQ ID NO: 4082 - DNA, 1064 bp, Zea mays
  misc_feature (1)..(100): optimal_loci_254694_G1, chr7:111415271..111416334, Cluster 25
agcttcacatagatgtgcaaagatggctaaacgcgtcacgttttaaggatagtttggttgcactcaaatccaccctattccacaccacatgagttaggagtgggaggaattattatagagagaaaacttattcctacacgtgcctgccgtactcaacaacgcacaaactatgccttctatttctattttatgtgtagatttgagatgaaccaagaggatcctccactccggccgcagaggttgcctgcagacgtctccactgccgacaaaacaagaaattccagccactggttcccatcttcgtgcatgccccactatgaatgatccacacacgttgccaagtgaaaatatctttctatatatgcatgcactgccgagtgccgggcattttattatttgcaaatatatttaatatttcatcgaagtgccgtccagttttctatgacggcgaccgccatatcagtctaaaaatggatagtttcttgatctgaatcattaatttgtttgtcaaaaaattgacatttctttcatggcaagcatcacatctcctcgtgtggacgagttagttgtctcgccctcagacatttctgtatctgtatgtgtccggattatatatggtggtgactcaaataaataagaaaagaatttgtatgtaagtacctgcttttggtgcagtgtggtggagtcgggcgtgcaagattcacctgttacggttcaagatagatccttgtgaatgtgtgtgtatacgtattccatgccggaaatcgcgtccattccattatctaaaagatttaaataaatagtgtgcctttagttttcttttcctgttatttggggtttggattaggaatagagatagacatcatcagaaaaataattacatgaggtccgtttctttgccatgcaattttggattcacattgttccctctatttccttaattattaattgtgcattttttaagattcaaacttcatatttgtcgacccacaataatcaccttactctacgtgaattttgttagaaataagtgatattgatgggattggagtagggatggattt

SEQ ID NO: 4083 - DNA, 1254 bp, Zea mays
  misc_feature (1)..(100): optimal_loci_255556_G1, chr7:115700100..115701353, Cluster 25
caccctcctccagctagccgtcgttgaaggagggagcgctcgtgacggcgcacaagtctgagatgctgccgacctgccgtcgcctgtgccacatcttggtagcgtcgaaaccgccccagcatgcagcaggaggccatcgccccgtggtcgcattcgtgcccacgtctccatcctcgccgcactcctccatcgccgcccgcctccccgacgagcaagccgacgcagaacagagccgagcccagccgaagaaatcgagtagcgatctcactgagttacccaggagcgatgtgttctttggccgtaggatgcgcttccgtgccacacgtcttcaatccagagaggtgccttgtttcgttaatgtctctagatacgaagtctgattgatataattctaattaagttaattgtgtagttttatctatttaatttgataaagttttatgttgatcagagtcacggattttgaccatctcattttcaccgacgaaacaatgttctttctagaaacgtgatattaatttggttttgcaattatgaggtgttataactatttttgagcttccccaatcatttaccccctccttacgtctctcgatcctacattatcagtgcatttaacatggatttgcaataggtgattatgcaaagacatactacaacacataaatgagtgatggtaagacgccaaaaatattggcaattcaacagatatatttaggttatggtgacaattatatgctttggtagtattcattgccaattctaattctttatatttagtatacatatatttcaagtatttatatttaagctttatatgaataaccatagcacaaccctaaaacaatatatttagtctatgcgcagagtttatgtcataactatatttttttgataatcccattatatatagcaaactgaaatacaaagaccattcctatgacaaaagcaatatcatcaattcatcagtggcaccccctaaggagaatgatgacaaatatttctatgatgtcctacaagatataaaattagaaatggccaaaaatcattctaactatatccactctacattttgtattgtcttgaaaatagaaaagctccataccatatttcaagtagtactagaaacacattccaaatcttcaaatataacttttattcatactcttatacacatctagcatttaattgtcatgtgggagtatgaaataaaacatgatacgatacatatatcttctatagtaacatgataca

SEQ ID NO: 4084 - DNA, 1138 bp, Zea mays
  misc_feature (1)..(100): optimal_loci_255679_G1, chr7:116406027..116407164, Cluster 25
ttttggggtgaagagttcacggataggccatccaattttgggttaattccacctgatgacttctagggttgtcagacctaagggtttaggtttttcctttcctaacagctgatctgttgagtaaccctataaaatagttgatagatcatgcttcctctcgctaatcccccatagaaggattatttttctatgattttcataaacaatatggaattgatgtaaagagaaaacatgataaatgaattgaagtgtaaagtttaagaaaacatttgatttgtattaagaatggagtgaatcaacaaatttgattgtctccacaaattagatctctcgaaataaacaagaacaacttgaagataaatctaaaacctaagaataaagaaaagctaaactaaatttaaaaagaaattctaaactaagtaattggtatctataacatgtgacaaaggagcctatttatagatttcaggtggccgttgtccttaaccctaggttagctgacgttcccaagctttaagtttgattttacggaccaaaatacgccctggattgtgtataattctcgttcaaagtcgatgtcgtgacacaccaggacctgtgtcatgacttaggagtcaacgtactcctcttgggatatcttcaggggtatgtcgcgacacctaagacagtttcgtgatttctctattctgcttcatatgttacgacattgagtattccgtgttgtgacatagtgaccagtatcggtttagtatgctttctgatggtctcttgcacacttacaaaggttattagctcactcttaggcctcattttacctctaatgtcataaaagatttaatttgcacattttactaacttaatgaaaacttacgaaaacatgactaaaacctaatggaaatgcttgctttcatgctcctaaagtgtagaaattagtttaatctgttacactaaattacgacagatcaaactcctccacacttaagtcattgtttgtccttaagcaacacaaacaaaaacaagaaatagaaaagatgtcccttaagcaaatatcataacaatattgactttggagcacatgactaggtatttcatctccataaacaactttagcatgatgaataattgacttaccactttt

SEQ ID NO: 4085 - DNA, 1044 bp, Zea mays
  misc_feature (1)..(100): optimal_loci_260288_G1, chr7:141605159..141606202, Cluster 25
  modified_base (372)..(372): a, c, g, or t
  misc_feature (372)..(471): n is a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
tgtttctgggcattgctgctcttgtaatttttttcagtacattgagtacagctgtaggtactgactgctgcaaagacagggcctgggacaaatgcttgttatgattggctgaggagggcaagggtcctaggatggatgactggctttctttagtcaagctaggaaaccaccatttgacagataccatagttcttgtctattgctataatcttaattgctttggggagacctgagatgagaccataaagaatatgtaaatatgaacctctgagaataaggcaggaccatttctcagactttctcaaggacacactggaagacctgttcatgtaggtcatttgttctttgattggggtggggggtttgaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatctagagattcgtcgttatcgttatcgatgactccacagttgttctgtcctgcattaacaaaatacaggtacggttagagttaaaattgaaaacatctgattactgagaaacgacaacgacatctattttgaaacgaagctcgcatgctctggcttacctgctctttgaatacgataacttttttcctacggagcccagaaaaaaaatattaggagactgactaaaccgcttacaatagacaaatataatggtttaaattagacttatattaaaacatcaatgaataacgaaactagaaatacataataaaaatataggatcaaattttagagaagatttcacagggctttataggatctggaacggtagggtcatcccaccgctgtatccatcccttcctcttttttttcttctagaaaatatggagaaagactatgtactccctttgtcaaaaatgttgcccttcaagttttaaatctagataagtgcttgtagaaaatcaaaactaaagtctgacttttttagggcggagagagtatcaattttgttgcccttgttgttaaacata

SEQ ID NO: 4086 - DNA, 1242 bp, Zea mays
  misc_feature (1)..(100): optimal_loci_260978_G1, chr7:145287867..145289108, Cluster 25
actcggtcaagttggaaggtatgtagccgagccctctatttcattctaagtctttacgattccaatactttaatcttacctacaacttataaagtcaatggtgttaacttgagtagtcaacgctctacaagctaataaagacaaatatgaagacaaaattgtagatatagataaatcttcgattgtttgccaaagtactttagatcaaagcaaagctattgctaaatatttatctaaaagtttaggcttggcacagaaggccagagatctcgcccaagtcatagttgaaaaaagtcattgctacaaagaagagtaagttcacttgttacccatcacttctagattccaatgtaataagttctaactttgtcctatatatgatcaagaagaactcatggttgataaagccctcattaaatcattggtgacttggctctacaactttgaggctagaaaatgtttgagcgatttgtataaaattgaaagtctccttgaacaactctgtgactcgagtcgaaccaatatgatagaagcgagcaacctttcattagacattattttttcttagtatctaggtttagagctaaccaaattcaagaaggttttatggtagactattcaaatgataagattgaagatatactgaaagaagtcaagccagatgcatctaaagtagttaactaggtaaagactttttccttaatattcttcttgtgatatggttgagttgaacattgtaagaaattattcacacatttggtatctttgtaatatattgagaatccatgtatgaccttgatgatatccaagtcaagtattgttttggaatcaaatccatattaaacttaacttccaatcgagtacagtcctcatagatgaccgagacccatggactcggtactcctgaagctcatatagagttattactcatagatgaccaagtttcacaaacttggtactctgtagctcatatcatgatattttcatagatgaccaagtttcatctagaactcatatagagatattatcattgataaccgagccctagatttctctagaactcaatattcttggtgcccatatagggataatagagtgcatacaatttcgtccatggttcctcacattatgtcttttaacatagcttagaatcactatcacccttcctagagggggcttacacccacctcataaaactgtgtcaaagtaccttttagcatatgcaacgttgatacctatacc

SEQ ID NO: 4087 - DNA, 1308 bp, Zea mays
  misc_feature (1)..(100): optimal_loci_262950_G1, chr7:156485118..156486425, Cluster 25
tgccacggcccgacctgacagaggcgactcatttaatagcacggttcgtcacgattcaaaacagaccccatgctagattgctagtccagatcgaaaatcgtatcgtccatgagttgttttctgggctagtagtgtcaggttggcttgacacgattatttttttgtttttagattataagtaatgtttaaaaaatatatactttttttggttagaggaggcggacattgttccccgaacacagacgaccagggtttggttctcggtctggtggtgcgtacttgctttttttcctgcgtgtgcacgcggagggggaggaacgacgaaaacaaaaggttcgtgctttatagttgtagtaaattaatggaggaaattaatggaggcatggagcgtccactgtcctaatggacatgatttggcttagctttatccttcaggtggtggtttcggcacactacgttccactcataagcatatggatatgcattgatcctacctgcaacacgtatgcagaagagggtctgatgagctcgctagttcctctacacgtacctaggccaaagaaagtgtaaaagcctacatacaggggccttcgttcgtactagtagctaccctggcatgccatgaatctatgggattcagagagacagtgagcactgagcatggctggctatccagcactttgtaaagaaaaaggcgctttagatgaagctcgggtaatgatgccaagaggcaagatgcctataggcagcttctaattctaaccatgcatgcatagcttcggtactaaggcaaatggatcaggggctaatcttgacagtgacacgcccacagactaaaagcattattatttttttacaaaaaaaaatacaaaggccctgggctgggcgtgcattactccgatcttccagggagtaagctatatatattgaaaaggacgcgtgatattttctaggtttctaaactataagctagctaagctttagctatccatccgtcctactgtctacaatatgcgattgattgttataatatatatatcactatcaaaatgtctacggttttcatttataaatatacattataaaacataaaaaaacatgtatgttttattggctaaaaaaaaactcagccggtgagagaaagactgccctctggacgcgaccatgtttagatctcttcttaatttaatgttttgttgactagatgggtgtaaaagtgagtttggagccaacacctagagttcaaaatcctggtttgtgcataattttagtttttttaatccctaattgaaatatagcagcattcat

SEQ ID NO: 4088 - DNA, 1015 bp, Zea mays
  misc_feature (1)..(100): optimal_loci_263024_G1, chr7:156811923..156812937, Cluster 25
aatagctaattgttagctagatgctagttaagacattagttagtttattatcttaggattcttagctaatttttagcaactaactattaactccatgagatgaaattatcaaacaagccctaaggtgatcagtctggggcacgattgttaggtttggggttttcagtcacccaattatccagccatgctctataaataaagtcataaactatacacttgaaaaggacgtacaggaaagtccaaccctcctattttttaggaccagtccagcagtccttttccctttatttaaacctcatatgatgtcgttttgcttgttctttaccttcctcaagcaaaatgtcatgtgattccttataagtagtccagactccaaatggttaatatatatcatcatgtgaaataagtttcatatatgagtagtgataactgataccaccaaagatcaaagttgtgtgcgtgtcaagctttttgtttcagttctatcttatcattgttctcatatcagttgtggtattatttatcacaatctctccttactaatttttcaggttaacaaagtatgagcgattcggagtgtgcaggagcacctcaacttaaggtctctccaaagtcgaaacgctgtactgatctagttttgcgatgcaatgcgttgctgtgtcctttgactgtgtttggttttggacttgacaggggaagtacatggtctgttcgtctgctctctattggggaatggatgcctcttctcatggaacagtatgtgcttacaattgaagattactatgtctatctcttccccgtatgttcatcctctacaattacagaatatatgatttttattatttgtgctcagtttccagtgcacactgggtaactatatatgttctataccttatcgctgtcgcttacggtttagagcttttatatttctttatgtattttgaaccaatggcacacgaagctagagaaatccaatgacaatgtcgtgctattacaaacctgtgatgactgatac

SEQ ID NO: 4089 - DNA, 1030 bp, Zea mays
  misc_feature (1)..(100): optimal_loci_263516_G1, chr7:159151897..159152926, Cluster 25
gagcggttgagccttgcctagccacgggaacgggatgcggtccggccgacggccatcaccgtctagttaacggcttcagacagcgatccttttaataaacgtgatcaagatttcagatagtactccttttttccgttttatttaatttatctcgaaagaaatactccagctgttattctgcactggtggcgtgcttgctccactccggattctgacagagatactccctcgtccaacgtctcgctttttttttggaaaaaactcgaagttttaaaatttaactaaggacatgtttagatctcataagctaaagcaaaatgactaaattttaaccattttagaagctaaagattcgtacagaaagagctaaaattactaaaatagtaaaaatatgtcgttatagtcattttagctaacttttagtcattctaaagcaataactaaactttaatcactttcctttatctcatggatctaaacagaccatgagaacaattaacgtaagtagaccaattctagctattaacattgtttttctaaagttggttaatcaagatttttgacttattaaatattatgacacatgagtcagataatttgaactttaatcaaaactatataaaagaagcatttatgatacaaaattaaatcataaaatatatttctataatatatatgtgtgcgcgtattcacgcccgtgcacgtatgcgtgcgttttattactatcgaccataaacttggttaatcttaaacaactaaaactggcacgagttttaaaattatatattttttatggagtgagtagatattttgttatcttggacaaagggagacaatgaatgatggttggcacatattaggcgctgcgctgagttgcagtcgacctaccacaatcacaaccattctagagagaagacaagttcgttctccgcttaacctgccatgttagttttgtgaaatagggagaatgatcaatcttatggcaaatgtgtctcgcccttgcattacgacatgtaaagattgattatct

SEQ ID NO: 4090 - DNA, 1058 bp, Zea mays
  misc_feature (1)..(100): optimal_loci_265208_G1, chr7:168259790..168260847, Cluster 25
tatgggggcagatccactgtttcagtggatcaaatgagctattggatccaaaatcatttcttgaaaaaatcaaatccaaatctagttttagtgaatacagagttggcagagttctaccaaacaagcccttagagcttacttaggagtgtcccatgaacactaccgtggagcggtttcacaaaaaacccggagcttttagagtatctaaagctattagaatggttcaaaaacctaccttttttctagaaagagttggtgcagctatcccagtttggctaaccaagttggaagcaaagctaaacaacatagagcggagcatcagaaataggacctttagactcatttttggcagttggagaaaaatagggttgacacaacttggttctcaatataagagggctctccaaggtggccaccttatttctaggtttattattaggagccccactttaaaccctcatcttatagtttacatagttcttcccctggcctagtgtgtgtcgaattcctccccacccatctgtctgccttcactccttaccgccaccgccctcccactctttcacacagttcttcccctacaaacatgcctcatccccattggcctgtcccccacgatgtgtatcctacccttcacgtgattcttcccctccaaacatgcttcctccccattagctctttgaaatggcctatatgaatagagcagtgtgaataggataacaaattattctacaaactcacaaaccactaaagtttgattagtacaaaatagattataataactactttgcactaccactagttcaccctatgcaagtctctaaacaattatagtagcttaatctttagcctatgtttattaattaaggcaagttactagcaagagatatcaaacaaacacaactatcgctagttacaatcttcacaaagctagttgaggacataccatacaacatgtaaaaatgaatataattacaagagtaagtatattgagcaaaccacatggaacaagagattatataaggtatgtcctcgaggttcggttacttgctggcaac

SEQ ID NO: 4091 - DNA, 1270 bp, Zea mays
  misc_feature (1)..(100): optimal_loci_265549_G1, chr7:170125602..170126871, Cluster 25
ttaaaaagagccagacagtgaacgccagacttcagaacaccagatgtcttccgcacctagaatagacaattaaaaatgattagtaacagttcagccaaataaagaggaagaaagttttaaggtggtggacctcatcctccctcagccccctgaagtgttgaagtgacaaattggaagactgttgattttgttgctgttcaccacataatagaaatgtcagcatcaaagggttaattagatctcaagtataatatcacaatcaccaaaagatatccacgcatttgggaggtttataatacctgggggcgtggccagtgagcatgggttatgctccatattattgtcttcattccttgtatgaggtcagtatgaaatagcagtttaaacaataactgaaatgagatgctgaaagacaaggaacagagcaataatttacaacaactaatacataccgacagcaagagtctttatcagacttttgtaatcgttgatttccttagtatactccaaaggttgctgcaaattcagcacagtctgcaaagttcaccaaaaaaataaggccatcaaatcatcagtcataaacaacttcaatttgtatcagacttaacctatctcaggaaaaaatccatttattttataagtacaacgcgactaagccctctcacattttgttaacaagcaaagcttaaataaattatctatctgcccatgactaagagattagttatggttttcataaccggccaaggctattgatatttataagttgctgtgtctttttatcttgagaaatttgagctagacagctatatggccaaaaaaatcaaataaagcataaatttgtgattttctcaggaaagaggagtgcagtcagccaaaaaagaatggtattgctgcatgctacctccaagagacattcacatagcatacctgtaatgggacttcaagcttcattctcagattcggttgttccttcccttcctcaccttcttcaagcaactatagagtgagaggagtaaggtagaccatatcagcaagaaaacacaaggagataacactgatgtttctgtatagaatcacacgacatgttgcaatgtaacagtatattttctctatatgttttcaatccccatttctttcaaacattaattttttaaattatattctgcggtgtagcagcatctaacgcaagtgcccaagtttgcatgtcatcagctaataaattaggaacacgttttaaaacctaatcaaccgaaagtatcacaaaaca

SEQ ID NO: 4092 - DNA, 1300 bp, Zea mays
  misc_feature (1)..(100): optimal_loci_265834_G1, chr7:171715549..171716848, Cluster 25
tggtgtaacaaaaatgagtatgctataaatgatcgaacggtcgggctgttttgggctgctatgtgaagagctgctcctaatattcttgggccgtgcctcatctgctgcagccgccctagtccgggccgcgaatccgccccctgcttggaaatctacacgtgaccaaatataaatatggtcattgagcacagaatccaccggacgatggaatgatagcgtatacatgatgaaatataactctggtcattataaatccttttccttgatttcttctattaacagataaataataacatgtattcgaaactcgccatgcagagcgtcgtgcagcagtgcaatctttacacaccgccctattataaaagagagatgcgagtgtaatgaccgggtttatatttatacatgatgaaatataaatccggtcattataaaccctcttccttccttccgtctagcagataaacaatagtactactaacatgtacgtaatcatcatgcagagcgttgtgcatcagtgttatctttacacgccgcgaaatgccaagaagtggtcttttatgaataaaacacaaagtgtgcgagcggtgcaaacaggcccatgacttctgggcccccaaaatcccgatcagctactacgctatactaggttttttttatcaggtgcatgcaaacttctgcacatctaggcctatctagggaccaaggatcaactcacacccatcacccatggccggcgttaacttccataatgtatacaaaaggtcgttattaagcgcgtttctttcccgtgagtcaaacatccgtgaaaatagtgctgcaacgtaacgtatttaaaggcgatggtcatagttccatcagtctttggcagtgaggtgcaggcagagcagccgcggatcttggattgaatgataattacggttatcaaatatagtttaattataaaactagacaaagttattaaacctaattaaacatatatctaacatttataattgatattaaatatttaaagtgacaccaactaaactttagcagagaacaaataacccttcatcaaccaatgacactcctccatgtggcctcgtgccgtctacatggctcatatcactgcctggctcagtgcttgaagggagatccaacgtgtctatagatatatgtgagtgtatcctgtatacaatgaattttttttcctctccgaaagtctcgtctcgttaccctacgtgtacgacccagatcccagattcaataatcaaataatttgacggaccataaattttgagcgacgtggataggctaacat

SEQ ID NO: 4093 - DNA, 1193 bp, Zea mays
  misc_feature (1)..(100): optimal_loci_266070_G1, chr7:172807808..172809000, Cluster 25
agagcatataagtctataaatcgctataacattattaggtatatctggtgtagcaccaaataatgccacattggatatggttctcagagagtgcgtaaattgcgcacttagtactaacatgcatcgaatgtgatcagcgtgtgcaccaaatacccgataaagggtaacaactagtttatagccattgagattatagagatagcagcgaacatatctgatgcagaaactagcagtgcactagacatgtctgatgctctcgattttatcctatcaagaggtaaaggttagatttcaatatatagactacttggccagtcttggtccacatccttgcactcgatacacttttgagcacatcttaaagctaaagaaacacacttcacttacttgcatcgtatcgattatttagatgagatcgaagatcttctaatgcatcacatataattgttatatttgtggcactagttgagtgacttgggctggttgtactcttattactctttatgattattgttacctagatggctcgaagttcgtgggatcgtcgagcggctaataaagattgttgtcggcttcgatcatcgttgtgaggggctcctgtgcttatttcctatgcaagattggtgaagagcaaccctagtagattagtggcttgttggagagcctctctagtgtagttcttacgacatcctaattataagcttggcatgtgataccaattaatgtaggaaccacctagctcgaactcactgtaacgaggacgtaggttgtcgacaagcaacataaccttagagatatatcttatgccatttattgccgaatgtgctttccacactgtatttacttttgcagttacatttatctaatttttgtatgatatgctcagctagccttgtgtagactataactagttataattgtatttgattagtatcttttgctaagtaattagcttgcattgaccaatataaacaaaagaccaagctattaaatttatttagaggcttgtataggtgaactagtgctggtgcaaagtagttgctttaatactatttgtttactaatcaaactttgctctagtgacttgtgagtttgtaaaataatttttataggttactcaccatccctctagccatataggtcctatcatgatgacatacgtagtgggtagtgcagtactgcaaacatccacc

SEQ ID NO: 4094 - DNA, 1278 bp, Zea mays
  misc_feature (1)..(100): optimal_loci_266241_G1, chr7:173529276..173530553, Cluster 25
agaaaagaaaagaaaggaatgtccccaaataaagaaatatattagaggagaaagaagaaactaaagaacggttgacggccgacattacccatatttatcgatccatgacttgacgccggtaagctagtgactgccgtaaaaggctaggatacgctgctgtctatttcctgcaggttagacgataagcacgaactgagtgaccagtagcgacgatggtatgatgcgcagctgggaaagttgctggcatgtgcgtgaaaacctgcattaatattcaacaccacgtacgtacctactactctctccgtctagtgacaagtgcacatttagagtttaaattttgttgccaaaataaatacatctatatacatactacaagacaatttgattctagttcttgtttttctacccttctagacaaattattgtatttttttatagaaatataattgtaattccttactaatattgatctctttactaaaattctagaagtacacttattttgggcagatgcttatttaattaggaaatgagctaacacctacctacgcaacgtcgtcatctatcgccgtcatcggcagtctcggcactcgtcactgctgacaggtcaaggcacatgaacaaaaataattaagctctgatccatgaaacataaacaactagcccatcatctatttatctttagcttgccacaatatatatagctgaaaattagtaaaagtggtatagctaggtgctaatagtagctgcgaagaagaagaacgtactagctatatggcgtaaactattcattcatgcatatatgtgacgaataacattattattaagggtttaatatagattggagaagttttgtatatatccttgagaaggatgtctatggaaatccttagccgccaagtaaaggtacgtcgtacatgcatatacgccggccgccacgcaccatgcatgcatgcaaagtctaggaaatctatctatccaccagggcagcatcaggctaggttggtgatttggacacctcgatcgctcattcgctctagctccatctgatctgcctatatgggtctccttcgtcgttgtccacgtatgtttcgtcggaccatcggcaccgtacgtgttgcactgtgagagtctaggtaaaaagacgtatagctaagctagagaagagtagaaggaaacctcaaaggaaatgctcggtaaatgcacacgtgtgtacagtggcggggatacatatggtgtaagggaggctaagaaggaactgattatctttttttctct

SEQ ID NO: 4095 - DNA, 1184 bp, Zea mays
  misc_feature (1)..(100): optimal_loci_267002_G1, chr8:695694..696877, Cluster 25
ttttatgaccggtatatagtggaatattttcagtagcttttggacaatatttatgtctaccatttgtatataatggttgtcttagttattcttattgttctatttggaaatctgccccacgatgcatggttcagtacattttcttgttgttggtacaacaattgtattcgatgacacctcaaatactctatatgggattgtggtcgactatgaaaggatgagtccctactattgttgctgctacaacaatcatttgtgcataactcatgtagtttcactgtgattctggccgaccacaccagtttaaggacctgaacacaactttcattccatttggcaagaaatttcatatgaaaattgaatcattgtgaactagataaactttcacacaacatgcatactagaaaaacgggttattctgcattttattgtaacaacaactactcaaaaaacagttaaagattttgcacgaacacaatattgattcccgaacatattcaaactcaacaaatttttatttaactaggacgacaccacaaacaagacatggtaaaaacaaattggttgaactctgcaacatatcactcaaacccaaattcctttgccttagcttgaatatgcttcttcttcatagcaaagtaatcttgggaatcatcatctggtagggtgcacatgtccatcatcatgagcttgtttgtttccttgtctgccttcagattgagcaacttcttctagatttcaactttttctgccatcatagatttaaaagccctgccctctttttttggatgcctcagcctgagccatgtcgaagttcagtctatccattgacatcttctacaaaacttccaaacaagatgtggattgagaagaactaggtgtgttgtgctgcttctttgcattgtcccatcccattgggtgttcaggtagaggaggcatgttctccccatcctcattgttctccagacatggggatctggttttgttggggtagaaccttgctgccatcaaccaggatgtccacttgggcttgttttttagaataaaccaacaatgcatgaattggaaactatttcctattccaccatcataaaggctaatcacagtgcatttgtttgaataacacctacaaacaaaaacaagttttagaacaagtttgttcatagtgcatttgtttgaatgac

SEQ ID NO: 4096 - DNA, 1094 bp, Zea mays
  misc_feature (1)..(100): optimal_loci_267433_G1, chr8:3282549..3283642, Cluster 25
  modified_base (31)..(31): a, c, g, or t
  modified_base (32)..(32): a, c, g, or t
  modified_base (33)..(33): a, c, g, or t
  modified_base (34)..(34): a, c, g, or t
  modified_base (35)..(35): a, c, g, or t
  modified_base (36)..(36): a, c, g, or t
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(130): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
aaccaacgaatcaagctgaatcatcaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggttattccaaaacctaggtattcccagtctctgggtctcctcatccaccaccatccaggtaccatattgtatctccttctcccaaaatcatcgatgtttcattctagatgaagatgacccatcataccacaattcacatagaagtgagggatcttttcatattttacttgtagaaggacatcatccttcccctctagggagcataacaaagtgaacaagaggtatttaggcatctatattaactctagacatgtaaaaatatcctcctttagctggtatggctcccacctccacaaagaccacttcccaacattgttcactacctcatttcaatacaaatatgggatacaatgaacttgaacccaagccagcaccatgtgaggcatgatggtcaaaatcattttagctccattaaattcttctagcatgagtccacaaccttgaagatctacggaccattcttcatgcactttcaatcccccacacaaaatacctacaccatgaaaaggtttttctaataggacaaaaataaacctcacagacagggttccacactgatctcatggttgacataaatgatgcttcactaaagtattggactgtcaatagcttcgccactgctgtccacttgacctatggatagaattcccttatctccctagccaaaagacaccctcatgttcagggtcactaagttagagcgtgtgcagcaactcattgacatcaaagtatgcccctacgccctccctaaaatgcctaatcttaaatcaccaacctccatgcctgagtagtagtgctaaggtaacccctagatcaacccaaataagaagatggcatagaggggatgtggggggtcgacgctaaagacctccttcgatgcaagtcaccaacatagtcactcgaaccctaggtacgcacctaggttgcatgcatagatgccatcgctggtttgaatcatc

SEQ ID NO: 4097 - DNA, 1190 bp, Zea mays
  misc_feature (1)..(100): optimal_loci_267571_G1, chr8:4126292..4127481, Cluster 25
aatagtatcagtggcacaggtggaaatacactatcataactcatgatttttttgctccccctcgttatcccgaccacttttgtcacgattcttaatgtgtattcacttcactgtattttagatttatcgtatcgtttgcatgggcaccttactagtgtaaaacagagagggagtcgtatcgtgtcctctttgtttcttttataccaatacttgatgcctacaatggtcgtggtggagcttggctaggtttccagcgacgacgctcgtggttctaggggagggacacaagtaggctagcagagttcgcggtaacagggacaacttgtggcaatagaaaccaaagaagatgcagactgtggcggcttgcaggcagtgcagacacgagcaacaattcggtggcctggctaggttttcggccaacagtgggttaagatggctccatctaatgagtaagaatatttcccctctaatctagcttatttgacgagatatgattcattcactaaccaagaaatattatatattttttgatttgttggaactcggtaggattaatctcgatgtcacatatacagtgtacaatgtgcgttcggtttggttaatttatggctaaatctaatggtggtatttgtgttctcgtgccgctcaaatatgatgaatgggttgtggactaacaatgatgttcactaacgagtttgcgaaatgaatttgctgctagggtgaagtgtggcagaaaccaacttgtagaggtgtcggtatttgacaagagcattagtctggaaactagagtggaggatgatttcacattgggtgcatgttttgacggttgtcatgaaagaaaaatgttcttgtttgttgatgtggttgacaaatctgttgaagtagttactaactccggtcacacagtggttagtcacggtggtgtggaaagtacaacttttgcatgttccagtaatcaactagaaagtgcatctattgtgatagcttcaaatgttgatgtaccactggttgattgggatgctcttgagattactcttgttatagaagatgagattggttatctagttcctcttgttgatgaagacaatttttatggacacattagactttgagctgagtatgagagagtagaggaataaaatggtagactagcatatgaagttgtatgtgtaggtgcacttgatcttgaa

SEQ ID NO: 4098 - DNA, 1158 bp, Zea mays
  misc_feature (1)..(100): optimal_loci_269644_G1, chr8:14951402..14952559, Cluster 25
ttaacaatgtgggatgatgatcaaatcgacattaaaactctagtactcgatgcgatttacaatttcacggttaatatttttttacttaaaatcatttagaatataaaaacacggtataagatttagagttatgtagttaaaaaagagtaacatcagctgtaaaattacaagtgtcacgtagctcaaaatatgatattgatgttggaaataacataaacgttgaggtattaaatttgaatcctgaacacacacatattttccattttttttgtcactgtctagttcagaatcaacaatgatatgtaaggcaaacctactcactggcgaatcgccgcactgattactaatacgacgtggtagtgctgatacaaaatatagcacagccgatgaaaacaaaaatattaagcactactttgcctgtgcattaccagtcccacgcctgcatgtagaagtagaactgaaaaccagaaagaaaatctaattgcttattttgcctctctacaaaactcttgcattaggttcttgttccaaactgcgcacaccttttttttgttatgttatcattattgagtaatggtagaaatgctgtttggaacaggggcaaggtatatatcatataggagtatatgcatatatacacaccagggtttaccatcccattttcaaccggtttaccgcacccttctgaaaacagtttctcgtcgaaaaccgccaataatctcgagcgatttaaattttcaaatttgaatttctggatttcgctatttctcaccgaaaaccgctacatcctgaccagttttcgttcctttttcaccgagaaacgtaatttagttagaaaaaaataaaaaaaatgatagaatttgtttgtaaatagttaaaatcacggcggttttcggtagtttctcgccaagaaacacagagaaccgagcagatctcgctgcttttgcggcggtttatttttgacgtcgggtttggaacaaatcgaatttattttttagacaaaaaatgaattttgtaaaataatatatttctgacctcctgataacctttagttttttatataatttttccgatttttatgtttttttttaatttagcgctggatttcgatttcgctgtgtactgataacgggaaaaggtagcggttttcgagattta

SEQ ID NO: 4099 - DNA, 1235 bp, Zea mays
  misc_feature (1)..(100): optimal_loci_270161_G1, chr8:18206047..18207281, Cluster 25
gcttgcgagagtcaccgagtcctgcgatcgtggcctagtagcgcacgccgcacatgtaaggtgtctccactccaaagtatccctaagtatcccacaagtatttgtttttcaattaaatttaatttctttttattctaatatttgtcggatatttatccaagctttatcaggccgccgtagcggtatttgatatgacttccattacagatatgagctctttgggaagtatcgaggtatcataggttatacatcgacctaacattgggttgtgtaagtttttgtaacgaaaactgctggcactggatctacaccgaaatatcccattctcattaattgatgcatagcttttgacgacatcctagggacgttttttttccacaaattgccagtattatatgcttttatgttctcttacatgttgtattcaggatatatccttagagaggtatcttcagcccaagcaagcacaagcagtgttctgtgttgtcatttctcgtcagatggaaaattaattgctactggaggtcacgataagaaggtaaaaagacgtgttgttgtgcttgctaagctatttagtggtgataattatggaatttgttcaaaatcaccattagtgctgtagtactaatatgtaattgctaattaccttttgtatctcgcaatgcaggttttcctgtggaatgctgacactctgaaacaaaaatcaatgctagaggagcattctctgctcataactgatgtgcgcttcagcccaagcactcctcgcctcgccacatcttcatttgacaaaactgtgagggtttgggatgctgataacgtaagtgttattaccaatccaagttttcctgcccctttccccacgtgatcgtgctcttatgctaggtgacaccatgttgcattgcgaaaatgtcagttaacacacactaatactggtcattgcatttttttctttctagcttaggttctttcctctacagttcaggcttcacatacgtgataattttctctcgatgatcacattctctgtcatgtaatagcagttatggtatgttaatacctctgccaggaacattgcacttttccacaaaaaatgtgtctctgactatggtgtgaagccacaaagaaagctgttagcaacccctgttcatgattgtattctgtgaaggcccaatagcatctgttccttaatgtgaaatgtagtaaatcggtgatgtgcatcatgcatcatcaataag

SEQ ID NO: 4100 - DNA, 1208 bp, Zea mays
  misc_feature (1)..(100): optimal_loci_280754_G1, chr8:91606662..91607869, Cluster 25
cgggcttgttgcagaagctctcattgactgcttcaagctgtataacatcatctactccactcaattaggtcgtgtgcaagcagttgtaaatgtcattaaagagagtgatctttggttgctcgtggaccatcaatccttcaactgccaactgcttaggtgtatggtggtgagtagcacttgtggtggagttatatgtgttgtctatttgaccctagaagattgattcctttttatagttgccatcaatgggtataccgaatgtagtagccacataaagatctaaaaatatgaacttaaaaactatcatggacctaaaaattatgtggattttgaaaaaaaaagatatacgtacttatcatactttcaccctccatcttccaatcccttcaccattgaagttgaggagcaccgaagcgagttggtttgaagcagcatcattgccgctgcttggggacactatcatcttgtaggagggcaaaatggagggagagtaccatatgaaggaggagaaccatattggggaggaacaacaaatgggagagagaacaaaggatgagcaccatatcaagcaccatatgaagaaggagcaccatatggaggatgagcaccatacgatccatatggaggagcaatatgtggatatccatatgggtatgcaatagagtatggataaatgaatgatggaggaggagcatcagtggtaggtgcttcagtagtaggaggaacatcgatggtaggatcattgttgagagaaggaggaacatccatggaaggttgatagggatacaaaggcggaggatatgggtatgaaaacagatgttgtggagtgagagaacaatgatgggcataaacatcctccgaacgatggtgtacgagagaaatatcatcaaacaatacctccccactccaacaggggtgttaggaagttgtggagataggtcgtcgatcaagtcagtgaagctttgagagttcagacttcacctaggatccatattgaaatagagagtggaaggctatgaaataaaggaagacaaatgcaatggagagtgagaggtgtgaatgaacgcaaacaccccctctatttataagacggattctagttttttattgggggattaaactttttggacttgaaatggatcaaaacggtgtggaccaattagaaacatgccacatcactaaagccaatctgtatcgatcggtttggg

SEQ ID NO: 4101 - DNA, 1310 bp, Zea mays
  misc_feature (1)..(100): optimal_loci_282661_G1, chr8:102732253..102733562, Cluster 25
agatatccacctttgaagtttttggccccgatgggaccttgaggcttagtaacatttctcgatctagaattagatgcctaataaaaaaaggaaacattgcaaaatcaatagcaaatgatgcaaggtataactttattacaagtaatgaatcaaggttgtttcatttacattagtaggatcatcggttgtgttagttggttcaaccgttggatccctcccttctaggtttaggcaattcatgatgatctgtattatagagaacttatgtccaagaaaataggtgataaataggggaaaatatacttatagagaaccacttacaaaggaacaataaagcaaactatcagctaagctacaaaaaatggaacgaacacaagccactatataatagaagaaaaaagttctcatttcttatcttctaaagttccaatggaagctttgtaagaacatgatcttgttgtctaattgttgagtctcccaaagatgaaatcttggtcaaggttaaaggtggtggtgatgatttctctagttgtatccatagaacttagtgagattgatcacagtgcttccattacatgcaaccaatcatatatgtttttagtcaacaatggttattatgttcttgtttatgttcaatgatgatggtggtgttatgtgctatactcagagttcctttttaacataagatgcatctttatggtcatgatgcttcatacatgacaatcaccagaataaaccaaggtgaatatacttcatacatgaacaaaataatgaaccttgagctcatcggaacatacttcatacataaacaagataatgaaccttgagcgtacatgaacaagatatataacagtcatcatgaacaagaacaagaacacaaaaatggaccttgagcactagttgtcaaaggacatgtgcatgatgtgacaggtgagcactagttgttggggagcacttttggtcagagatggcgccaacagagggttgagtaatcattggtagtgagtgatgagcgatggactagtggaggtcggggacgtcgccgggacagagcttgaacgagaagatgaacatagtgaacatgagcaattggggagtggtgtctctgttagaagtctgtatttataagagaaaattgatttagtaccattatttaaaaaatggtactaaatgatcttttaataacttttgagtaaaataaccagtactaaatctatcattcagttcctacctagagggctttagtactggttatttaaaagaactggtactaaagccttttaggcaggaattcagaaggaagctttaat

SEQ ID NO: 4102 - DNA, 1230 bp, Zea mays
  misc_feature (1)..(100): optimal_loci_283454_G1, chr8:106768958..106770187, Cluster 25
ttcgagttgggaagtcttcttcagaaggacagattactcagtggtgatatttataatgtggaaggtaccattatgcatttcaaccgtccggatagagcacacaacttttagagaagtaatgtacaacagaaaatgttggatatttatgttgggtgtccctgttaccctcatgaatgacatgtgtatccatcaggtcgtggcttccttcagaaaatttctgtgttggcacaacaacccttagattagatcatacgttctggtcaaatgtatgtatatgtttgctaatgatgtgcctagaagtattcttctcacatagggagatgactccaccggattgggttgttcttggtccatacccgtctatatcctcaccccagaagaggactgaaggtaggaaacaatgatgtaataggtaatcaggaagacagtgttctcccaatggtaacccccaccctctccctgaggatgatgaagatgagatttttttacaagctgaatgtgatttcatggagaacatggtaaaccaaaatctaggacaatatagtgttgaacatggggcatgtgaatggctggcctctttggcctcagcaactccacatcccccatgctcgtcctgctcctctgaatcataagaatcaacatcagctgatgatgtaccctacatatagacaagaagaaggtgacaactctagctcctcatctagcaattctcttgcaagaagtggtcaaaacaggctaccatactagaaggctggagattcttctgagattggctctttccccttttctctggagctccattctccagaaatgtcggtttgggttgtgtcatttatatctgaagagctaaagaggcttcttagttagactctccctcatctgagtggtgcttcttggtgggccaatgcatgccccagctcacacaccattgcaaccactatgtctcggccttcgcttcttcaagatggcatgtgccaaagttcttaagtacatattcaaattcttggacaagaggctgaaatcacaactctggctagtgcttagtctgaatccactatctctgagacttatattcagctatctattccccctcaaagtttgtacatcttgatagttttggatggaaggagcatgagctgattaagtaaaagcaagttgtgaccaaagtttaccagagaaatgtggatagacagtctgagaaattcactaagaaaagaagtcggatgatga

SEQ ID NO: 4103 - DNA, 1383 bp, Zea mays
  misc_feature (1)..(100): optimal_loci_287878_G1, chr8:130736121..130737503, Cluster 25
gcgagaaaaaaattggcaagtgaggaaacttatgagctgggacgatgcaatcccggctgcagcagcaagcatgatcgagaacagctaccagatgcaagtgcagaattgcagatgtaccaccctttataataaaaataaattagtagccacaagttaacttaggtccctctcaatcggccaggtcctcctatttttccttctttggaacacatgagttttacatgaatcatgcaggaatttcattttaacatgaaagaagtaggaaacggaaaaaaatcccgcatttcaaaggaggccatagattttgttgagtggctgtcatttttttcaagcaccataaaactcatcaataagattaatagtagactttatggcagcaaaaaaaaaaaaactttcatcgcgtcgcgtctctccattctccatctacctcttctcgtcgacgccctcgccattgacgatcaggaacctccgtgatctctcgtctctcaccacaaatgcaggtgcagctgccctgtcctctccttctagttctagttctagttctagacgatgaagctcacctcgacctcggacggatcatcactagtgttttgaatactggagaaacgtagctttcctctcgaaagaccgaaaagggccatgcttttagttttagctactccttttttttttcgtttggcttctagggagtgctacctcacattcatgatcaccatcattacgttttggtgtcgctatgaagcctgaataaagtaatcttgctcttggacggcttcgttttgtcttgcggattccacagccacggtgcttttgcatttgcatctgcactcacgtagtcacgttgctattgttgacacaccgatgggtttgctgcataatttgccacaatttgttataacatgtgtttgatttaaagctacagttgtcgcaaaatttttctcttgctatgtaggttctactcatcaatgactggtaaaattgtgacaagattttcttagacgtgataaaccatggcgcaaccttagacaccttaagcaaatgtggcataaaattgtatggcaatttttagcaccatagttatagaaccaaacatcacttaaattctagtaccgtatattgccgtaagtactttgacattgcgcacgacgttttgcttcagcaaaccacttccttttcttgcacgatcttgctggatcgatcggaagcggcgttaaaacaataccattccgaatagcgcatattcccttcatctttttttatataaaaaacaaatcattttttagagttgtcttaagttaagttttttttaatttgactgaatttataggaaaaagtctactgcacgtctagatatacattattatcaaatatatagtaaaagtt

SEQ ID NO: 4104 - DNA, 1305 bp, Zea mays
  misc_feature (1)..(100): optimal_loci_287880_G1, chr8:130739004..130740308, Cluster 25
gtgcctgaccaaacagcagtatcatggcaggtgcaatgattttttttaagacaccaaaagctaaggctgtcaccagacgcgtctccatcaggcaggccttgcctattccagacgcagtcattagcctctttcaaggtgcttaacataatctaacactatagtaaagcctcgcttactataaataagagcgctgatctcattgccgttcagacatcatggttagtggtttgttagtagcccgcgatccatttgtcagcagtgcacgtccctaggctttcttggaacttcaagctaagcatcagtataaaactgctcttgtcaatggttgaatgatcaggactgtagtagagatttcaaagcgagagatctgtgtgctttagcttgccttgtttcaggttccatgctctcaaagaaagcgagaatcttccaagttccaaaaaaaaaaaaaaatcaggcggctttgctaatatatacacagaatgacaggactcatccacagcaactggcaagaaactaacctgttttttctccaagaattcaggaaccttatcttgttctgtctctcttttgttttttctttttggcctaggaggattggagccgtattactacgcgccagtgttgtcttatatttgtcggttgcagcaatgaaatgaggcatgagttataaacaagagaaagagagagatggaactttcagctgcactggtctccaaacaaattaaggcagaaaggtgaggttgatctgagatggtagattgttgaatgacatgactggctggttggttgccatgataagtctgcatttatactggatttttatcttgcaccgccgtggacggtgccggtggagtatgttcatctgatgcgggacctccattcgatcctgaaaaaatccatctttgatgatgctgtctggagatgcgaaggctcgttgtgatttgacctcttgaaaggaacgtgagaacgcgccgcaaatataggttttttttgcagccgagccgagagtacgtgttcatcgttgctggaaagtcgaaaaatgaagacaacggaggtctcaatttcgttttctttttctattttcctctttttaaactttaatttataaatagtgtcccgaaccctattttacgggatacagtattaaaaagttgtgggcgtgttgttatcaagatgagcaaaacatagggcgtggcgtcggttaggccctcgtcttgtagacttgacagacagtggatgtcactgtcttgaagatatgtctcgagagagagagagagagaaaaaaaaaaaggtagggcctgtgac

SEQ ID NO: 4105 - DNA, 1322 bp, Zea mays
  misc_feature (1)..(100): optimal_loci_289879_G1, chr8:142301707..142303028, Cluster 25
aagtttgatctatattttttgcgctaacatctaatttagataatctaggtgactatcaactttttaccctaagtttgactagttctccttattaaaaaatcatcattattattaagttttattgtgatatcgtttaacatttaaaaaatgaaaacatcaaagccatactctagtgacccaaaaatatctctgcatagtttttgaaaaccaccagatcaatcaaatgtgattaattcgatgctcatcaggctatacattgtaagtaaattttactgttggactccaatgatcagtttcaatttatgaatgttgggaagtcatcgaattgattcgatgacaataatagagaagcaccaaactatgtgttggcaagatgtttataggtaatctagtggacattggactaattggatgcctacacatactgcccattaaggagcacccaatgtctagctctcaaggggcaaagttataaatagaagttggtcatttggtggccaactctatttgcactctaagcactatgacatccttgtgagcaactaagaacacctcactcatctctgtcttatgctcattcaaattgagattatgagagatctattacatttgcattgggttgttgcatataatggcactagttgatcaataaatctacagtttttttgttattcttagtggtttccaccacctgtatgtcttgaagcagcttgtcattgaggaagattagtgactattcttcacatctaactagttgattattgtgagaggttttgatcccacctcctagagtgtaaagggatattctattggaaaacacttggctagttggagtggaccatttgattgattcttgaggcacccaaggtgtgggtatagctttccatgctagttagcactcgagtcatcacctggtgactcaccataacatggactaagttgtcggcaagcaaccaaaccacatggataaatcatatgttgtatctttcccttgctagattgatcaccactctcacttatatttacattcatatctttcttatgagtgttagctttttgcctagctggctagaatagcttagtagtagttatagtgatagctaccttgcttagtagttctctactatagttctttctaatagtagactgtttgttgttgggatttaaagtagaaaccaatctcttagaattgggtaggagcttgcattaggtgaattatatatattgcaaagtatttgctagtagggctttatattatactaaccaaccttagctctagtgatgtgtttttgtaggtaaatttttatagtatattgcacaca

SEQ ID NO: 4106 - DNA, 1355 bp, Zea mays
  misc_feature (1)..(100): optimal_loci_290360_G1, chr8:144717253..144718607, Cluster 25
attgttacagcaatcaatcgaaaaagcccatcacattttttagaatgttaaaaaatttagacatttgcacttgcatcttagtccagaaaaatgatatatagacgtttatgacaatataaaaagcaagcgtgaacataacattatggttactataagcataaatatttaaaatgggtcagcccataaaatactaacaacaatcctcgtcgtctttataaccttttctttttattattggttttcccttttgtgctctgttttggataatgaaaaaaaataatctcagagaacggatatatatgaatgaattgaatatacgagtagggcattgcgaccactaggccgcaaagcattgtggtgtgtagaaagctagacgaacatgatgttgacgcaaggtgatacagcaaagaagacctcgctaataaagttgaagtcatcggcaacgaggaagacgacatgtccacatcgtcattgcatgaaatagacaattggcaatggatcggattggagctgggcaatcagcactagaggagactaacgcttcctgttcggcaagcagttgcattgggctagagaagatgaggaagaacggcgttgctacagaggggagaggactagctccacctttctaacgaatttctgtgcaaaagtgtaacctatttccctcaaactgtttcccttctttaagcctatagttaaaattgctcctgagtagtcataatattttattaaaaatattttctctctttatacaaaggaatatcgtccgggatattcagtggaagtcggagtgagggggtccatgcatgccgtgtaagacagtcagaaactggtaaacaaactagttaaaactactcctattttatacagataaccaacacgatgtcacctttttgggctcatgatgccgacctataccttcttacttagaaaggctagcttgtgtaatgcatgcgaaatgcaggtgaacgtcacataacaagaccagcagcactaagctaggttttggagcatgcagcatggctgtggttcagaaccacccgacggacggcgacgcttcctttttctccggaacggcaaccctgggtgtaacctttcgtgttagggggaaagcatgacttggcatcgaaacggcaagtctgaagcctgggaaccatcagtgcgcttgctcccagtgcaaatccgaatcacttgtcctttgtggctgtagctagtggatggacctgccacagctatgagcacgcgaagcggacccgtttgatctcggcgccctgagctccaaacgcctagggaccgaactttccgcaagattactgtacacaagcgaggtgtctgccgaaaatctatctttacgt

SEQ ID NO: 4107 - DNA, 1197 bp, Zea mays
  misc_feature (1)..(100): optimal_loci_291057_G1, chr8:148250494..148251690, Cluster 25
taaaaaataccagtttcccaaaatttagtcatatattttctatatggtgtcaaataaagatacttttatataaaaattgcagatctcgacaaggaaaattttttatctttgagttttcaattgaagtcgttaagacatttacaaataatataaaatttcagcagcatattaatcatgtaacccttattgccttaggaaaaatatatctttttggatgtaatcaaatgaatatacatttatttgaaaagtatagatctagaacagatctacaactttttaggtttgattttttttatttgaaatggttaagatgctaaaaaataatgaaacattcagacttgaggatattttggactttccgcagtttggtaccattagagctaaatctaacgaaaagtggcatgtaggaaaaaagtaaagattagtggcatttgtgactgctcaactttttttttaatggctggtatgaaatcgcaacgttttatactggcacgcaaggaaaagcctctaaatccaaactgtaactacatggtgtcttacaccaatccatactaacattccaaaaaaaagaataacccaccctcaatccaatctgccatgcagaaaacaaaccaccccagattttaatgttaatctagcctgaaatgttcaataacccaccctaacccaacccaccatgtaaaccacctcagattttaacactgttttatactgaattgttcaatataagggcattaggcctacatatatacaatgatacaaaatagagaccatgtacctaaccccctattgttgactctttccttgggtgctacactagcggcgcaaccgtggctaaagagggagctaggaggttagctataacaaggagtcatccttattcctcgttagttagcaattagtttattctagttagttagtgaatcatctttatccctagttagcgataggcttatccataatagttagtagatgaacaaataaagctccaatgttataaaaggggctattgtgtgttcgtaggaggctaggagatcaccgaagaagtaaagcctcccaagtttggtgggattgcttcgatcaccctgtccaacatttaatttggccttagtgacagcaacaacaccacttccaacctagttccctattcactttgttttatccctcaatcttatctcctgctacattatcatctag

SEQ ID NO: 4108 - DNA, 1060 bp, Zea mays
  misc_feature (1)..(100): optimal_loci_291315_G1, chr8:149444995..149446054, Cluster 25
actccatggcggatattgtttcatctgataaaggcaattgcacaatactaagctctttacttagattatttcaatcaatataacatgagctattagaagagaaattgttagccaatttattataatggtcttttagttcaatagaatccaaggacctcaaggttgtggagctcatagacacccaactatacttttgaattattcgagttcttcaaatatacttttaataaactaattgcaatatcaaccataactaagaattaattaaaattaaaattaaaaaagccttctcaacttcgagattttctttctcataatcggttccattatattatttgtgtagtgggcctatcgatatctcatgagaaaacacaactggacaacatgattatttaggctcacccttattccttccaaagtatcaaaggggagaagggtggttaagaaaatatctgcaatcaattcaaaatgatggcaaagatactcatgtattgaaacatgtaaaattacagatgacgaagtaaactacatgctcacaataagctttgtccatttatattgacaatgaagtatttatgattactgtaaacaacaaaccatattcatgtaacgaatgagaaaagattcatttatttatacctttaggagctctctaggaagtagatactacatgcatagtgttacaaatggttgatccatgtaacggtaacactattcatctatttatagagttatctcataagaaaaaacaactggacaacatgattatttagtttcgcccttcttccttccaaaggtatcaaaggggagaagggtggttaagaatatctacaatcaattcaaaacgatggcaaagatacacatgtattgaaacatgtaaaataacagatgacaaagtaaactacatgctcacaataagctatcctttttatattgacaacaaagtctttatgattactgtagacaacaaaccatattcatgtaatgaatgagaaaagatttatttctttaaaccttttggagctctctacgaagtagatactataggtgtagtgttaca

SEQ ID NO: 4109 - DNA, 1375 bp, Zea mays
  misc_feature (1)..(100): optimal_loci_293228_G1, chr8:159244860..159246234, Cluster 25
gaactagtactaattatagttttagtatcggttttaactgttgtctgctttagtacccgttggtgtttccaaccggttctttgtaataactagtactaaaggctgccgcgcctataaatacggccttccacacattgtgaaacccaaatgtaacttcactttgttcatattcctggtatgtcgtcgtcttccctgctccaccagcaccatttttcgtacgtagggccgaatgacgagcatcgcagcacctctcctccatcgccacagccacgtgcagaaaaaaaaatctaaatctctgctggtgaaaccgcatgcacaatcccaagcatgcatgcgcgcagcatcgcctgtttcttaacgttcatctttccctggtcatggcgacctctttgttttctgatgatcggacctctcgaattccatatatatatatatatagcatcatactgtgtgtgtgtgtgttaccagcaaccttgtgaaagctacaaggaagacaagccaaattaaaataactgttgattttatgcacgatcgcgagtagctatatatatatatatatgcccgcgcgcatttttcccatcaagcaagtttaagtacccccaaaagctagactctttaagcttctagaaacctttagctttgacaaataattactactgtaataattaaggagtatggtgcctttcttatttggcgtgccactagcttctctctagattgcttttttttttcttcagatatgcttagttattaactatagtaaagatgcctcttaacctaaccatatgtaggcatgtagccataagtttacacaaaaagttgttgcatggcaagcctatcgagcggctgctagatcacactacgtactagctgactagcttaatttcatgtaatatcaacacctaataacttttgttgattgagcatggaccgtaccagtgaatctttgacagcaaacaccttatcgatctcagtgattaagagcatcaattatatgtctgctagatcacatcaattattgtgctaggcaaccacctgcaaaggtagtagcaactaacagcatgccatacatagagacaaacaaacaaaatctacgtacccgatcatgcgaagatctttttgatgaatatataggcataagcctatctagcttgttcattctgcgcgcccatagctacaagtgctacttaattacaatgccacagcatgcatgcaggtacgtggccggtttcccaattccaaagtcaaattcgtcagtgcacaacaagtgctgcgctgttgcgaccttttggctagagatttgttttgggtgcgtgctggctgctgggtgcaacagaaccgaattctctgaccgtgttttgcccggcaacatgtc

SEQ ID NO: 4110 - DNA, 1120 bp, Zea mays
  misc_feature (1)..(100): optimal_loci_298800_G1, chr9:8445996..8447115, Cluster 25
agctcatgaaggctagtcccttcactggaatctctcttgggatgatcctctgattaggtccatcaagctcctgatcaccttcgacacacatgtgaatacattgagtacatggaattcacaatggctaacctttgccttccctaaaacatcattcattggtaccccatgctttacatgttcatgccatgcgttcataaaggctacttggtcctcaaaatgttgggttcaaatggtgttaccttgatctcatgtgaatgattggaagcgtttgccattgttgaaaagctacatgttggtcacctgtcaaggctcctacaaggaaccataataggaaaacacaattaaatcgataataccttctccccttgtctgaaaaggcaaggggagaagggtgtcaataatacagataagtaagatacaaaaatagataaacaaaaatctattccctttttattagtagattacatgattgtaaagttaccttcggaacacatgaaagatgttcgaaggtgaatacacgaggagagcttcaaatgttgagcgcttcaaggagatgagagtacgtgagagtcaaaaagtgatccccgtgcatgggcattgttcacatagttataaaggcatgacactatacatcttagtgtaaaataacattattgtcttgattattatgtacatatgtacaaaatctacgaggggtattcttgtcttctcaatcataagaagtgtcgtgtatgtctctcctagatacctttgtcttcccaactctagggtttatccaaagcttcatcagagtgcttgttggtcactctttggctgaacgaaggcattataactgggttgaaatgccaaagatgtcatttccttctctgatctgtcgaagctttttggccgaaactcgttgcattatcctgaaatgagctcaaagtaataggattgatcagtttgaggaccttcagcaaaggctattctccaatacttcactccatgatgatggcaagactagagtcagtatccctagctggggccctgagatcgtaaccgcaatactagtggtgccctcattggcccttatgcccctcgacatctcttggagcagattgcactacccaaggcctaactt

SEQ ID NO: 4111 - DNA, 1301 bp, Zea mays
  misc_feature (1)..(100): optimal_loci_29984_G1, chr1:183816447..183817747, Cluster 25
cctcctttgcagttgccatacctgaggtctacaacaacaccaacagagcagagtagcaggactgctgcaggaaagcacagctcgactgctcgcacgcagaggaggggaggcacgccggctgtgcacaacagggcaactcgtctactcctccctccgtccatccctccccgcttgcctgctcgccccgcctcgtgatgcccttttgccgccacccccgctgccaaaaaggacgcgtgcggactgccggcctgccgctgcggcgctgcccactggccacccaagtgcgcaaattcgagcggaaacacgcagcctagtgtttttttttaaaaaataacattaaccgctatcgaaataaaattacatgcattatatttttagacaagacaagatcactccaccacgccacgtcatgtacacttgcgtgataaagactactacaacaacgtagatccttattaccccaggtcgtggtgcacgatgaggcatatcgtgtcgtgacaccaacactcacgttggctgcgtaggactaggcaaaaaaaaaaaaaaaaacgctacctattatccaagcccaatttacttttacccggattcgatttacctgaactcggatagtcggatacctagaattttagataaaggctgtgaacgggtattttcagaacatgattgtcattacctaaatcacacgacccaataaaacgaataacccgaaacacatatccagctcttttctcccttctatttgtctcctttcattctcttgtcacatgagctcacctaggtggctttttttcactgttctccttttgtccttttttgtcttatcctctatctgaattggttttggtcgtagttgtcaacagtgtcatgtgtgatgtatgactctttcgtcccatgaagatttcatgatgatttgaagatttattagttttgtggtttggactaggcttgtgaaagattctgtgagcgctattgtttagagtgttgttttgaagattttataccactcggatttagatagatctaaagttgtatactgttctagtgtttccactatttgattgctctagggtttgtgatgctcaagagtatccatggttgtacgtaagaatgtcttcatttgctgtaactatagtttctttgggcgtactctttgaggatggtatacgtagttattgtgatatactatgtacagtgctttgcacaatttgagtaatgaccttatgagagatacatttaatatacgtgcgctatagggttggtggagttctttcaagttgtttgtaactatctctatcgat

SEQ ID NO: 4112 - DNA, 1103 bp, Zea mays
  misc_feature (1)..(100): optimal_loci_300333_G1, chr9:15359557..15360659, Cluster 25
tttaacggatgtagtacatgctaataatggaaggatgagcaggtccttattcactacaacggaggacgaataaagatgtttatattcgtttgttccccgacacccattcctaaaacaaaccatatactatgttttttttttcaattctctggcttctatctgcacccattattttatatccaagtgttttcttcctttttctgaccagttctgcaatcctccgctccaaattaggctcttgcattctttaatttgtcccgtagtatacaattaacaagaaacttacgatttaacaacttgaaaggcaaaggggagcggccctgctaaattatccgatgaattacatgtgtaatatgacatctatacacaatgcagctcccctaaacagaaaacgaacataaattaatattttatggcatgcagcaaatggcatatttttacatatttacgaaaatggcttaatatattcaattcccttggcagtatgagatcttgagtaaactaatcagttcatgcactaccaagcaacactgacatgagaaaaaaatgcggaccatcaatataataatgcccttgcatagttgcacacagaataacaagtgaaggaacccatgcatgcatgcactccgtagctaggtagcataaagatcttgtggaacattttgaagcattattgtcctagacgaattaatttgtgaagttaatagcttgtgatttcaatgcgttctagctctctctatccgcgtctttgagcgggtcttctgattctcgttaattagagagtaacttgttctatggtcactttaagcgacaatactcatttacaagataattgtaattttcttccaggtgatttacgataatatatcatgctaaaatttgaggtggttttttccctggaaaactgttgggttggcaacccgtagaattgaaactttgattcgagcctattttcactctccattttttggcctaccaccaattcttactgtaacaccatagaacgttatcgaatctttcgtctcctagatcatgagcagcagcgggcatgccagcaagctccacacgctggtcggcccacatgcagcagccaacccacatgt

SEQ ID NO: 4113 - DNA, 1198 bp, Zea mays
  misc_feature (1)..(100): optimal_loci_301180_G1, chr9:20328932..20330129, Cluster 25
tatgataatcgtgatgcacaccgtaccatgcagatgtcgaggcaactagctaggatgcacgtgagtcatgacgacagagctgagagcaggttaattagtgatatttaatttggtgaggaacaatgttattattagctacagcagtagcacacaatgctatatatcaaattaatttggcgacgaggaatgtttagctacatccacgggcatcaaccgtacatactactagtagatatatatatagcaaaggtacacgtacgtacgtgtgcgtacatatgcctgtcaccttcgacggaggacgtttttttgttacacaatatctagctaggaacaaccccaaaattgagaagctaggcatatatatatgcaagctgcagtctaactagaacatgcatgcatgacgaccgatcgacggtacaatgcacaagagatgaatttgagcaagcaaagcaatgcaacacaacgcgcacacatcatggagaatataatgcatgcatgcctaccggcggtctataaaattaattaccatcaattttgcggttctaatcgggtgctccacgcactactagctactactcttgtacccatttcgatcgagggcgcatttgctctggccgacagttccatgttgccaaattggcctctaatatcacatccctcactcaccatgatttttagggcatatataggcactatatatacctatgcatttcacatgaccatccactagctaatatattaattggtgaccgtccttgttcccttacgtgttcaagatgttcctcaacatttgcaggaaaatgtaggcacgtaggacaccgtacctttggagggacgacggcattgcaatttgcatgtgtaggctacctattgactccaagctaggatgggtaattgggagttccactccagagagagagagaggggggtgagtgatagatagatagatggatggatgtgccttgtcattgcagtgttagcagttggtatcatgggtggctcttggtgctcatgccacaaccgacggttcagaaggcagtagctcaatatatatagatgtctctaaaaaatgtgaaagtactgtcacacaagtagcagcatttgcacagagagcaaagtaattagcagataattacgactctccgccggtgtggcgagggatgttcagcttgcttaagttatcactagctagtcagat

SEQ ID NO: 4114 - DNA, 1055 bp, Zea mays
  misc_feature (1)..(100): optimal_loci_301187_G1, chr9:20342888..20343942, Cluster 25
tttttgttaaagtattgacgcatgacgacattgaaaaccggtgctttatagtagtagaggcttattagtagttgaacacagtcgcctcttttcccacgacagtaaaccgaaagtaattctgactctcacatgataaaaggtaaaatgttccataaaaatcatatttaaccgctatatgtgaatagtataactgcaaattccgagtcaagccgccaagtagataaagtagtgataaatcctacagtaaaatagatcctaatgaaaatccatcaattcctaatctcagtgaaaataaaaaacatatatccatttaaaatcctcctttaattgtgactttgttttgtgacaatgcaaataagttctaaatttaacatatacttatgttcaccacacgttccaatttcaagtggatgatgcaaaactacttgtacaataagtagagctagatttggtgttaaaagtacataccaaatttatgtttcatccttaaattaaggtcaactgttgacacttggaagtttggtatgtctcaatctaagtctaacaaactaagaccttgtatggatgcatatgcatctatctaaacccatgtgttagggcaaattggtgtgtaagttagtttaaatttcacatcaacacacccaacacatatggattgagttttgatattaaggatccaaataaaccctaaggtgaaaaggaatatgggccttgtccatttattcacctcttctatggttgtatagaaactctagtccctattgtatcaactttcaatggtatagaaattggtttcaaaaaatccatagaaaaaggaagtgatgcaatgatattttgcacctttgaatcgagacaatactgttctataccattttctggtaacctccaatgaagatgtgttgttgcaatacataagatatgttgttgggatagtcgacagtcttaacactcgtggactagataatattgggtgtcatcgtggtaggacatcgaggtatagaaggtacccaaaagatgaaaggtgtaacaaatagagcgggacatagactgattgt

SEQ ID NO: 4115 - DNA, 1384 bp, Zea mays
  misc_feature (1)..(100): optimal_loci_301784_G1, chr9:23517262..23518645, Cluster 25
aaaatcgtctctatttgtattttataacgattatttgctagaatcgatactaaagtcgtctctatttttagcgcgaggattttgaatatcggtatgtatcttcaaccaatactaaaaagtttaatttttgtatcgatgcagtactaaagattttatattagtatgggttgaaaatatgagtcgatattaatgttgatggacataagctctgttctctggcaatgggcgtggccgcgttcaataagatcggcggccacctgttctacactgcgaccgctctgaacccaggtgtgctcggctgagctgacacgtaaataaacagcgttcaaggtgaagatcggttggtccgttggtgggctagcaagacaggcaggcctttgcagctgcaagcgcgcgcgggctcgaccagctgaacatatgctgtgattgcagcgggcagcccgcccatagtcatatgacaaatgccgtgggctgtgagtgattgcagctcgaatgctcgatcaggggacaacgagcctgccgttatgcgaaagaaagaactaattgagtcggcacattttttttttgctaaaatcattctgggggacgaacgctagctttctattaaaagagacggttatgatgtcgtatctgtcttcgttaattaaccttattaatagtacggatccgtctccattattgaatattggttatcagaaaactacaaacctaacactccaacactagtttatctctaccactgcaccacgcaatcatccatgtttatatataattatatgttacattttatatcaataatgcatggtcttatattgggtattttagctactagaaaattataactacagatttttaaatcttgtaagtactatagctttgataaagggtgtatctccatccaagattgtttgaaaaaaaaagatccaataatatatgtgaattaaaacgcatatataagactccaaacgactttaaataaaaaaaaaactagtaatcagtaagcatgtagctcatatcggtcactatagcacttgattggttgtctttttggccgagaggtcgcatcatagaattatccgctttttggccagactcaccatgtgaaacatgcttttgtttggtctatatctgagttcagctagcagcctgttagatttgattaaagttagctgttcggattgttgtaactttaatccatagacaaaatactatataaatagtagaagctgataaagttcaactttttatacggataccaactgatattcaagttccttgtgccaaaaaatagagactactttagtactgattctagcaaagaatcgttaaaaaaatactaattttcatttcccgtctacaagttttttagggtttctatcaacaa

SEQ ID NO: 4116 - DNA, 1228 bp, Zea mays
  misc_feature (1)..(100): optimal_loci_303042_G1, chr9:32314885..32316112, Cluster 25
tacctcttgttgctctagtagttgtcggggcgccgtcaggctatgctatgcaaaaaaaaaaaaaaaaaagagttgctgctcacgctaacggattggtggtggtacctttgcttaggatgcaatgcaaatcttaaggtgacttcagaacctacgctctgagtgcttcttaattgtactattaattagtataatttcgctccacaagatttgcgctagcttctttctgattactactaatatattttttctttggagaatatcatttcgctgttataaattctttgtgaaaggccatcagacgacgtacgcaatcaacaatttggaccatatatatgcgttcgctttttataattgcataatatatactctaaaaaaacagttgagtcacgaaaagattgcgaagctggaaacctcgatctgtaaaactttatgctaaaaattttggcgcatgacaccgactcccaatccgaaaaagttagtagtactgctacgtggtcatcgaatttgagcttccaaactacagacgtacggcacttaaacaggccaacgccattatctgatgcctgcgccaccaactacatgcctgcccataaccgaagcgtagcccaggcgcaggctgacacgaacgcagcggtgataaggacagtcacgaggaaccagccaaagcataacaacaactctcaaaaatctagccaaatttaattttatttcccaagggaaccttcgcttcttcgaaatatacaagtcaacaaagatgatggaagcagccgcaatcattaattacctactctatgcaagtgggatcacacatttttggtccattaaagtttgcttgagattttattttttccacaaatagggacctttcagatgttaacctcagtaataaagaactgtatcaattctctctggatacaaataaatacgcagggttgagaacggagaaagatccatgctccttgtagtctaaatttctatctctacagtatcgcgtaatattgaatatgtgtttcaaagacaatcatgattcataagaacattaataagtttctagggtaagaaccataacagaaatctatatttataaagggaccgacatactagataagatcatctgagcagtcgtcgtccgcctctctctctagggttatgagcactcaagatgcggccgttgtttttctcgttgtgcgctcaatgctagcacaccggcgtcgtgatgtttcgttcc

SEQ ID NO: 4117 - DNA, 1359 bp, Zea mays
  misc_feature (1)..(100): optimal_loci_30584_G1, chr1:188108410..188109768, Cluster 25
ttaacctaggcaaaagagactagcataaacttcacatcatgatgtttaggctggcgtgacaggagtacttcctacttactcactttcgatccctttttgctttctaagaaattaaatatacttaggtttaactaactatagatatagacaacagcgacatcagaagcgaacgtaaggaagtagttcaaaatttcagtacaggcgtagaaaatcttgcgggccagcatcggtagatgggccggtttgcgggaatacgtaaatttccaacaggcaccgcacaacacagcgaaggggcgacctgtggcaggcacagtccaaacacgcgcgctgctgcctgcattcttcttccatcttgctgggccagatccaggtatagcccaactgtctacaagtcttttccagcccagatcatacaaagacaaagacaaacaccgtgagttggaagccgaattcgtggaaagtgcaatgttccttttggatgatacgtgtataatatctccctcccctccgtgccaaagtagtcgtcgatctctactatttttttcttcaaggaatcaactattcttaactttagttataaacaatattagtatttgtgttacatacttgatattattaggttgaactgcaaatctgtttatttataataagtttatttggaaacataaatgttgctaatattttacgcatacgccaactattttatatgggagcaagtagggggaaaaaatctcaacttgacgcacagaaggcacgtacgcgtactcagctcataagcaacacgctctctctaaagtctgaataatatatagcatgcatgaatatgcatgatgactatcaattctaaacctgataaaagcactctattacatcttaattggtggaataaaatgccctaaataatcatatatacttttgtccttggacaattattgtattttgtttttctccttctttgtttgaacgcttgaccactcacatcgtctccggcgggcgaggcaacgacgtgcaagagagacgcacgcagaggatcgatcatatcgatccggatccacgacagacaaaaaaaagaagttaccgcgcgtatacgtacgtcctgccttgccgttgtcaaataggagtactactatactacgcaggcaggacagtacgtagggacacggcgacgaacaacgacaaccgcacgtcctagctaccttcccaggcagccagcagcagctccatcttcttctctggctgatgcgagctagctaaagcaaacgaagccggccggcgctaccgcagctagccgttgtcgtagatgcgatgcgagaaagaaacgtctttttgacgagctggtagtcgtcgtcagctgccggg

SEQ ID NO: 4118 - DNA, 1236 bp, Zea mays
  misc_feature (1)..(100): optimal_loci_309774_G1, chr9:75762917..75764152, Cluster 25
taaagcggcgactgcagaagcgcaacagggatgtggggaaagtgagagagggggccgggagaaggttttcatttttttatatcattagcctaacagttttatatacgggtccgatagttttctataattctaacgtgctaaatggggttaaatttgaacatgtgatatatcatattacttaagagacaatgtagtttttatcattttttccaaatcctatattttataattttttttgaattttggacgaaattttaaaaattacacgttgagaaaccgaatccggtggccggcggtttgggtaaaccgcccgataacatctaaaacggatcggtttttttaaaccttgcttccatcggaatgttgagtgaaatctccgtccaattggactccctcgagcccccaacaaatagatagacatgatcctgaacaaaagctggcagcattaacgacacctaatcatgatcagagccttggagtatctctagctatcatgcgctggctgcgcgcgcaagtacgaactaaccggcatattcatatgattgtttccgcccaccttcttcccgtccgtcagatggtcgagctactattctcatatatacacgcgcatctcacactggcttgacataggtttattttaacttgttgccattatcccaacactgtgatatatatgcatggtcagatctcgatcggatgctttctttactgtacgaaagctcatatccatagattaagacactctccgtttgacctaggtagactgcaagtcagcgtcgatgcgctagacagacagccacgtttttttctgcaattcagtgtagtagcatttgatgccattaaacgctggtatttatgcgtcgccgccctgattggctcgctgttagccgtcgctagctcgcgactgtgatgatggggatatattcctgtcgtgctatcaaaactccgtacgacgacgacgacctcggcaaactaataactggtttcctgcaggcttgcatcaatggatcgatttgtcctgatagaaatgggcgccccgatggtaatggtcacccgattgtgatgattccgttattttcacttgtaatttttggatatcagtttgtatctactatgcttaaaccaccagtttcaacggttgtcctatctctcgtgtcatctatttacaaaaaaaagtccttacatttctttcaaaacaactcagcgtaaaatattaaaaaaactgtgtagcaggtg

SEQ ID NO: 4119 - DNA, 1327 bp, Zea mays
  misc_feature (1)..(100): optimal_loci_311592_G1, chr9:87447256..87448582, Cluster 25
gaaaacgtagtttaattggtcaactagtgccactagaatgtaagaacttagtgcacagacactagattggatgaagcacaaggaaaaaagatgagtggtaggtgttttggatgttctagagggtgtttgttcacttatgcaaagcgaggtggccaagacatggccaacttatagtttataagaccatgagagctagccattagaataaccgactgatattttttataccgtcggatgcttcgatgacatttaaaacccctgccattaaatcatatgctatgttatagtggcactgtagcatatactccaatgcaccccatcacattactctgatcctcatgtgaactctctagctagaaactagacatagaccttgccaatgaccagtggagcgtgtgttctaatgacactatttgtaacatgctagcttttgtgtgataaaagaatacaaacattttttcttgcagtgtgtgttgtggtagttgttaggccaaacataagcaaacttttctgttttggttccaatattgaattcacaacttcaaaattgtattcaacacctttggtgtatgatgttggcctagtaaacaccataaaaaggtatttccaacacaaaatgttttttataaactatattggattgaattcaaattcacacttgaattccacatgcaaccttctcaaaccattttccaattattcctaaaagataaaacactaacttgctaaccttcccttcaaacaatgttcatagaattaactatccatttcataagaatgtgtgagcatattagtttttacttggttttcatttaaagtttgtcattctttaattccctaagattaatagaaaaacatcattcctatgcctaatcaagccttggacctaaacttctaagttctaacaagcccgcccctctcctccctttttttactttcttctcctgctcacctacctatctcgacctcatactccatttagacccatatcgcctaattagcaatcgtaccagcccaacccacttgcttacttccatagcggcactctcgagtagacctcctttcaataggcactgcatgcctctccctctagcttaaaggcccagatcatgttcccctttggtccagcctaatcagtcgcttaccctcctctctaacggcacatcagggcctagcggtcgtgtcctcccaaaaccctagtgcggaccccacctggcctaggctagaatagaatcctcatgattcatatgtgtgtatatggcaaattggcgttcgctctcactccttaagtcttgttcgctttcgatgtccgcctcgtgccccacct

SEQ ID NO: 4120 - DNA, 1073 bp, Zea mays
  misc_feature (1)..(100): optimal_loci_311776_G1, chr9:88594879..88595951, Cluster 25
gtgaaccaaacgacacctggtttgattgtgttgagattaatgttgtatttagatacatttggttaatcactagttggggaaaaatagtgtaaagtagttatagttggctaacactagttaaagaattggttagaaaattagctcttccatttataggcactaaagctaatttttagcaagccagcagtgagtccatatatcaaaacatgccctaattttgactagttgtcgtagatgtgattattcttgaacgatgaacaatttggtcgatcacaacatttgctccaaaagaacacttaccaactattatatcatttgttgcaagaattatttgctccataaataaaaaatcaatgtattgcgtacacgtaattagaaggatgatatagatttatattggttcaggtatgtgagagtagatttcttgtcttatatgttcgatcaatttacaagtggcttgtggctactgatgtctactagttggctaaggtttctatgagcgagtattgaatctaatgagatatcttgaaatactatttggggttgatgtaaaatatagcatggttatatgaaaaaaatgtagcattataagcagcgttttttttaaaaaaaaaaacagcgttaccctaactctctatcatcgaatcactattgttgcgattgaccgtttgcctaggtatagtacgtacacattcacgaaagattcaccaacgcgctctggttgctgcaatatatagcaagtcaagtgcttgctgcgtcgagcgtcgttctctcgatccaaaccaaacccaccgggatacccaggttcacgcagccgcagtgaaaacccgcatgaaacttcgtgccggcgacgccgatcgagccaccaccagccatgccggcatgccgcgcgcgggatggcactgccggagtgggagaagcgaggcgccgctgctcctctttccctgggcaggaggcaggaggagccacgagtgcgcagtactactagtaccaacctgcactgaggggggtggcgaggtggtcagtgacgtgtgctgcaaagcccaagcctcccacggcgtgcccacgagatg

SEQ ID NO: 4121 - DNA, 1124 bp, Zea mays
  misc_feature (1)..(100): optimal_loci_311834_G1, chr9:88941251..88942374, Cluster 25
atggttttataaaccgtgctcgacccttgtccaatcttaggcagttgcctacaagcagggcaagcaatagaattacccagctttggtcttcctacagtcttcgtggcgtcatctcatctatcgcagatgcctccaagtacacccatgtatccatccattgaggtcacatgagtgtcattagcttgcacaggtgctctaacaagcatttgtgggaagcgtccactctcgaagaccttggaaaaacttggagagtcttttaaatcattgcattacttaccacaattacatttgtgtaatttaatttcttagaattgccataattacactggattggaatgagggtgcaatttttttgtatatatgttaggcactcaagtaaagttagggttgtaattagaatttaattatagcaagcaaatttagagaacctcaatttacctcctcttagcaccgatgctttcagccactacaaaaacatcttcatcactaccacccacatccactcaggagtgataaaactttaatctatgttgaaaatatataaactaatagagatagcagcattctaatagaaaggaagaatagcaagtattcaaaagaaaaagattattttatgcttgctacaaactctggtgctactaaaattggtgatgatatgctaattttgttcaccactcatgatacatcagagcaacatttttaggtactaaatttgaattacgtttgtcagaaaataatcgttttggcattgcttgtggtaaagaaatgttgactgatagtgttttcatcatacatgtgccataaacgatgaataataacgatgctttcattttagaacgaaataaacttttgctttgaaaagatgtgaaaagttattgtcttctttaaatactttaagttatatttatattaatattctatatgctctaactagtttggaataaaaatttccatgtactgaattgtcatggttgtttagtcatacatataattactggtaaactataattgtaaaaaagaatatatggtaaatagatattatattttttcaaatataaaatcttcttttatatataaaatcttcttttatagtataatagtatgatcaattagaggaatacaat

SEQ ID NO: 4122 - DNA, 1164 bp, Zea mays
  misc_feature (1)..(100): optimal_loci_313911_G1, chr9:100663294..100664457, Cluster 25
ccttcttaccaagacactaagtttgtatttggtctgcagaccacatgaatctatctgtgggttttacgatgggatatagtctcaaactcctattcagttttaaagtatgggacagtcgaagttaattcttgttttgttaaaattgatatgccaacatgagatagatatcagttttctacacattaaaaacaccgttagtgtatggaggctcattgaccaatgaaaaaaactgatgttcaatcaaacttcctatataatcatcatgcaattaaactaccaaaagtcataaaaaaatcttaacttccttgtttactttatcgatatctaattcattctatgttaggagatatgaaaaagagaaatctctattattttttaatgattcatattggatataattttctattatttatatctcttgacatagggtggattagaacttaaaatttgatatattgataaaataaataataaactacatttatctcttgtttaaaaagacttttgattgtttgactgtacaatgatcgcacaagaagcttgattccacatccgtttttgccttggctaatagcgattactgggtagaaaacaattatccgtcccatataggccaatccttctaaccaagtaagagttgagatggtcccatcctaaaaatattggatagattcatttgatcacatatattctactaaccaaacacatactaagggaaactaaatacacatgaggatccatagttgcacactcattgataaaactataggtgaaaagagatgggctacatcagcacccactccactccaaccttctcgaggtgcgaaccgtctcctccacctccaacttgtcattagcagactcctcttctacaccttctccattttctacaccttctacaccttggtgtagctcttcttccttttattctagggtggggagattcaaaatacattacttggttagctcattctccttcaacgatctcctcctagacctagcctcaaccccattccatgattccatccctagggcctccaagaaatgatgtctttgtgagtatcgaggtgaaaagacaggaagaaatacaaaaccgtttgggatggatccatcgcttctatcccaatgctcagttcccatgtgccctcttctcctctcccatcc

SEQ ID NO: 4123 - DNA, 1379 bp, Zea mays
  misc_feature (1)..(100): optimal_loci_315318_G1, chr9:107853354..107854732, Cluster 25
caaaaaaccatacgtagcgcgcaacgctctcacaaataataccatccagctatttaaaagagaacgagcgatcgaatgatttataaataaagattagacttttttttaacttatatctttttgaattttttagataagataaattgtaaaatttgtttttatgtgccgtcgtaggtcattgaacggtggatgcaggatgcttgagttgatagaaccgaacggaactaacgggggagtagaacgaagcacggcatgactgacttagggaagggaagccgtatttcctactctaattgagagctaaagctataaataggtagtcttaagttatctcaaaactttaatgcactttataataaaggtatataacttaaaaaaattataataacttaagggcttatttgggagcaaaataattagagtaaattgagaggttagaatcctttactattcaattttaatttttaaaaaatagcaagagattcttgcccacttaatcctcttcaatatgcttactcccaaacaaaccttaaaactttaaaaaatctacatttaaaaaaaatagaatctaaacatatgcgctagctaatcgaacatgccagtgctactgcctacaattggatacgtgtatccagccagctactgctcccagtcccagagtcccagggcaagggctcaaaattgggccctcaaatagcctttgaatataaggtggtgaggatctaaaacgccggcgcacacgccgacacgcgacaacaaattcgtcgtcatacaagttgtctgacatcttcttcatgacgacttcgcctctaaggccggtccaatgacgcgcgacagcaaatctgaagcgcatgtggtcaggcagcactgattgcttctccaaccaaggcattgcggccggcaacacctcgatcgtcatccgtgtgtccgccggtgtccagttccgggcttctgccgtctccgcgactccagcacttaaggtcgttgcggcggcgatgggcgatgcatatggcacatgcgggcatgctctcacggtgcggcgaaccacgacaagctccagcggcggcgcgggcagctaggctcaccaacgacgtgagcggccgcgaaatacgatggcttatattagtattttgcacggggcctgcatattttgcattttttgccggacgagcctgactcgtgcgctgattgcatgtttgcagtagctcgatcaggctttcaggatcggcgaatccgtttgatgatacctagctacgctatcagaatggttgactgtgctgggtggctaattattactactacttcaacccataacactatcaatttccattgaaacgtacagtacccactaggaattaaagggtcataatagtcagata

SEQ ID NO: 4124 - DNA, 1054 bp, Zea mays
  misc_feature (1)..(100): optimal_loci_320130_G1, chr9:134081459..134082512, Cluster 25
aagagacttagattatatatgagtggggtgtggccgtaggaaagacaatttcagtatatgaatagagatcgggacaacgcacgtttgctcacgatcgatcgtccgcgcgcggatgttgttgattaccttatcggcatgacggaggacggtggcgtcactcttgcttggctatatctgcgctgccaagtgccaacacgccacccgctgcgaccgtccgtgtccaatatgtagctgccgtgctggcatcggcttttactggattattatttgttgcaattggcacggtagaattctgctgaatttttcgttccgcccacgaccagtacatatcatatcagctaggcgccgcgtgaaccaagtatgaactggatgccacacggatcggagtcgacgctcaaatcaagcaggagacaataatcgtctttgagcgaacgttaatttcagacctcgcattcacgtgagcagggagacgggacaaccagcagaaactaccttgcagctggtgcctatttaactacaaatatgtggcaaatggagacgcaatcttggaccagaaagccatttcttatttacttctaagcattgtctattttgacttagggaccgtttgcatgggctaaactttttttttataagatgcaataagttgggttagtgatttttcttactgtgtgtgccttgaaaagtctttcttaaacacactctctaaattctcatttacgtacgtacggagtcatttcaatatagatgactctctatatatatagcttgtacttggtgtttgccctagctagctaaagtctattattatgagtgcagtgagaggactgattaagaattcatatactcctaccagtgaaatagatggcctatgtactcgtgtgtcgtgtcatcattgattattttagtacatatatcatatgcagtcgagaggactgatgacgtgaatggtagcaaattaaaattgccacgtatactacacgtactcagtatactgttccccaaagggctgggccgatttaggaattaggatattggcctaatgattgattat

SEQ ID NO: 4125 - DNA, 1194 bp, Zea mays
  misc_feature (1)..(100): optimal_loci_322190_G1, chr9:144605601..144606794, Cluster 25
gccgttgttctttgctttgaggcaaagcaaagtcgaggggacaaagaaaaaggtcgccaaggaaccaaaacggaacctgatccgagcaaaattaaagctggaataattcgagcatggatcctgcaccgtaagctgtcaaaacaaatcagcatgtgtataatataatgtcatttggcccgggcggtgcaagtgataaaattaagctacttatggtgttggaaacatgatcctgatttattgctagttagtttctcactgtagacgtgcttttaataatcttaataaatacggactactcaatcgtatgtatggaggtatggttagcttaggccctaagtttctgccacgtcgtgggagctatggacgggccagccgtgtgcggcgtgccgcgtgcgtgcgtgcatagctcggagtctcggacagtcgaccgagacttcgggaggacggcgcggtcggccggacgtactggacttgttaattatagtttgctattaatctaatctaatataatatccagggactgaagccatattacttgctacgtcgccgacggccgacctgggacttgatccggacactcaactcgtagagaactcaacggcgctctgctagatttggacctttgcgtaccacgcgcgttgacgtgccaagttttgtttcttttttttttcttaacggaataaaggaagaaaggaccgaatgtagaatacgcaactgctggtacaaagaatcatcttggcggaagaaactgtcatgatttggtaattgtgaaaaaactaaaatttatttcgttaaaacaaccatggactatgagttctataagatcatgacagctcgtaacatggatgacaaaagtctagaaaatatagggtagaagttgattcggaattaaactagagcaatctatagacttttaggaatctattctacttaacaatgaatctaaattagctgaaccaaacacactctcaggtctcagcgatcaattccggccgattataaagcaacaaaaatgagatcttatctatagaaattagctaatttgtattgccccggcacatggcttttacaaattatgaaaatcactaattttattggtctcacacgatctataaaagttactgatttttattggctatagacgaccgaggaaaattagcatcatcaacacctaaaattaggtcctctacacta

SEQ ID NO: 4126 - DNA, 1234 bp, Zea mays
  misc_feature (1)..(100): optimal_loci_322798_G1, chr9:147520058..147521291, Cluster 25
ttctctgctgaggagagcagaacagatcataatgaaggtgtggaagaacataatagaatgcattacgatcatgacaagtatggtttgcatgtacgtatgcacagtctactattgtaaatagtagtattacatacataaacatatatgacataaaaaaatattattatgttacttctagattaaattaagcataaaatcacctagctaaattcctaacactattgatattattttaaaataaacctacccagactttagaaccgtagactcagtcaaaaattgttgttcttcgagtgtaagggtagagatagtatttttttttaaaaaaaaaatcaaactcctagctccgtatattataatctctagtggactgatcgtggtctttgtcgtctaacataccgcgcgtatactgcactgcagtactgtggtagcctcgtcacagctatacaggcctgattcagaagctctgacaatgcagcctcgttccatgaaccctgtcctgaatgtgctgcgctgccatccgtcgcctgcaatttccatggaaacgccaatggcatgaatgcaggcagacacaaccatacggggagagacttgactgccgagtgccgagcaacgagaagccaaggaacaagtcgtaggaaagcaacaaaccagggcacctcagcctccgtcatattattattatatcctccgtccggtactcctttccggtcatctcggtcgccggttcgccgtcaacgtctggactatcgtaaacagacgacggatagattcattcagagtctttctcccaaaggtggcagtggcacccatctgctgccgttgccggcacgcgggttctaacgtgacgcacgccccggcccccgaatggtattcgtgcgagtcacggatggatgatgctaacagaatcggagaaggacagcattgtgcgcgaggcctgccgtcctggacgcggtcttattagtcaacaggtcagtggagatagcgatggccaggacttgacgagtacgtaacacacacacaacagacatgaccaattgatgatcataagtaggtatgttcatgtattttaacaacaataaatctaataattagttgctatctaacattagtgttataaatatatttagagacaacgatgttaatgatagccaaaaaagatattctatgttggacctgatattcactcttgaaatcttgtctcaagttagagcatgtccaagaagacgaagaa

SEQ ID NO: 4127 - DNA, 1375 bp, Zea mays
  misc_feature (1)..(100): optimal_loci_325234_G1, chr10:4224509..4225883, Cluster 25
tagtagtggcctaagaatacttggaaccaataattttgggacctcgagaacaccaaaaaccaatgagctatagctcccgtaaaatggtcaaaacgtgaaaatcgatcggagaccagttggcatcaaaaatctacacaagaaaattgacacgataaaaacaatatgcctctgagtgcctagatcgttatgtttcatatgttgaaagaaacaaaaggctaaagaatcacaaacccaagtgaataaactcatgactctgaggtatttaagctactcacagagtcacagaaatagtaaatctaaataaactttatttataaggaaaaaaactagcaagaaaatattgtctcgaccaaggtacatcatattaccctaaaaatgtctagtactcgaaagttctaggaccttggaaacacttgtaactattgagctatagctcataaaaatgatctaaacgtgaaaactcgttcgagacccaccacgggacgtaacaaatctacacaaaaaatgggcccaacaaaaacaatgtttttgagtgcctacatcaccatgttcggaagaaagaaaaagtctataaattataaacccaaaatggggaaaactcatgacaccagttatttgagctcctcacggtgtggtaaataaaaaacactcgtcattcgtgagcagagactagctagaacaatattgcctcaacctagctaggtacatattagtggcctaagaatgtcaggaacaatgttgtatccagtgagatatatgtcgtggcttggtctactcggcttgagcccatacatgcgtgcatgtgcgtagttataattggtgcatataatatagatctataaatttattcgatttggatagcctatagtttagtttaacctaaattaataattaattggtttatttttatttcactgggtagacctagaacagataaccgcacagcaagttatatattgagttatactatccgtagcccgtagtgcatccctcaaactttagaggtattttaaagccgcggtgaggttgcccccaaaagagcatcataagtttagaatagatcctcctagtcgtaaatgtacattgttttctctatttcttcctaaatcttttaaatatggtagactatgaattaaatacagaattaatatgtacgtattattttaaactatgataactacataatttaaagtatattaggaatatggtgtaccgtgtatagaggtgaatttagagggagccattacatggagctaagatttagaatgatggaatcttttagaggacagtgaagaagtaaatgatgatattgagaaccggtgaagatagcaaatagtcgacgtatgagtatattaataccttcattcataaatat

SEQ ID NO: 4128 - DNA, 1140 bp, Zea mays
  misc_feature (1)..(100): optimal_loci_326265_G1, chr10:9237317..9238456, Cluster 25
aaactttccataggaattgaatcatataacattcttttgtttttctccattccaaaggaggccttaacagggctcctacattcatttggtcatatcggcttctacggatctcctataagtaatcacgaacattgtccctactttagtacttatttataatcatataagaaccctttattttattgccatcacgttaacgagcaaaaccatcatacaacagttgggcgtgtcaccctaccctcgccttccacgtgaccatgtgtctatgtttgttgggagcacatgtactaagaatgtttgttaagggagagagccaactgttgctttcacttttggataacggaaatgatgaaatcaacaaggaacacatgcatgtagaaaacttatgttgttatgttatgtataatacaacttgtttacaaataatatggcgacacacacaaactcatgtactgaaatttttaaagacaacctaaaattcttatgcaaaaaaagtatagtaacttgtgttttaattgaataagtaacaaccaaaacaacatagtagtttccattgtagatggggtacacttgtttgtattgatgctatgcaaaatatgacctagtaacttgcttcgtgtttctatggcaacttgtagtgtacatctaatagcaacttatggaaatacataacttgcgtcaattttacttgcacagaaccactacacatagcttgattgtaagagtaaaataacactaagatatatacaatatgcatttcactatatattgaactttttgaagtgaaagcaatggtgaatcccaataacacatggcacccaaagagagaaaagtgtactagtaagcacaagcaagattgattttatggtgataatattgtaactcccatgtgctccatcccaaacgagctaacccacataataatgaaaagaatgtcctcttctcgggctaaagatttgtaatggaacaatacatagaatacatatcggtgtttagtaccgcacataccaccatagggttacccacgtggtaggtttagttcatataggacgcaacagaagagttgtaatggtgcgtaggatcgaggacatatgatttaaataggtttgggcagctaaagtattgtaccctccatcctat

SEQ ID NO: 4129 - DNA, 1356 bp, Zea mays
  misc_feature (1)..(100): optimal_loci_33474_G1, chr1:204809622..204810977, Cluster 25
atacaaatggataaactctctatcacaagaaatttgaccaaccaagttatacttagtttatatcacacatatatatttttttctttattatcactctagtctagtgtagcacatggttagatgtccaaattaaactcttggcctatttcaaattaaggatcaataacctaggttatgatttcaagtaaacaacctaggttttactagcaccgcgtggtaggcatgattgtttgcaataactaagggcatccacaacttttaatgacactatgtttattataggtagtgacgtacccaacccttatgtttagggtcaactaggaaattagaaaaaaaatagggtttcaaatgtgttagctaattcaagactcaacacttagactattaagttaactgatttttgtgttcttagagtccatcatggtccatatagaaacccactggatccgcctctggctataggagtacatgatactcatggctcagagcacaacgaaggatgtctaacaagctgaccacatatttaagcttctttgaaattaatataatcttgtttattacatacttttgatatatttgaaagtctacttcaaaccaagcttaacgagcaagccaaagttgaaagttgtttaaaatcaagtcatttttgttttaaaagaaaaaaggttatgatcatataactttgaaacgagccatcgagctagctcaacaagcttttcatccatctctcgataatgagttgatgaagcatccaataatacatcttcaacacattacccaatgttttcatgggtccctagtatctccatctcatcttaagaactggacacagtccacctgtcggcgttgctcatggtcaagcaatgcttcacccgcgccaacatcgaggaagaagaaagcgacacctaggaacaagtttttttaacatgcctaagcacttgtttcgttaagaagaagagagaattacataacacatcaacgagataatccaaagcaataagagaaagaggaggtgatagaaaagggcccctaattcacagccctaactgtgtgaacatatgaaaggaaaattgtatcaacacaatggttgccacagtgggataaattcatggtggcaaagcatccatggagaagagacgagataagcatccaacatgaaaggcgtcaaagcatctgctagagacaaccatggtagctaaagcgacaaaacacatgtatatgaaggagctatcatgttctcagcagcaagcatatgaagggataccaaagtaatgtcagcaacaaagcatctacctaagcaacaacgacgataaagcatctacgaaagaagagaggcaatagaggagcaacacatcc

SEQ ID NO: 4130 - DNA, 1052 bp, Zea mays
  misc_feature (1)..(100): optimal_loci_337179_G1, chr10:78338114..78339165, Cluster 25
gggtcaactaccaaaaaaaacaagaaagaatcttcagactttgcccataagcttctcagaaatgttccagatacaaggtatcaaaggtggttagacagaccttgttcagtaaagcatgcatatttctacaacatcatatagaaaattctggcaaaaaacagtttgtaacagcgttttaataaccctaataagtagatatcattgattcagcttgtcttataagttaatggcattccttctatgagactagagaaagaggtgatagtgctggttgagtggcatacatgcttctctagagaaggataagaacagactaaggaaaaatagcttcgtatggaaattttatttattatttactaccaaaacccatagaaattaacctgaaaaccaagtagccagctcaactgggcaaaaggcaatttaactagacaggcaagacagaaaccctagcaggcaacactgaccagtgaccacgggtatttcttactgggctagccctgctgcctatgtgaggtctaggtcaaggtcgctatatttatagcaagggcaagcaagtacccttagaaactttttgtaagactttttttcttacataaagatacacaactctcctagtgttcgagaaaagaaacactcctgtttctcttaaatgatcctgacagacaacagaaaaaatcaaaatcaaatttaactgaaaaaggcatggagattctttaattgaaaaagaatcaaacagttttccttcatcgttaattaagtaaatattatttatggttttatgtgaaatcgttgaagttaatttatatgtcagaaatattatctcctggcctcagattgccatggcgaggttcagttcaaacttggagtgtcaaccatgatgcccatcatcattgaccaagcaggaatgcaacatagggcttttgagattacagctagaggaaccttatggcatttgggtggattaaattgatattaccgaaaatataaatgaggaaaatcaaaagaaatgaactaccagacctctgtgtgtctgttgcttattgcgagtttgc

SEQ ID NO: 4131 - DNA, 1026 bp, Zea mays
  misc_feature (1)..(100): optimal_loci_338365_G1, chr10:84115225..84116250, Cluster 25
tcccttcagatgtatttctagataggttagattttgttaatcctttggctaaaagccctaagtcatgtaagtagaagtccaggtcatgttcaaactttgttcctattttcaaatgaaataggggaacccctttctgttaaaaagagagagaaactgtagttatatcatgatgcagtgtgtttctcattattataaccgcgttatggccctatttagatacccagtcgattataatagtcacattatataattatatttttgactcaaacaagattgattatatgatgggttttcataatcaaatttcttgactactgtaattccataattcaggtgaaacctacatgttatagtgaattatgaatgttgatagaccaatttgtttctaactaattgaccaacttgtaaaattataattaagggataaaataagaatttctcacttcaaccaaccatatccagtcatcataatctattgaaccaaccactctgattgctataatccataataatgtcgactataatactcatgcttaatcttgattataacgagtcacgattcaaacagattctaagataagaaattggacaaatggattagtccccattgactaagaatttttcggtgagtggaaaatcatatatacctacctgcaactagagaactttaaagaataattaatttgttgtccaacttacccacttataatgaagagtatgcttggcatgtagcttagtcgtgagaaagaattagttaccagtagttaaagggtactctagcatcaaattgaagtttttgttaaacattgttactttttaaggatcacttagtattgagttatatgtaacgagtagcccaacgtaaaacttaagctaataggaaaggtgtgcaattcactctaatatattttagcactccccctctcatcctaataccatactaaattgcatttatcggctagttcaactcaaacatgtccaattcactccgcgtttcaataggcactcagtcatgtgtgggagata

SEQ ID NO: 4132 - DNA, 1041 bp, Zea mays
  misc_feature (1)..(100): optimal_loci_338377_G1, chr10:84175750..84176790, Cluster 25
gtagtgcgacatattgaatataattgtccataaaaagataatttagctttccttttctttgggctagacgggccatcccactgggcttggacccagcagcgaaaaagtgggcccaatctatgtccaaaccggagggctacctgcccgttcctgcatatatcagtgtagtagttctgaactccttgatggagtagtgacgctgtctgaacagaactgaatggtgcagagcgtcagtcaccagcatcccatgctgcatgacacaaccttgtcaatgccactgcaccagctcatgcaacaggcacgtacgttgagaaaagaaatgaaagcaacacgcgcggttttaagtgttgtgaagaagctaatagtaatttttatagcatgtttgctctaaaaaaacttaagtattaagaaactacacacagttttagcaaactctttgcaaggaactatattttttctgtattattcagtactgttttttttcctttttcattagaaaactatactttggagtttcaaggagctggctcactcaataaaataaactcaaacaacatatcggagcagacttaaaaatgagaaaatatctctacgtgaagttcttcctcaatcacaacttagaaattgaagtgcttctcccgccatttcattagaaattgaagagcacaaatttactctctacaaaatgtatccataacgtatagcacacaactaccgtgttatatacagattgcgttggtctacattcagcatgcacaaacagggtctccatatgagttaccttttaaatatatattctactcaataaccattattcaaatttaatttcaagctaccaaaatacgaaatgagacaaaaaaatatcaccaatacatctcaagagcatatcaaaatgaaacatgcacaccttctatagtgaacattgatttttctcgatttgatttgtggtattaattcaatttttttacagaaatcggtttaatctagaggggtctgtatattttttttctcggttttacgaagattttttttttgtttcaa

SEQ ID NO: 4133 - DNA, 1157 bp, Zea mays
  misc_feature (1)..(100): optimal_loci_338613_G1, chr10:85506842..85507998, Cluster 25
gaaaatgaagcatccctccaaaatagacaggactagactagttttttttacaggacaccgtcatgggtactatttattattaagattatgtagactagatttaattagcacaaccatttttagctttatccatgtactacaaaaaaaaatgggtacttgtacccccaaagcttttcaccgtgtacttcaaattattgtaggctagactagactcaactttttagtgggccagtagtggacatttgggctgggctaggcctagcacggcggtcttcaccaactatatatataataataataactcattgagccgtccacactgatcccatttgcagtgtcattatcgccacggttgttaaattgcgttgtcagatgatgcccatcagagatttgcctgcccgagctgctgctgtcagccaagttcattggaccaaaccggcggtgatgcgcctctgatgcaagtccataacagggttggcttaacactgatgtttgaataaagatacagctgatcaggaaccaaccaagtgattagttcctgcatggtttagcatcgtatatatcttgttatgcccaaaaaaagggggggcagctgcataggcttgttacgaattgcagtgtgacagaagtgtaaaaaaacggagtttgttttttttttaaaaaaaactaccatcattgttcctatccagttacctactcaatattcatgcactcgagtcaagcttgatgtttcagtgagcagaaaataacatgaacttgctcatatctcgtgtcctagaaccttccagtgcataaaagaggaacatctataagcttcttcctgaatttgttgccacaaccacaagcaattgaataggaatcatggtaccaccgacccatccctgcgttgcaaatttgcaatctacaagctggagagggagtagcgccacgtcgcttacttctcctgcacaaaatgaccaaaaagaaaacagttgtgcttggcgatctttctcaactaaacactgtagtcattaaaagcaagcgactccaacagagggaaatcgcatctttcttcatcacctgtcacccaacccctttctctctctatttgtggtgacttgttggcctctcattggtcccagcaaaaaaggagagaatatatatataatagcatgagt

SEQ ID NO: 4134 - DNA, 1285 bp, Zea mays
  misc_feature (1)..(100): optimal_loci_340243_G1, chr10:94682449..94683733, Cluster 25
aaattgttacagttatgagcccacaattctttagtgggcagcatgccaataagcgcttggacctctacaacaatagcatcgacatggtaacaaatattgggtggctgcatggtagaagctagatccatctgcgagaccaagtgtgacaatggtgtgaccatccctctgttaaactggtgatcccgaacgaacttgcttattctatgaagatcatgagagaagcccaattgtgtctcttatgttatgtgcctgctataacttatccatgttttcgacctaggcccagcattcctctaatgtctaactaatgtcgtgtagcatctgtcatgtgtctacaaagaggaaagaagaaataatgtagtaggacgacatgcactggagacctcatgatttgttctagatgtgataattctctaatcagtacaaacatatcaagtttgtcatcatcatagctgtctgggctgggacaaagtgagtcagggtcatcttggtcttctgaaagcagtagtgtaagatcgtatagtgacacataatcctcattctctttaattttgtctaccatataagcttgttgaccgttgttaaccagcatcattggctctttctgaggctgagcatgcatgtcatgatcatcagtacaagggtgctgtattttttctcgatcaatcgctctaattctctccagtatatacctcacaagcattaatgtcttcatagttgatatgttcagaactttttgcagacaaagcagaaagcagtgctctgagagcatttgagatggcttcagcatagtatcagatattttgtggctacatagtagtgtttttggccctaattaaggtagatgcttagagttttattaataaggcttctgtccacatagtgatcatcaaatatctgactgagattcttccattgtgacgaaagactcccaagcgtaatgctcaactgttttgcttgcaaaaggcgttccatgttaccgacctgcagtgattgctcaacccgagtattctggatgtgataaaccacatctttgatgtctccaaaacacaaagtcataataacacattcaaatactgtgccatatctgtctagatgagctcgtaggttctctgcattagccaagcttattatctcaagggaagtgcgagtctccaaatggtaaagctcgttgttagaatcgatgggcacacgagaacttgaatcctctggctcaaccaaattcctccaatcgtacatggattcatactggccatgatgcccatcctctcttctggtcccttga

SEQ ID NO: 4135 - DNA, 1119 bp, Zea mays
  misc_feature (1)..(100): optimal_loci_343764_G1, chr10:114202439..114203557, Cluster 25
acacccaatgttggaattagagcccacatccatgcatgaaccatgccatcgtaggtccacaaagagagttatgggtttgaggttagagttcgggagacatgagtcaagataggaagagctacgaccatggcacctgaagtggcatacgatgtgaagatgtgatgctgccaacatcccaacaccaagatagaaagttgaactgcccacacaccacgtcgccaatgtctatgcttgatggtgcatctatctctaaggccctatcttgtttcataattgttatctatttactttagctaccttaaaaccaaacaaattagttattgacttaaataaactttagttagagtctaaattacattatctcaatgaaatagattagataatgaactagataatttagctaaagcccagatttcatcatcttattatcttctcaaccttagctaataacaactgatactatgtgatcgatccatattcctattgatagcgataaatcataagagtatccatatcattctcatttgtattagctagtctattatctagaaaagcaaaactccaccgctaggtaaactttagccagctaaaatttaggtgtgtggaaccaaacgtggcctaaatctggctccacttttcatttccactattcaaaattatcctttttattactctttatttttgtgagagagagagggactcattaaatacaatagtacagtgacttccttacaatttttggcacatattttttgatagctattaaactatagaaaatagagaatttgttagagacacgaggtatataaagataatatttattaaatgactccaaatagagattgagattttagtgatgaaagtccactctaacaccctctttaactagaccactaaatattttcatcctctatttatgattcttgcttgccaaagataaaagaagagctcatttctagagtgttgagcaagatataaaaaaataggagtagatagatctaaaagatagttttttttattataataactatcgagtaagaatttagaacataattctagtgaaacagttgaagcaataaattcttggtggtcaaatggtgcaatagtataggtctatat

SEQ ID NO: 4136 - DNA, 1004 bp, Zea mays
  misc_feature (1)..(100): optimal_loci_346796_G1, chr10:131978796..131979799, Cluster 25
gtatgatattagcgtccagggaaggtcataccctcagatatggtcaagacacatttaagaatcccgatagaagaggttattgtgggactcaactactgggaccaccacactgacaccctcaatgccctgggaggctaggacttcccctggcctcgacccagatagagattttaccctctgaataacttgatagtgatgcacccaaaggaataactacaccatcaaatcctattaagaacctctataggccatacaatacaactctctaaggtccagggcgctcccacacttacggtgccaatccgtaaggatatactaaggtatgggccccttagtgtcttgagacaccccaactagaataatacaagtcttcaggggtccctcttgtccttgaatgctcatgaacaatctaagcctctaaagccccttgtgcttccgagtgctcatgaatccaagttctgagagtcctttatgccccaaggcgctaattaaggatttaggtgcctaggaacctccaccatgcatttaggacactctgtattacttagtctctaaggaccctctattgaccccaaattctttaggtccctaacctcacgtaagataggtaaccacgaccacgagtccctaaggacccaaaaactcctatgggaataagggacttcaaatgactaactgtaatcctattgtaaaacagagcgatgtgtctaggctaagaaaggcattataacttcgagaaagggatgccacatctaaaggcctactatcaggtctattgtcatagcatatcagatctctcatgtataacatattaaatatgtgatgtgtgatattacaggcctaacagatgcactattgctgcaacgtgagctataagatattgaccacttcaatacatgcatcatccttatagccacgcatgttgatgacaatgtaccatgaagttattagtactattaagtatagaaggctatagcaacaaccagatgtgagtagtattatta

SEQ ID NO: 4137 - DNA, 1357 bp, Zea mays
  misc_feature (1)..(100): optimal_loci_348718_G1, chr10:141641606..141642962, Cluster 25
taagggctattgtccatatgtacggccccatcaaataatttttctaacactctttttgagcgaaacgatgaactgatgcctcatttcgtaagaaacttgataaaaactggtagtatgaaaaaagagtacaataataatcatcattgacataacaatctttagaatcgcaaaattaagatagtctagatccaaacccgaacttattgccaaaggcattttcctctaaatcttgtaattctctcataaatctcatactgaatttgtgtatacatttactaaaaaaaagaaacagcagaagatgtggaggataaagatgagtaaaaggagaaatgtattagtttttttctaaattatgtaattttttcttttgaagttttgcaatttttatcgtttttacaaattatataattttatttgcttgtatttatatttcagtaaaataacacatattatattaactaaaagtaaaacacgatgtatcttaaaaaatagtcttgtctcatttcttctcgagccgaatcaccatctctgccctgcttgctgggctgccggagagcgcgtgaggtctcagacgagtgggagcgcacagacgctgcggtcgggtaagttacctcagttttcatgcggggtcagcgggtatggtgatccgtctagtggcccggcggcggttctagggttaggtgtctggaaggcgcccgggtactaggatttgggcatttggaatgttgtgtagaaaggttggagcttctttctgggctaaccgcagcagaggtgccataagcgctgaagagcaagtagatgggatgagaagaggaggataccaaaatagaaaattatttggtatcaaatctttgagaaacaaccaaccagaaaactatttggtatcaaatctttgagaaacaaccaatctacaagcaaataattaatttggctttgttaagaacacaagagcatataatgtcggacttgtttttcttgctcatgtagatgtctgcacttgtttatctaccttttgcttatgaacatgtcgattttgtagatggatctcaaggaaagcctctccaaagttaagcagcagcaggcgagatgccagccatctttggcgagcatagctacttccacctcaaagccaaagcacatggcccaaccagtgcatgttcccaatgttcttgcaagaccatcacaacatattcagttttcaaatgatacagaaaggctacaacatattaattcgattaggaaaattcctattggagcacagatcaaacttgtcattgaactactttacaatgtattttcttgctatgctaaagatttttttaaatgtctcttttcatatcggagatattaaaacctg

SEQ ID NO: 4138 - DNA, 1148 bp, Zea mays
  misc_feature (1)..(100): optimal_loci_348789_G1, chr10:142205892..142207039, Cluster 25
gatgaacaaagactattgttacattgttgatggctagcatcttcatgcatatgcactttagatagggatggttgattgttgttgacatgaagctcgtcaagaattattttggaccatgctagacaacataagttgagagcacattgaacttgtagcctagaggctattgcgccatctacaagtttgttgatagtagggaagttggattaatagaggtgattggttgttgagagactctttcttgcgaagtttccatcgtagatctcgagttatcgtcatgtgtcatcttagttgaaatatgggtttcaccacttaggtgccaaagagtggttgtgatctcctagatttcttctaatgttttctttgtttttttctaacattttttaagttctatccgtttacattgaaattgatattatgaatatttgatttttgttcttttgtttttttgttatgcttggacgtttttttggtctttattgatgtggagtgagttgttttttttgcgcttttgtgttgtcttatatgtgagtttagccattgtgcttgtggtcgtgggtggtgttaacgagcacacacaaatgtgcgaccacctgatgttgaggaacaaaacaatccaaacaagataattgtggctataaattcaattggatgtacttttatgtttgtgaacaatatattctacggtgtatttgtagaactatactataagattataatcgtttatccatgtaacaccaatttggtcacccatcctccctataaactcttaaatttgtatcagtgattagtcttcgcggatgaatatttacttccaatgaaagctacgtagtagcttcacattgactttacaaaaaatggggccttctttgatgaggcttcgtatgtaccaagacttcatgtagggtcttcattggtgaagtttcttcgagtcatgtttcgtgtagagagtttgaattgaggcttcatttgccttcatttttccaggtgtagagtgaaggtgatcgaatagctttgattttttgcatatggtcttcacactcgattacattgaaatgtttgtcttttcttttctcatcactcctattgatttgcttaagtgtggagtcagatttaaaataaaatgtgaaacaaagattaacgattag

SEQ ID NO: 4139 - DNA, 1017 bp, Zea mays
  misc_feature (1)..(100): optimal_loci_35102_G1, chr1:213219863..213220879, Cluster 25
caattcatccgtaatttattgatgtgggaaaatttggttgtgttgttattttttgttttgatcgatgcactttcgttatgtccaggttttgtttagtgcatcttttcattccttatgtgcaagttactatatagtcaatcgtagtgtctcatcatggtagtgtgctcttagatcgtaggttacgatcttcttgtaatgactattttgttttatataaaaaatagttagtgtgcatatgtttaaggatatgattttggtgtaatggtcttaagggatccttttagtatgttttaatcaaagtttgtagggttatctcttttagaggtaaaatacaatttaataggttaaaggtttgtcgctgtaaatttctagggcaccagttcacctcatctcttaaggccattcaattcttttatgagaacttaagtattgtttagaagcatgtgtatctaccttaatctatatgtattaaagtgggttaagatagtttatcttcactttaatccactctaacacacatgaattaaggtaagtacctgtgcatccaaaacaagcccttaagtaatagaacggtacaccaaccaaaatggaagacaacaccaactatatatagggaagtaactctactccaccccacccctttcgtttagacttcccaagcccacctaagatcttatttgtctacatttctatctatattaatccatatgcattaggatagtatggtagaaaattagttaatgtgtcatcccaatccatcccaacacatatggaatgaggtggataatagtgcaactaaacaaggcctaatacaagtgccacgcattgtgtttcatgcatgtaaacaaatagcccatttagttcttgactaggagtatttaattaccacaagtctactcctggacctccagtgaatggtgaaccttggtcactataagcaaacacagttaactataactatgccactaggaatagcactgcctcaaggctactttggtacttgcatgattttactac

SEQ ID NO: 4140 - DNA, 1232 bp, Zea mays
  misc_feature (1)..(100): optimal_loci_37653_G1, chr1:226283617..226284848, Cluster 25
ataaacttgtcacatcaggctgaatgacatgtcagtgcgcgccaaaaacattggcacgactaaatagattaatctcaaaaaaaaaaaataaaacttgtactagaaacatgcatgaatacgagacaaatgagaaatgtgtctctagcttgtcgtgccagtcagcacatcatttagatgttcttcgaaaattgacatggctaaatagattagtttcagaaaaataaataaatgattttgtaatcagaaagataaataagagataacgggaaatatattcctcaaagatcgtttgtgctgcacggcacggacgagaaacctgaggctgcaatctttcgtcccattccattttaccgtacgtacgacaaataccggcatagatgcacctggcacaaaagaatcgattcacgcacgcaggcaggcagctggaagataaaaatagcggcctggaattttccaagaatatacaagtgttttctgataaaatagagttagcggcaagataaaaaaaaacatttgatgttttcataaagttggcaaaaaaaaatgaactgtatattcgtagatcatttttttttgtaaagaatgcttctgtggtcgtcgagggcgggcagcagcatcaccgactaaaacttggcatttgttaatcagggtacaaccacgtactccctacggtgtactagtatgtatgaataaatgtagtgtaaccaacgatgtcattctaggatataaaaaaacagtattgtccggttttattcctgtcttctgcatgcatagctggctacacgtataccaaagaggaagtcggacccttatttaatatggatacgaccgaaaatttatccctcaattacttattctttggtatgcgaaatgctgtataaagcgacatctaatactacactggaagggggagtatcaaataatggccgcatttaaggaaaaaaaaaacaaagtaaaacataacatgtgaagaaccctagaactgtaaaaaaaaattaaaactggggtaaaatatcgggacacagttttaaaatttggttgacgatgctatccaacatgcgtcccgggaaatctaacagcttgtatagttgccggcagctgttgatgtagaaattaaagccggagtcagccgcagcaagcaagcttaagaagctcagcctgcacccgtgtccaccgccgcccgcaacttgtgtaccgggcagagcggccgaccgcccacgcgtcccctcccc

SEQ ID NO: 4141 - DNA, 1060 bp, Zea mays
  misc_feature (1)..(100): optimal_loci_38428_G1, chr1:230173071..230174130, Cluster 25
ttattagacataagatttgacaaatcaacaaatgcacaataatggtagaaaatttagggtaaaaatgaagatactacaaaaggatgattggagcagctatagtcaagcttaaattgcatgtggttccatttggagttagtattagtgacaaaaatgctggcaaatgggaccatatagatccaatcaagatttgatccaagtttgcttggggataagtataagagttgttgttttgagtgcatacttttgttagggcttatcttttattgtctatacaagagatatgcaacttcatctgaatggaagccatgaaaattatctccaataccaaaacagcaaaaccctaccctataagtgttctatcttgtgaagcaaaggtcttggtgcttatagtcagacattgcagttgttgtgtttgttataatgggtattaacatgattctgagtacttgattaaaggggctcaaaattaatctcttcataattctaaagcccacgtacttctatacctacaaaaattgtgcttgacacaacataaaaatgcaactatagaaaagctcaggtaccaaatgatggtgacacaaaacaccaaaggataataaaaagtgctgactgctgagctaataaggatagcaagaaaaaagatggagacttttatatttgccatgaaacaaacaatagttaagaaagaatgaagctttaagccaggagggatatggccacagccgtaggcatggctcacaaattggcttacccacgttgaaaatttgtggtccaatacatgtagccctaggcatggcccagtgaatctcccagcccatcaaggcagcagcctgctagccagtgtttgtcctacctgcagcctcgcctcttgatgttgaccactccactcactcttccgtacctgggcacaagctacgctcacaggcaggtggctgcacccttccctactccacaatgcaaaacactagcagaggcatggccaaatcaaccaatcggggatgactggcaggagacggcactgccaaatcaattaatgagcatgccaaagaggggcagg

SEQ ID NO: 4142 - DNA, 1115 bp, Zea mays
  misc_feature (1)..(100): optimal_loci_38826_G1, chr1:232393534..232394648, Cluster 25
tagattagatcctttatcatttgctttatctcttcaaagttatctaaccaccttgggctcccatatagaaggtcatcattgtcgaggtggttaacgaaatcctcaaagaattgtgcatccttggggtctagagtagtagccacctcactaggatcctcatcattatcacccctatcgtcgaccatgtcttgcacaaaatcattcatcatgatgaaatcattctcgccatttatgtggtgcctagctcatgatgaagctcttgctccatggtctcattcaccatcggcggtgatgttcttatagatgcaccactggcatgtgctttgtcataaaactccaaactgtatatccctcgataaaaccctcactggatcatgtgagatttgacatcaccaccttctagcaatcaaacacattatttcttgcaatgataacatggacatatgatttcatcactattcacactcaaaacatgtgtttgagtagtgtcaacaaactttatcacttgttctattaagggttgtgatagtctcgatatatgggacgcccattccgacctttccatgctaattaaccttctatgtagcagaaaaatatgttaagaaacatcaaaatgagattgattgacatcatatatagattatacaatttatgataattaaaatctacaattaataatagaaacaaataaaacaccacttgagatatataactgctatctacttgcatcatgtatgtatagctagctagagcttctctccatgtcacacaaacagatatagaagtattataaaggaaactattaaaatgaagaaaaatgtacttcttccctccaccgtagatctagatcacccaaaacttgaaaacaagcacaagaaaaggtgtgtgagagttggtaccaacatcctacgctgcccttcttcaaataacccaagaacaaaacaccccatcagaaatggtgttttttaggttggggttgattctgtagtcatagatatatggaggtggacatactaagagtgactgcctttgttagtatgaaatattaatagaggcggtcgacgtaggtgaaccgcctctgctaatgaattaacggaggcagacctcttaagaca

SEQ ID NO: 4143 - DNA, 1224 bp, Zea mays
  misc_feature (1)..(100): optimal_loci_41055_G1, chr1:243460119..243461342, Cluster 25
acttagagatgcatggacaacttaacaagtaataattttaaataattgtgtgcacaccgaaacacatatagctaatgtatcctatagtttatgattttgagacaaacgtgattgcaaacttatctgatgtattttggtgtacatgtctccataggcacggaaaagaatgttcaatctacatatggcatcgtcgccaatacttgcagttaagcaacctccatctttaatcttatttttttaagaaacacacataatataacttatatcgggcctagaagtgtgtaacttcccactatgcccgatccgttcgaaagcccggaaacatcccccatttcctggtgatagtgtcagattacgaattgggccgctcaaatacatgctacttgggctcctccggtgctgcacctgcgccgtaggctgctgtaatggctaccagtctcttccctactaggccgtgatcccgtgacatgacaaacataggagcagtacggagaacaaacctccaatgttacagtggaaggcccattgcttctcttcctattgctatacttatcttattgaccaaataaaaaaagaaaaaaatcctggcaccaattgcaacacacatttagattcaatatatagactagcactaataagacactagtaaaggtagtaataagacaggtgataataataagacggtggttttgctgattatatatccagcaataatagggtagatgatctgatgccatgtacagcctgtgagattttgtttctgagacagtgacttgtgaggatgaacttaagctagtgtcggaacgatgacgctactggttaatttaattataataacattcgtcgtggtcatggacttgcgtgcattcgctcttttatatatgtaaaaaatatataaataactgtagtgtgtcggtagaatgcagggtaaagacgacagcgcgagacacggaccgaaaacgattttggtcccttgaccatcgcacagcgccatggagagcgaccgtaccgcgccttgttccattttccaggacatggtacgacgaccttggtcaaattttagcaaagatttctgtagcggtgcagaccgtatatatgcagatcttttgtcggacagcaacctcagaccaaatcgcccgctcaatcccgcaaaaacagtagctacgccgcgctcatgtcggtcaaatcaacccatgtcttaaatttcactaaattaataaaaat

SEQ ID NO: 4144 - DNA, 1027 bp, Zea mays
  misc_feature (1)..(100): optimal_loci_42318_G1, chr1:249453922..249454948, Cluster 25
gctttgaacttatctctttttgtaatacaataatatatgtgctacatatctttgaacttaaatctttttatatattgcatattcttctactgtcaatagtatgtagccataaaccatgttaatatttgtttttagaaagaaaaaactaactgcatgtacaagtataaaaaaattggtgaaaatttggctaaatttcaataattttgagggtggccaaattttttaatatcaaaattagaaacactcgagtcagagcgaggttcaatcatatccatggacgactccaccgcaccacgccacccgacgtctttgcttgttttcggtgaccgacagctactgaaaagtgcatttttttatctcagtttctgcagctgcctgaccctccgatccggtgcgatgtcggatccaactcgatcatcctcaccaacatgttcttacctttttctatcgctcttcgctccagagttccatgcggttcaagttttcttttttttctacagtgcagtattagcccaaaggatgatgcttctagtcacttctgctgccaatacaagtactgagtgtgtgtggtgtggtagagtaaactctgctgaaagctgtgtattgcaactagcgtacagtatactacgagtatgtagtatctgataatgatttggtcaacggatgcagaaactgttggtagtggtaggggcctggcctgcgcgctgcgcatggcatggcccaacgccggtgaaggcagacacatgccgtcgccgccatatgtgcatatgcatgattcaaaaaggcaatcaaggcatgtgatcattgttaatgttgtcagttctgtggctaggagaaaaggaggacaccagggcctggccggtataattcaaggccacgtaccaattttttttatctttgttaagaacaggtgatatagattaatctcatctattgatagtgattggactgttaacatgaaaaatggcttaataacggcaacaaatgttatgccagcatacgttggctgcacttcgttatatagcta

SEQ ID NO: 4145 - DNA, 1163 bp, Zea mays
  misc_feature (1)..(100): optimal_loci_4265_G1, chr1:22011779..22012941, Cluster 25
gtcttacaaagccctaattcaaaaaatagaattgtttaatattgttgaaatgacaaacgacataaggtcaagtctcaagaggggtgtagcggggaggtgatggtaatggtcagtgtctcaacaggtctgagatagctagtggttcaattatgtcctcaactcctcatacagaaggaatagcagcggcggcttctagccttttgaacttttgaaacagggaactctgaacatttgaccaagccagtcgtgaggtttcatgcatctactgtgttctgtcatttgttttcggttaactgttagtatgagtgacttgtcgttgtccaactaagaaccctgagctcagactccatttcccatatcggtcgtgtccatggaatgtataagtgattaatgttttgaagtcttactttatgcttcaacaaggaaattgcataaatacttcactgcacttgacgatagtatttagtttgtacggagtacatactaatgtttttctctctttgaaaatctacgaactgttttttcctgtgcattccagtttgcttgtttccttagatttggcgctttcacaaactgatatcaaaattgttgggactttctgtgcagggggtgaaaaggcgctcaagaactttccgaaaatggacaggtatagatctggttcaaaattttcatgctctccgcatgcatgtaagttggttaaaaatcaagcaatggctcagttggaaaagaaatcaagcaatatagacatggaacacgctgattagcttgacagctagagagagcaacgtgtagccaatcatatccaagtaggggatctaacgatcaatcattcgatttgggcgaattaacagaattcatgattatcggtttagttttcccaaacgatgcggccgtgcaactccttttttttgttttttactccagcaagtccactaataatgcaccactaacgcacacgtacgcttgttaatatatccagggagacaaaactatatatcgatcgtgtggacacctgtcgatccggtggaataagttgggcagagatgacaacaatataatgtgtgaggtcgaatgtcagaattatttgtgcttgtccgttgagatggagatacgttagctggcatggagatttttcagttattcgggtgatctttggtggtgca

SEQ ID NO: 4146 - DNA, 1244 bp, Zea mays
  misc_feature (1)..(100): optimal_loci_42935_G1, chr1:253145590..253146833, Cluster 25
tgccctaagagtttataaaggaacatttggatccattaacatccctaagtacaccctctgcttgagaggttctatgaggacaagcaccgaaccaacctgttatagtaaatttgggcaaatttatgatggtttaaccatccaacactcacacatctaacaagtcacacaatctgatgagacacaatggtaacgatttactactgtgtcaaaactagtcgtttgaaatactattcggagcgtatgattcgatggtcattgtcggatcagttcgatgcccatgaaaacatctctagtcatggtcggaagatgtcactgtttatagggtttgatgactcggtagaagaaacactaactcaaataattgtgttgtatgaatcaacgctccttatcggatagtccggcgtgacctgaaactctctaatttattttcgcagatcgtcaaactcaacacattagcatacgacatcttatggcacgctgaagtgtgagttggtcgtgaagaagacagagttgatatggggtggtggtgctggtgtgcgggaggagtaaggagagatgggccgaataaaagagacttttaaatatgtgctcttagtttagtatcggtgcagtgatgctaaactatgagcaaatatttagaaattcgtaaaaaagaagaggggcggaggttttgaaaacttggtacgtccacgatgttgacttgccatcatggctggccacatctgatgctggcgctgatgtggtagacttttaaatatgtgctcttagtttagcatcgttgcttgatattgccactctctagtagtaaaatcgtattatttattgatagtagaaatgtataaaattgagcagcgatgctaaacaatgagccaagatttaaaaattcgtaaaaaaaaaggggcggaggttttgaaaaccggtcgtgatatatataatcattttcgaaggaacaaattttgcatgtaatgattggccgatgcttaccttgcaaggttttgctggcttgctgccggtgcagaccattccagctggtagcaagctgacgtgctgcactgcatgtgtgtcaagattagtactctgttaccttttgtttctcgtcttcatccttccagtcccctgccctgcataactgcacagtatctgtgcagtgtgcggccctatgtcagtatgtaaagtgttcacgttttttatgggtcaaggccttttgactacatttacccacatatatatcattcttcacttct

SEQ ID NO: 4147 - DNA, 1283 bp, Zea mays
  misc_feature (1)..(100): optimal_loci_44637_G1, chr1:262145528..262146810, Cluster 25
aagttcactaaattgtgtttcccataagaaacttgatccgtttcttgcacatttgacaatctgcagtttttatattgaagtagattccctgtacttgaagatgttttctcctgatcatctggtatgtcaatcaaatataggtgaaggaactggtttgcttcgtctgcatagcacttatagacatgatttaaaaatatacagctcggacgaaggtcgtgtacaggtacatttagtcacatgtatgctttttccccaatctatagcaccctatggatatgttttccttggaaccttggttgcttggctatcacactacacttctagttagttttcacctttgatattttcccacatgaatggccaaagtaccactatgaaattacacttacctactttgtcgctctttcatgaaattacacttaacctactttggcaaatttggaacactaggtttaattagaaattgcatgtggtcttaggaatgactactttttgtcacagaaagcacagcattgattctttcttggaaagtcatctcgtataggctataccggtcaaaacacacattattcttttttgtgcttatatcactggagttgtgactaatggaaaaaatacaatctttcaagttgtcccacatgaaaattaatgaaggcaatgatcttacttgcctgcaagattttatgttgcatttatggactaggcatggatgttggttacaaacttgaaattaccatgatatccctggtattgtcttgtaatgcatgagaaagttttgttaagatttgctcaatgtggaaggaagagggaaaataagggcaactatcagttaaaacaacatcccttatttgaagaagacccgagaaacccttcccctcctccaacccacccactgctcagtctatgattctgcagttcatgcatatgtctaactgcaatattttcttggcaatcaactgatattcgtaatttacatgttcatggtgtacttttcagatgtctgcagcagcatttgcaaaaggccttcttgatttggaagggcagttgactccgatactggtaggttgcttatgatctagaagagcaaatatttggaagggcagttcacacatctttttttttaaaaaaacacacacacacactcactttatacttcttcaggtatctttagtaagtaaagactcatctatgctagatggactagaagatgcaagcaccgagatggatgaagctaaggtttgcttttataatttgataagcgtgctatttttttaaagttgcga

SEQ ID NO: 4148 - DNA, 1196 bp, Zea mays
  misc_feature (1)..(100): optimal_loci_44900_G1, chr1:263429422..263430617, Cluster 25
gcatgagattatggtttatttactccgagttaagggtttaaatagatttttgaccttgccttacccatacaaagctaaaaaaagtatacgctcagacacaatgcagagttcacttcacataaaagttaattaaaaaacacgtaacctgatcattaaataaatctatgtaaacaagttgaacgtgctcccttgctccttacatgtggctgcactttccactctatgtaaccgtgctccggagcttttcccaagcttctcgaataagcataatcttcttttttctagaaaagaatatccttaatcgattgccctttaaaaaaaagaaagaatatcctcgtggagcataaaaaaaagaaagaaaaatcacgagagctttttttttcatgtgcttcaagtcttaactaaagaagtgatctaatcaccggggtcctactaatctcaccaaacaaaaagaaataggctgataaaaccatcacgtcccatcctaggcagtgcacgtcagatacccagctgacggtagctaacatatacccgtaccttaatcaccacttttttatgtgcaagtgcaacaggcaacaaacgtactgtatgagctcaagacctcaagtaggagtgcagtcgtaccgtggaagacatcatttactcggcggccatcgaaaatgcaagctaactgcgctggctaatcagagatcatcatcgaagactacttaaaaaagtgacacacgaaggagcacggatcggatggtgattagctcgctaataacccgccatctggcagagcacaagcttaattaaatgggcattaaacctgccgtgtggagacccgggtgggattagccatctcgttcttgtttaacattatcctttggacgaaagttaaccagagcgcctcctctgtcccctctttctatctccacttctccagcgtcaagctccgggcgtccctctgtcacttcacacttgacacgccgcacagcagccgtgaaaaaaaaagagcccgtagtgatcacttcgcttttgtcgcgcacacgtctatccgatccgaagaaaatcttctcttctctacccgccgcatccagccgtccacccgtccgcccacccgtatctcacggcccctataaaatctgtccatttgttgaataaactaacccatgctttataatggtaatcagcacgtatccctactactaattaag

SEQ ID NO: 4149 - DNA, 1164 bp, Zea mays
  misc_feature (1)..(100): optimal_loci_45356_G1, chr1:266031003..266032166, Cluster 25
caaactgtggttaaaaaaattcactcgtctatctcacgccaaagcacatgtcgttgtatatgggggtggggcaggggttccggatgttgtctatgtgtacttctatttgccacatatacttaaatcctatatatttggcttcatcaaccttgtccgttgtgtgctcttatatgctcgtgtggcctacaaggactacatcctatcagcatattcacatgatatatgcatgaatgctcctaacaactaaaagtcttgggatagttttttagatttagagaccttcatgaagtaaaatgtaatagatccttagtaagatccttaatataggaaaatgtacaagtgtacattgaaatgacaaaatacagaacgaatgtgcctcagcatgtctaacattctttctcttctttttttgacattgttgaagtgtaagcatttgttatgaaattggtgatatccgctggaccaaatcactcgaatttattgttaactctctttatttgttcatgaccgacactatttttggagtagccctaggttgtctaccgcatcctcctttaattctgcctaggtttcttacttcaatggatcgctatgtcttcattatgatactagtggattatctatctcacatgctagctaaagtgaccaccatgtactataaatgcagtcacaactgttgtttactagtttttttatggcagctgcctaatttgattgccattctcagtgttcttggttggtattgtaaggagcgagtgaaccctgtcatacctgtttgatgttttgtctccatatcttccaaacgaagtagcaggttttggaggagtgtactttaacattcaattgacctatatgatatagatttgtacactaaaaataagatgtgtaagtggcgactattaatgtaagcattggaagggaaaagagcaaaggaatgataaataaaattaaaaaacaagaactatgaaatgagttgtggcataaaactacattagggaataagccggataaaagtttttgtcattgcagcaggaggagaaatttgtattttaaacatagtagaaggttttattgaagtgtttagagccatagactcggcattctgttctattggtagcaaagaggagcttcttccataagctgctaggggaacggatccactcc

SEQ ID NO: 4150 - DNA, 1043 bp, Zea mays
  misc_feature (1)..(100): optimal_loci_45565_G1, chr1:267170834..267171876, Cluster 25
ggcatttataatttatatataattttagagggatatttaaaattgtcttttataatgtcataagggataatttagatacaattttaggtattatttcatgtattttacatagtggtggaggtggctaatttgttttagaaaatagaatgcggctataataatcggtgattttagatacattccgaattattgttagtgtttttagagttcgttttttatgtgctacgtcgagtaagaattagactacatagagaccgttggagtcacctctgaataataatgctgcaacaaatcttccgaatcgcattgaagacaaacggttgccggttgggcgtgcttccatttcttcctgcttgtcagccaattgttggtccacgcttgacaaaagtttggaaaaagaaaaacagatactgtatagaaaactcggccgtgtccgaactttgggagtccagcaatctcctgctattatgcgcaagaaccgaaccacttcatttttcaaaaggaaaacgaaccttccctatatttccgtatagagaactgaactttggcgagtcaccgcggtgagaccgtgcacggtcggctagccctagtgccaattgccaaatttaatttaggttgaccactatgatgaccagtgtgtaagagaggcttccactggtatacgtaataagctggtgaatccaaaaaaaaaaaatgacgagcgacatgtgttttggaattcaaacgactccacgctgaagaaatgcactgcacatcagcgtatcgtctgcctaatgaatcatcagtacgtacatcaaagcaggtaggcaggcgtgacatatgcctcccgtgtcccgtctccatgcccacgctaatgtatatatggataatggatacaatgctaggcattttatttgtgtgttcaacacttgaactcatttcaatcgtccacaagctaagagacaaatataattatttttcatgtctgttcccagcttcaaagcatggaaaccaaagcggctttaattcctcgagcccaaccccaactcacgtcatacctgacc

SEQ ID NO: 4151 - DNA, 1208 bp, Zea mays
  misc_feature (1)..(100): optimal_loci_45923_G1, chr1:269130438..269131645, Cluster 25
cgattccctccgccagaggcccttcatgtgctggaatattatccatgcatgcaagtgcaactcacattctcacagttcgtttcgcgtcagagcacgtggatttaagacggcatcatttgctactgtaactatgaatgcaggcacgtacgcaggccgcagtcgtggcgaactgccagagcaagaagtgaacatcccggcccgttggttccatgtgcatgtgtcgccaaaacgtaaagagcagccaagggaccataacagggcaggaaggccaactcgtggctgcgcacctgcacacaacactttcgccggaatgcagtcaaaacttttcatatatacattttgatagaattgtttgtttattataaataaatactaaatttataattaaaatatggtaccgagacattaagtaacacagtaagttctaaattcaaatattagaatataaattatattctaataggcattcgagtataaattatattataataggctgcaaggctggaagtggaagggtagttccctttccattgttgggagaattactttgataaattcatgtctttccaactcccccatttaccgtgccaatgtacatgctgcccaaaaccactattaaaaatcttgatgctaaaaggagaaacttcctatggcaaggtggtggaaataggaaaaaaaataccacctgataaaatgggatagagtttgcactgataaaagaaaaggtggtcttgggattaaggatcttaagcttatgaacatcagtttgttatacaaatggtggtggaagctggagactaaggatgagttgtggcaagacattaagtatctccatggtaaatgcattcgtgatgtttctcctaaggtcttcgattctcaagtctggagttatatgttgaaagttaaaatgtattatattcaagggagacatatagccactgatccgagagataaaacaagttttgggatgattgctggttgtttgaagaacctttatggctttatctatgtctctatgcctgatttatatgatatctgtaatgataaagatatccttgtgaaaaatggtcgtgaaaaaaaatcatgaatctggattttagaagatggctttatgatgctgatagagcaagttgtgactccatcttagacaaactccaagattttgagtttacaaatgattttgatctggttttctagaaatgggaaga

SEQ ID NO: 4152 - DNA, 1036 bp, Zea mays
  misc_feature (1)..(100): optimal_loci_45926_G1, chr1:269141133..269142168, Cluster 25
catcggatgagtgaaaaattaaagttattgaagtcctatttttctataataatgaaaaaatcttaatttattgagtgtaatagcacctgatagtaaaatgttggacaagattgaatatgaaaatattattgaaaattttattttaaaatcactaaaagattaatgctctctaaataaaatttatgtaaccgatacaaaatttagtcgtcattatattatgtataaaagtatatatactattacttaatatcttttttgctatactttgcacgggggtcccaaaatgccggtacaggattatccatacaagtacatatatttttgtgctatactttgcaaaaggagaatttcatattgtttccaatataacgatcgtaaattttatatattataaacgtcactcacaacaaggcagctggtagaggattacagacgacatatacaatacagtatatggataataatatatggtgtaggcaagatagtacaagggattattgtgtcttcctcttcctctcccataccctacgcacgccctccctattatcaggtgtattgtgcggtgtcctaacggagccaggacaacctagccaatcatggacgcgccaataacgagacggtagatgcaggcgttatccggatcggatgcgcacaaaccaaacctgcaggcaggcaggcaggcaggcaggcttgcctgtacgtacgtaccttaattgggccggcccggccaagaacaataattcatggcaccaaccgtgtctttcttcccaacctctctttcttccgcgcgccacgcttttctttggccactacccctttacagtgatcgtgatcctaattctaaaaaacaatggacgagcagtgtcctggattaccgtaatgcgctctgagcctctgatcccttgcttgcatggtatcgtatgattgtatgctttatctaaaaatacaggctttagttagacctaataaaggttagtagttccttgcaactttgctgatctcgagcacccaatgatcgatcgacagtataaggccc

SEQ ID NO: 4153 - DNA, 1297 bp, Zea mays
  misc_feature (1)..(100): optimal_loci_46194_G1, chr1:270722607..270723903, Cluster 25
agacccactaaaccaaatcacatcacacttataacattcactaaatttactaaataaattacaccaagatttaatacatcatcaaaaccaacagttcatatcactagataactctctcccttacttggatccaatggacattatttggatcattcctcaacgtctcatccctctcccgcgaccccacctcctttgtgtcaacgttgcccccttcccttcaatcgcgtcgccgtcgccatcgaggcatcgactcatctcctccctagaatcgccacgccgttcggctgactgcttgctaacatagtagcaaaaacaacggatggtgcctgaagctgcagcagcatgtagccagccaaacagcgtatgtaacgttagcatgctactgataataaaagggttgatagagatgaactctccctccgaaagatctctcatctataatttatttttgtagttctttaaaaattatcattcttttttaaaaaaatcatcccctatatatcttgttctttatacattaaagatacatattaaagacatgttttactatattttttgtgtacgtatgtatttattatttctttcaaatgtcttatatatatatgtattataattttgcttaatttaatatctaaatctaaattctaaaaataaatcaagagacagagagaatgaataaatgtcatttatatttagaagattctaaatgatatcgttgaagggaatcttttgcaaagcgatgcgtgctctgctctctcgttccggaccagtggaaccgtggggtagtgtttttcctgcggtgcaaggagaacggatcctggttttttcggatggcttgtgtaggtgctcctgccaatgttgcaggtttgcaatagcagttgcaggttgcgtcgatgccctgttttaattcagaccaactgtaaaactgacggcttgcagaaatgtttacttcaccatgaagtgtgaggcaagcaaataatctacccctcccggtagcatcctgcatccaactatccaaacaatcagatgtgcattttccacaaacttgcgatggtagacttgcagaacctgatcatggaacggccgaggcaggataatcatcattcaacaaacataacaggggatcagccattgaaatcaaaactaaggatcataacagctcaatggaaagatggagcactggcactgaacaccgaccgaagtgaccaaaagtacgaaatcatggcaattggttacagtaactattcaatttcaggcacagacaaagcttcacattctaagaaacttggtgcagaaa

SEQ ID NO: 4154 - DNA, 1052 bp, Zea mays
  misc_feature (1)..(100): optimal_loci_46249_G1, chr1:270986600..270987651, Cluster 25
gcttactgactatatctgtttttttatataatggataaagtctggcttcgtatcttggaaaaaaaaggaactagaaaacttattacaaaagtttgatataacataaactagatctgccatcatccaaaggcagttaggatttacaaagtcttcgtttaattctaaccactactacggactagaaaacatttatagacttgggcacttgctggctacttgacctgtctctacccgtctatttctagctagaaaataggttgtaaagataagctcatgtgttggtttccttaccaactgtatatattaaagtaatttgtgaaatacattccatttatattcactttactgacgactatctaagatcttaaacaaattcaaatgagaaaatgtatgaacaagattacaagagagttttagatctctttgaagactgcaactttagtttaggtcgtttcttcgttccgaggtcattcaaaaatatttatcttagaaaccaaatatttgatgtccaaatgtttttaaataaataaaaaaattatcatctaaaaagtacatctgtttccacaagcctagccacagttccttttgttttccttttcaccagatcgtctcggcatccatcagtacgggcatattcctaggcaacagtagctcttgcgtagcgcacatggtgaacgttatgcttatgccgttgcattcgtcacgcgaggaagattcacggatgcttcaagagcgaatctaccaaaagtaaggggggcaaaaggaaaagttggatgattatggtcaagtcaaagatgggctggtatggtatggtatggaatggaatggacggatatttttttatatcaccgggtttcattattttggctatagattaggaccaacaacgaaactagcgcatcaaatatattcaggaatcacgtttagttgggttggcgcgttcagaatctgctctataaagaacaagtagtttaataaattatcagtctacctagtgtcttgcctccaacaaaaatggcatttcttccattcacacaatgttcccatttagt

SEQ ID NO: 4155 - DNA, 1031 bp, Zea mays
  misc_feature (1)..(100): optimal_loci_46940_G1, chr1:274729222..274730252, Cluster 25
cattaccatagtgacactctttgcagaactaggataatatgttacaaacaaattacaaaaaatatgaaaatagaagttttgtatctagggatgcaaatggacacttgatatgaattggtcttttctaggcattcaagtttatgtcatttcttctcctaggcaattatatcatatgatatatcattagcttattttagcgagatcgtagaaaattgaactctatgatatatatgtcatatcttaatagtatatgtcatgagctccatatatcgccagttgaacacatacatatctcagcggaatattttagagagtgcttgactgatataacatgacttcaattttacaacatctagtgaaaaggtctggctttgaaaatggtaagagcaaaggtttataggacttgcataactagtagaaaaaacaggctgtagtctcggtttttcagtcaggactacaaaaccaagattagacctttagtcttggtctagagaatctagactaaaggctctgaggctaaaaaatgttcatgcccatgtggctcgtgagacttggacccaagaccaattactaaatatagggaaattagaaaaattaattaaactctacgatatctatatcctatcttaatagtataattgaggagctccatatatcgaggttgaatacacacacatctttgtggaatactagagtgcttgaataatctaacatgacttcaattataacatctatagaaaatggttggtctagaaaatggtaagagcaaaggttgatcgggcttacgttactagctagtatgaaaatgtggttaatcctttagttctgctcgggagaaaaaccggaaataaaaggtcttccaaggctaaaaaaaatccctcggcacccctatgactcgagtgccccataccttatgcattgcctcactcgtagctttgcacccacctacacaactcatgcatcattggatggatgctttccttttaaaaactgaggtctttagatgaaatgttttcattgtaaactaaccc

SEQ ID NO: 4156 - DNA, 1128 bp, Zea mays
  misc_feature (1)..(100): optimal_loci_47452_G1, chr1:278174738..278175865, Cluster 25
tgttacagttccacgcctattccctatctgaaagctgtatatggaagcttttagaccgttcaaccttgatctgatatatgctcataaacacagtaaggtctgaagttctacaaagcacaccaccctagttgagcgtatggttcgtttctttaatttgtctgactttttttagaaacttatttattacggaatatatagagaggatagtttctatatatgacatatatatatattaattagtaagtataaaaactatcttgtatttttgggttggaaccctaataaattccggttattagcaaggtacagtgtggatcggatatgttgaaacgcatgcgtatcaatgatttgaccaagtcgtttacgagaggtacggttttacataatgaaatattatcagctacggagtacgtactagacacagtacaaaattttataattcaccacccattagctaatttaattagctgtattccatggtccattcttacactgtgggtgaagtgagaggttcgttatgaccccacatcagcgagctttcggctgtaaacacgtcgtctagctagcttcctacacctacacccagtccacttcgaaaaagagggggggcggggatgaactgccggtgaaaagggcactctgaaatataaatgaaaacaacggctttttctatgagcttcgaggtaacataaacaccaggccgtcttgcccagccgatttttggacaagccattcatattcagactcgtggaagaattcagcttctgacaggagccatgggttgcataaacaaaatggtatgatgacaaaggaaattaatttactgtcagtaactcttgctctctccgccgagacgaactgtggtccattacgtacggactcgatgcttcgaccggtattgaactatagatgtaaatgagggatcaaaaaatctcggtgcataatgcatgtagtgtggctcagtgtcgcggtctcgatcgtgtagacaatgaccttattttcggcctcacctcactttgcaactttcgttttcagataagaacatacatactatagtctctccaacgaatacggcgtgaatctatgatccttaattaagggtccaccaaccatccttttaagtttaac

SEQ ID NO: 4157 - DNA, 1324 bp, Zea mays
  misc_feature (1)..(100): optimal_loci_48100_G1, chr1:281299209..281300532, Cluster 25
tgatatgacttcacgctttattctcgatctttgtggtttggtgaaatgatctaatagacttcataatttgaatgttgatgaagatgaccaattggcttcaatctttgtttacgtgaaggatttatgtttgcctttcctattgcttttgtcttagacgaagttgatcatgaaaacaggcatcgagtaaaaaacagaaggtaagcgttaaccaactttgaaatgctagggattgcttttgtctgaggccaaatcctaagtagtaggctattgtattgtgtaaaggagatacactcatagttatatccagattacaatagaggtaatcgaagaacaaatttgaatgaattagatttccacaaacatcaaagaacaatgcctatcaaacaattcagttcgttctgatccatctaaataataatggatttgaacaaggatggatcaagtcaaatcgaaggaggaagaggtggaagttaacctatgccgacagtctaagagaggaaatgttgttaccaatcttcatagcgggcatggcgccagcaatgagtaagagtcttggtcactcgcgtaaccttgatttctattccttgaccacttgttatatggcaatgacatcgtcgcttttcccttgcatggttagagatatgatgaccgtctgcgctagctctacatcaaggccctgaccatccttggcaactttgccgtcgttgagctatagtcttagcattcttccatttttcatgtgcgtggagctagttttcttagttccgcccgcgaacaagataacatattaacatgtgtgttattcttggatttgaaactagaaaccaatctgacttgagtaaaacctttgattttggttccatctcggatgttgtgccagttggtttctcgtttcactgaacccataaacagataggactctctttcttaccacttatcatcagagacggtgaaccactagacatcgatgatggcttggatccctagctcaatggtggtggcgaccttttgaggggatacaaaagccaagtcaagcttgatctcaccttaccaaatgaggcgcaaccatgttgaccaattttcaccatatttttggtcgctagttgttacccctttgttctaaattataaggtacgttagctgcttgacataaggtataataaaaagcagcatatttaaagttaaaacattttataatttaaagtatataaagtaataatctttagtctaactgggatttactcctttcatcaataaatgtttgtttgtcactatattatttataccggtcaattttttttaagtttaactaaatttatataat

SEQ ID NO: 4158 - DNA, 1021 bp, Zea mays
  misc_feature (1)..(100): optimal_loci_49508_G1, chr1:287121910..287122930, Cluster 25
aacggtcgcccttggtagcccctttgatgcgatcctggatctgtcactataaacctgtgccaaacttatggtctatgtcgtggtagtaaatttaagccaatatggcaattttatttctttcggtgataaaaaatatacaaggtttcgttcaagtcctaaaactttcaaaacgttattagcgacttcgtattcaagatgtggtgacgtagtataacagagcgaatgaatgaatgatagtcgattgggagaacaaatattagacttcgtattcaagatgtggtgatgtagtataatggagcgaatgaatgaatgatagtcgattgggagaacaaagattagacctcgtttaaatgttatgattttgaaaaaaaatagtattacgaaactttaaatttagaacaagggaggtgcacaatcattgtttagaagaaaaaaaagagagagatttagagtggagattctaaaaataaaagcagttttaataatactgcagcttcaaaactagaaagatcggtacatctgaagaccttagctcattctctgtgagagtttatgtacattaaatatgttgcgatgtcattgtttttgataatattatagtatatcaaatgatgagaaatatgaaatatgttttacagggataatcatgcgtacattgtttctaaggtatttgtgtcttgtgatttagaaaataataaagataaaactatgtattgtgtgagactatttcatcatattttcaaacctccttaaatgaatgtgtcatcctagttaattgtgctaagaatttcattgcatttaaaaatttgatacaaatcatctctcgacctctgcaacaatgagatgcgcgtagccttaaaaagaaaataaaaatgaaagaacattgcaagcacattctcaatggctcgcagacttatgactagagcttcactcatgtgcctgggacaagaacctcatagccacctgctccaaagattgcgaagcttatcaccatagaatgttaatcgtgcctctgtagcac

SEQ ID NO: 4159 - DNA, 1338 bp, Zea mays
  misc_feature (1)..(100): optimal_loci_50926_G1, chr1:295789209..295790546, Cluster 25
tgagtttcttcgtgcatcgattactccagggagtgcaacgagccaataaattttccatcctgtgcagaatatccaaatttcccctcaggcgcggaatatcagaaaaatagggtgtggaggattcaaaccctactcacttgatataaagcacatggcttctactactgcaacccatgtatatttgtgttatataaaatagagatgttgtaaatatataaatatactaataatttgaaattttaaaaaaatacagttgtgtttgaataaatattttatttaagcaaggtctacctactatagcaatgtacgtgcaactaactatagatggaaacttgcactttcattggttattttgtgtggagatttcaaattcgagaatggtctctactttattttctatagatgcaaagcacctgttttcggtagtgccatgtagctgtgcttttcaattttgacagagcttttagacatctactgttgttgggtatgtaccttttaagcttatgcgtccgcgtattgtgatttgcttcaaatcgttgtacaaagctagccattagtgctgggcactgataataaggtttacaggtctaaatgtgatataatccaactaggtgttatcctttacactgacaccgaaggcgctaaagaaatgttccgtgaaatgtttattaggacatgtaatatatattacatgtggtcttttgaggggtctttattggactaaataaaaagaatacagtttcatgactttctatacacgttctcttagctacattgacgatccaaattctaaggttgtactatgcaatcttttagtcgtctcaaaaaacgaattagggttgtacatgacctcatttaatatgggatatactcggagtatctgaagagctaattaaaaaatataagagacggactcttcgtgaagaatctgcctctatacgattctccatacattttgtcttttaactgtatttatgatctaggtttaattatcaagattgtatcatgtaaacttttagtagtctcttatatttggaaaactaaactggtgtctcaatgttgttcatgctctaacttctactgtgcccctccttggcttgaatcttctcgcttcgcttttaagactactatgttttgtttgctctcattattgagacatttttcttcccgttgatgacggagtgacatggacgttgcctgtccgtacgctcgcctccggctcgccctcgccacgctctggcatgcatgcatgccgagagcttgcgactctctccctctcggcctcacgctagtacgctacaagagagcacctccatgctttccatacatgaaacaatc

SEQ ID NO: 4160 - DNA, 1353 bp, Zea mays
  misc_feature (1)..(100): optimal_loci_52106_G1, chr2:2090071..2091423, Cluster 25
gtgttagttgtcaaatgtgtcagagtgtcagtcgttagctagcttgttaattagcccctgttgtgttgggacaacgtacttgtcgggaagaaacggctgcaactcaagtgtgctgtgtgcttcgtcctcccatctcgatgcacgaggtcgcggcacctaccgtcgctcatcagttctcgccttgttttcatgtcgtgggctatgctgtttatgtttatttccctgctgttggtgctagcgtacatagcagcagatgtaccgtcacttcattagctttgatctacgtactgtgtgtacatgctggggagaataatctgagtcgccgccacatctctttctaggactgcggacacacgcacatgacatcaccgctatttctatcactgctcgtggtgctatagcacaccaacgtcatggcatttcatttcctcatttgtggataccgttgtcacggtgttgttcaacaacgaacttaagaatcattggtgaacgcacgcgattgtgtatggctacttccattattatattggtgcactcttctttcattatgttgtgtgtctagtgacgaaaacgatccacaattctctatttaatttgtatgctatcttagtcaaacaaggtagatatgttgtgtacagaaaatgtattgtttttatattaattaataatgaggtatgtttattataaagatattagagatataactactgctatttttataaattcagaagaaactaatcttgaaagaaaatctggaccgctttaaatcttggattacgcagtgttctttccgacaggcaatgagacaaagtacatgtgtcttgagctttcagagcgactgatcactgatgtgccatggaaaagtgacgtgatgcggtgtcgaatgtgttcttgttgcatgtctacggatggcttttgcgagatcgacaggtgggtggtggcgcagcggcagcgcagatgacaccatgcagccagaacccgcaagctaggtcaagaggcgaagggcaccggcatgtgtttgcgcggctcagctagggtcaccctcgtgttctgttgcttgtctctcgtcatcatcgcctgggttttcgtcttgccggtgcaaacttttgcaagcatgacagcatgtagagaaaaggtttttattctaacgtctcttcaaatagaatttaagaagtggtttttttttaaaaaaaaggaattaagaagcgagttcaaaaaaaacatgatagaatttaagaagtgtttttttaagaatcaagaagcgaattcaaaaaaaatacagattctcttatagataccgtttcagaggtcttcgattgatttttttttccttctctcgaataaaacatatac

SEQ ID NO: 4161 - DNA, 1055 bp, Zea mays
  misc_feature (1)..(100): optimal_loci_52584_G1, chr2:4311913..4312967, Cluster 25
acctaaaaatattttatttcgttgaccacttgaccacagcggataggcccacgtgctccacaggtcatacgatctggcgcggacccagcgcggctaacaccagaccatcgtcatcgtcagtcaggatgttcattcaaagaaggcaatgcagtatggactatctgtgtgtatgtgaaccatgccgacgatttctatatggttgtcacgagggtgattacagaattattaataatagaaatggtggatgtgtgaacagacctggctgcccgaacttttgggctcttctcgagtgagagcacagactcgtgcaggcacggcgcacgaccgcaccacgtttttcctcgactggcctgcgttgcgtgcgtcacctccagtcagcggtcaaggtggaggagagatttaacttctttcctctttatgaaagcttcgcttttttcccatttgcgtcgtgtttcgaaaacgtgttcctgcagcgaggggggaaccggagaagagagatacgtgtggtgtgtctctttttcccggacagattactaatcgacgtcgtgacggcgaagatctctgaccgtggagcgaagtgtacgctcgacggctctcgctcgtgcaggcactccatgcatctgtctagaaaaataaaaaatatatcatgtataaattacctacttaatagatcctagctaaaaacgtacaaatttaaggccatattaagatctactagctactaacaattataatttcacctatctaactattagttggtttaattagcacaatcaacaagatagttattagttggatattagctaacaattggctatatctttttaaattttggattcaaaagtactaattattatctccatctaactattaggtccaaatggatcctaaggccatgtttagatccattaaccgctaacaactagctcatagtatcaaacatgctacaagtctagtaagtcaaattagctttgttttcaaaagatatatgtatagagggtatcatcaatgactttaagtatgttatgtatactatgaacgtgtattttagatcc

SEQ ID NO: 4162 - DNA, 1148 bp, Zea mays
  misc_feature (1)..(100): optimal_loci_53452_G1, chr2:9103803..9104950, Cluster 25
tatgatcagataaaatattgttttgtatggtaaataacactgtttgtaaagtaaagtttaaatatagatataagaatggataaactgccgttggatagcctaatggaacggtactcgtgctagtccgacgtgtttgaggcttaacccaaacatagcacgagctccatcatcttcttgagggtcgtgcatcagggcctacatctgttgaacacctataccacgaacataaaagtatttcatgtgtttggttgtccaagtgagcttgaccaagctctaaacatgcgttgaccagatatcggtatgcgtttggttatctgaacggaatagacgaagcttgcatctgcgggtgcaatccaagccataaaattaactgcacggacgatcccacggaggaatttacagagacgtctatgctgacgaagtgacgacttctgttcatcagctttggtcagagctattataactcaaatgtttttttcccttaacgtgattctgactttcttagcctgtggtcttcgtttttcttctggcatcagctgcatgaatcttgttgctcctgaaagctcacgtttttttaagaattcaggggcacacggtcaactggtgatgggttaatttgtgcaggagtcagtctggagatcgagctctgcatagggcgtttagaaattggaatggtcgttgtcgcactgaataacgttacaatttaccggttcttccgaagaatccatcttttccacatgaaatatcttccttgacaacaacacgcctagactttttgtgctcctgatacaagagcaatgagcagacaccaacgaccgaccgaaaaagaaaattagtctagttcctatgcagaatggagtctatccttctgtctggttgctgcattgtggtagactagccggagtcaggctctttatatataggctaggtcagtacatagccttttgtttggttgttcgcattattgcattcaggactacaactcgtgtttgcttgcttgcttcagaacgtgtactaaagaagagcgcataaataaatctttaaatattatacaacatgtttggtctagtttattcgtaaaatattataaacataaatataataatcggttcggtgattaaatagtttaattaaaatatataataaaa

SEQ ID NO: 4163 - DNA, 1020 bp, Zea mays
  misc_feature (1)..(100): optimal_loci_54700_G1, chr2:15553284..15554303, Cluster 25
aatactgtatctaatgcatggatgcaaagaataaaagtgaatcaattaatatgagtatataggaagatctcacatcttgtgttgatgttttaagtactatgtaagtttttattgatggataattgtatcttgtgttagcggtaacatgagtttttgacaattgtccactatggccctattgttgggatcttatttttagtagagattttctaagaaacaatctatctagataatccactggctagacaatctaagtgtattggtgatcctaattttttatttagatgattacatgtcccaagtgagaaatgacctgaatgcccctagattgatggtgccttattttgttgatgaataagcatgatttgcattattcgaacaatgtttctaggttgtataaagattgtaccatttttccttgaaaatgttagggtcttcacatttaaacacaccttcaaaagtatgctggctaattcaaaattcataaatgtgtccaaaacaagttagtccacataataagttggcaacattcactacaaccaaagttaatgcaatacattcatgcaaagttttgatatccatgtcatgaaatatgcctaatatcttgtatagcttggccaacttgatacccatctctcacataactctcaaaaattacatcatgcatgacattatctttaataaagttacaacgagccatgtaggtagaggatacatatagatatcgttgatgttacctttattttcacatttctatttggaatcatattcgaatacgaaagatatcagctatgtcgtataggatatgaatgagtatcgacatcataaatatatgatttaggtatttagatacaaatatggtatttggatagattcgaactaggatacggtcaaaaaatattgcaccctatatatatttaatcacatttgtttcttgcttctctattggataactatgcaattctaagaaactacaccacttcacctttagaaatgaaacttaaaataaccctcggtcac

SEQ ID NO: 4164 - DNA, 1028 bp, Zea mays
  misc_feature (1)..(100): optimal_loci_5553_G1, chr1:28461718..28462745, Cluster 25
aagcttcatggtagtctttggttggtgcaatgactttcgagaaggtggatatcgtacaaaattcaatataaatcttattatcaggttctggtacaaaacctaatacaaacctggttgtgagttccatcgcaagctccgctgtgcaaccgcgctcgtgtagttttaaaacgcgtcgtatttggtttgctaatctgctcatatatacaggatagcgccatgcaaaaggtacgcctgagccaggctagttgagctatcgtatagcctcctcagcaagggtttttattttaatcacctgattattctatataagaaaacatttttatggttagatatatacatgctgaatgttacgcttagcagggataaagggggggggggggggggcatgggttcttcgttagcatcaaattgggcgaggttcaacgaacctgggacggtgatggcattgcttcaccaggtgctaagggaaagaaaaaaacaatcaagaagctaggaaaagtcttggccaccatatattgcttgcactagaacaacaacatggataagaaacactgcaacaccacaaagtgcaagtgggagctcctatgatggtcgatgctgttttgctttgtttattgctgctactgcttgtgatagtggacaggtaaaccactgttgtcattgttgggaatatgggtattgctgtgctacctggccccaccacaacactttatactattattaggaccgtttcactttatagagtttttaatactcacctttggtcatggcggatcatcagtcgccatgcgagcctttgttaatttttaacccgattaggtggattgatcacttactaagtactctacctttctattctaaattaaaaagatattttagtttttcaatttttttaaaatatacatcaagacataatgcatatttaagtgtatattagaaaacaaatatttagagagagagagaaaaacaaaatgtctcgtagctacggaacggaaggaagcgtttgacatagtatcagcgaattgttt

SEQ ID NO: 4165 - DNA, 1067 bp, Zea mays
  misc_feature (1)..(100): optimal_loci_557_G1, chr1:3049957..3051023, Cluster 25
gaaaaaaacagaccatggtgacaagagtccattatgggctaatagatttgatccaagactaaagagcagatccagtgtcgaaggctcctacatgagtgagctccagtgaagtgataaaccgaggcaagcttttttctggtaaatgcgaagaggctacttcgaacacatgattttatttaacttggtttgcatttttcactattgaatctaccagaatggtgagtttgcctgtatatgagtgatatctcaaaagactactccactcatgtggcttgcggtcctgcagaatttggtttctcaaaccctcttactgtccatgctagaggttttatatatattttttttatcaccttgggatcctttcccctgtacttttgtagttatctaacagaacacctggcccacttgcccaaatacctctcgcatcttatgggtggcataatgacaacgtcccaaagtttgcctgaaaacgaagggtgtggtacggatggcagagatgggcatcgatcaaggcgaagtgataaatcccgtcactttcataagaatgggaaactcccagcagtagtgaatattttacataatttccatcacccatcaactaacatactgttctgagttcagtatgcattgtgaatacaacgaaatttagcaatctctctgattgcggtttcggttgttaactaggggagaagtgagagcgtgatgggggttagttatgaggccatgtgcaaaggaagtggggagcaacagttggatggggggggtaacatgggagggagcaatgtctgtccatgttactaagtgcatgtatatttgtgtatatagctttcagtcttggctggactcctctggcaagggaataacagccaccaacttaatatccccactcttccactttatcactttgattctttatccttttcttgttcttccgtttggaaaggtaacagcggggctacagtgatgcctttctttattttcatttactgaatttaggcacacaccaagtatttgcaatgtccctttcatattaaacccagctgagtcagtttccatgcttacggttg

SEQ ID NO: 4166 - DNA, 1127 bp, Zea mays
  misc_feature (1)..(100): optimal_loci_55854_G1, chr2:21799115..21800241, Cluster 25
ataaaataactatattatgattatctaaaaacaagccaacaatgcttttatttttctccttgataaaggagttgtaaggcgacattctaacacctaataaataaaacatggaagtaagtacgttatctacagttacaagtctagctatagccctaacagaaacgggccatggcaacctaacatgctaaacaaatacagtagcaagcaagccatagatgatatagatcgagtgattttattggtcacgaaaatgagtggggtcgcaagggatgcatagtaatccactgtcactaaatccaaaattgattactgtaagcctgtaattcagaaatcaggtaagggcgcatttggtaggccttaacaatctaattctaatccaaccaattccatccgcacgctgaccgccgtggtaccaatgtaccatcagtggttcgctcaagcgaagaagtgtcgaagccgcgatcgccaaaagaaccaacgagtggaagcagagatgaggaattgctggggacaggaccgctcttccacatgaaacccgtcgattttcgctttccagaattgcaggcccttggcggcatggcacccttctcgttcactccttccacttggggccatagcttgcctactgattttttatcttagtttacatatgtgctccctgaatagctctataggtacgatatacatgtaaaatttcgagttcagataaaacaaactaaagtgtgatatatattccttacatgacatacaacatatcgttgtttcagtcaaacttttcttaaagaaagatacaaacacaaataactaaactattcagtttaaaaacatgcaagtttaatgtatagatttataaacaaaaaaaatatttgtaaaatcatattaattcgaagggtcttaaggaaatatttaagacaaaattagtggccaacaatacacatcaaaagaccatgtaaagtcatgtgggacaagtttttttttgaccccacaaagtataagcatatgcttaatctaaaacaataacaaaactcgcaaaaggcggcatccacaagaccacaaatcccacgggatagctagctgttattgtaacatttgggttctttgctgctggaaaaggttttcgtaaatag

SEQ ID NO: 4167 - DNA, 1108 bp, Zea mays
  misc_feature (1)..(100): optimal_loci_57037_G1, chr2:28623899..28625006, Cluster 25
acttttaaggagcgctctcattagattatgccacttttatctttgtcatgtgccaccattgtgttccttattattgacgttagtgacattgcactcgctgctcagtgctcacagttccattgatatctctattgacgttgcgttcgaataatggcaccatgtcatggtgcagccctccacaaatcaaacccatgtgttgcctaacatcctacactccactagcatttgctgccaaaacgctcatgatatcaatcttttggaggtgtagcgggactaattggaaaccgactataataaccttcatggtcaacatctaggatcaagggcgaacgaggaacgatgaactttccctcggggtcaaataatcccgtggagacaaggttataaaataattttaacaatggtaacatatttaagtacctttatgtttttagtctcaaatattctgcaaagttatttcaaaaatgcaaaaagatataacagataccatcgttgggataaaaacaaaccataatgcaccatatttacctatataattatttatgcggtactcattgatcttctgaagttgtattatatgccattgcataaagttttaatttaccctgtataaattcgattttcagatcctatttttctggatttttataattcaaataggtaaacccataaagatgtactattagcattacatgttcaaagtgcttgtctaaattataaaacctaataaacatatcttgtttcatgtgtttatattacattgttcaaagtgtttgtccaaattaacaaaccaaataaacacctaatattgttatgatgacccttttattgcaattgctttagttatttgtagctatcctttataagcccatttatgtttttatttaaagctcatagtgcttacatttttaatgaaaattacattatgtgtattacaaatgttccacgttatatgttgaccatgtatatgtagcattataattgctactgcggatctacactagatctttaacctagtgactatcctcaatatacatacccaacatcataaattggaacaaatgttctacatctatttaaaaaataactaccactaaatcacatttcc

SEQ ID NO: 4168 - DNA, 1404 bp, Zea mays
  misc_feature (1)..(100): optimal_loci_5976_G1, chr1:30249559..30250962, Cluster 25
ctagtactaggtccacactacatgtacatttggaagctccttctaatgactcatgttgcctattggctcccctattggcatctctatgtgatcttgacacttgacagtttaatacatccatgactctccctagttttctcattttctagtgaggtgtccaacctagatgacatagaagtctaggatgaagaagaactttgatagtgagaattcagtccagccagcacattgttagatatcagtggcatgactctcctgaggagctcatgcatgttgtctagcccctcctagttcagaacccttgcgcttgatagcaaatgtagcatagagattatggccatggcgattgcgttgggacaaagactagacaactactactataggatagagaaggcaaaagtataaagagcatttttggcagaagtggatgattgtgcgaggaagcgtgagaaggaaagtgaaatcgtatgctcgtatttaaggacctctcctctctttcaaattgttggtgctaaactcgaagtgtcacatgagtcatacaatttgggaatcatgctacatgttaactatgtgacactttggttgccgataactatggttgaaatcctgagcacgcatgtgggcatgtttggtcttgcatttttgaaaggatagcctcacctgtaggactccttaggcatgttgcttactttcctttgatttttcttcattattttcttttttgttgcaactaccagacttcatgcctaatgtgttgcatggctcattgagatttgagagatgtgagacatgagcactacctgatgcttcaacacttaggtagttatacgtgatggcttacaattggcccctaaaccaagtatgacaacaagatctaaagggaataccttgggagtggctaaggcatggtatgcactagctttgcattggtgggtctctgctcgtagaatggtttgttctctcctttgcacctgtgcttagcctaggcatgttgttgttacatcacctccattttcttgcaaccattaaatctaatagtgaaccccccccccccaacatgatagatctaatctgaggcattctacaaaaagattgctctcacctacatacctcactaggcatgtgatggacctgggagccactatcagtgtgcagagaagggcatatccccagataatgggattgcaccttcctagatcttgttaagataaagctcatactagcctcgtatccttgagggcatgcccaattctggctctagggccctctatgcattgaaagcctgccatgctagggaccaatcccccaagtcggacaagtcttaggggcctacatgctagggtccacaagatcctttaacattctttaggataccttaggggcgatatagcactatactaagtt

SEQ ID NO: 4169 - DNA, 1249 bp, Zea mays
  misc_feature (1)..(100): optimal_loci_59985_G1, chr2:46357032..46358280, Cluster 25
ttacgttggaatacatttactcgtgatgttgaaataagtttctcaacatctactgaattatatgtacatttgttgagccagctttggttaggacaacaaggatgccaatgataaatcgtttgccataacatcttgttttacacaacatttaaactctccttatgacagcatttgtgtgatgaaattatttatacaaggcatcttatcaatttccacacaaaaaatattttgggaggcaaagttttgtcattgtaatatagatttgagggtgaattgcatcaccaataaaaattatttttgttgataagggtgacacattttcccacatatgtgatgatccactagatacaattataatcgaattaatgagaacaattatcaatacaataaactcatataatggagaaatgatggtcattactatgtagcctcaagtggccatataattcatcactaacaatgatgattatattgacataaattgacaacatttttcttcactaatttgtatatttgtgtaaaaacaaacaatgttagacatggacatcaacactagtaagtatggttatttatggggtgaagatcatcaaaatagtatttataatgactagtggcgataaagtcaccaataggctccttttgtggtgaaaaacataattttactataaaattttatgtcataaaatccctttatcctggcagtgtcttctcatcatgcaacacatcatggggtccttatcgctagatcctccaagactaagcgctagcaactaatactccctactctagaacaagcaccttaaaacacgccacaaaccgagggagcatatgaaaagcatgataggagttcaatcttgggaggtagggcaagggcctaactaggtacacatagcactaagacctagaactacatgatctttagtcacttgattttatgttggtgtctgctcactattgtcgtcacttgacatatcgcgacttgataatgggccatctaaatctaagggttggatggagcctctaactcatatgccttttcatgaattattttatggattatgtgttggaaaaagaccaatttggattgagttctatcatataatggttgaacactagacttagcttgtattacgttatggattatataagagggtatccatccgtggatcgtgaggaggattccctattaggtcttgtaagatggtctcaatacttcatgaaaggcggaagataagccattgacttgggg

SEQ ID NO: 4170 - DNA, 1050 bp, Zea mays
  misc_feature (1)..(100): optimal_loci_59989_G1, chr2:46362708..46363757, Cluster 25
ttataatcaatagcaattatagatctatgtcaagtagtgtaattgttgatggtgcatcaacccccttttgggaggataattgggataaggaagctatgaacaccaaattcccaagacttgcttcttttgcattgcattcgaacatatcaatcaaggaagctagagaaacccctaatttatccaccattttgtttctctccctgtcatctcaagcacaccaagagttacatagcatgcaagatttattggtagatacaacgtactctactaaagagaagaatgtttgggttttgcatgggggagcaatatagttttcagttcacaaatatcacaaacacaaacatgcagatacctaaacttttatagtatttttttgaaatacggaagcgcaaatgcataatgagaaccaagttcttctaatggttgctacttgttgataggattaacaccaacgctacttcgaagaaatctgttacatgaccgtgattctcactgtgtactttgtcaggatgtggttgatgaagacattgaccacctcttttttagtgtgctttggctaaacactactagagactacttaacatccggtggaacattatgcccctccaagagagacgggtacatgctttcaaaaattctagattaaaattctttctggagatttgtattattgcattgtgggagctatggaagatacgaaatgggaaagtctttgacatacatgaggcctctcccatctctagttactttgtttcaaagatgaagcttgactccaaagcccgaggcttaggaagacggatcaacctaccctagggttgagtatacttcttttgatcttgttcctttttctcttggtggctgcgaacatcgttaatcagtaaactataatttgtaagtgcctttcttttcttttaataaattaccttttactatgggaacctcacccatagtctttttggtaaaaagccattatgaggtgttgaactttgacacatggtttgacatgcactcatcgaaccattcgatggtatgtagaggtgattgttgaag

SEQ ID NO: 4171 - DNA, 1295 bp, Zea mays
  misc_feature (1)..(100): optimal_loci_62668_G1, chr2:60677047..60678341, Cluster 25
tgtcggcaccggatgaggcacgcggttgggctaggatagaccaatccacgtgatctgatcaaaatttgaaatttatcttatcggtctctttcaatgacttctaatttcattaattaatttattactgacctagaaaagatgataattggctcaagggagctgatcaatgctactagcatagaccaatccacgtgatctgatcaaaatttgaaatttaatttgttgttgtgcattttcacagcgactcaccaactatatcacaacctcatttgttataggtcaagctaggtggcgcgccaagaacccccttgatgcctctaacactcagaggtagtcggagttgctttaggagggacaactgtagtagtagtgcacctcctggctcatagtgtgtcattttcctagatgatcgaccgcatgattccagcgatgacacatttctggcactcccgatggaccagcaacattgaccatcacatcgatcgatctatgttggataaacgacattgaatcatccacatcgacttatcatcgtcaagtccttgatcacctcaagtgtcataccaagggcgtaggatgcaagctaaatttggttataaatgcccaaagaagtcagaaatcacaatcgagagagcaaagtcacataccttcaagctcagctgagatggctttgagctggttgcatagttattggattgtcttttgatcaactctaagttggtggccttctctgtttccaagtcctaccaaatgcttttggccaattagagtctcttccaagttagcataagaaggagatatttctctagtagactctttgagaactacctattaacatcaactttagaaaagtggatttatctaacaagttgagatttaagtgcatacatgatgatgtttatgtaaatcaatggaatactgcttggccttttctagttgtcgtctgccctcggccagatcaatcatgcccaagagatgtttgttaaaacaccgagaactcttgatactttgtatcaaacacataagttttcacattgcataaaatctccttgatgtttgagtctacaccacacttgatgacattgaaagaacactaagtatatgaggactctacaaaccaaagtagtcaaatacagttacctcttaggagccttggagccgatggtttgactccgtggagttgggatcttagttgaggttgcactaggtttagtggtatcagctgcaagacatgtattaggtttatgagtgggcttcttggaggcggtactctcggatgtgtgctttggctaggg

SEQ ID NO: 4172 - DNA, 1294 bp, Zea mays
  misc_feature (1)..(100): optimal_loci_63429_G1, chr2:64934670..64935963, Cluster 25
gtatggttcgtgtaattcatattgtaatgcgtgcatcaatgttatcttatgagctatacttatgtgaatttgttatttctaagtttcagtttagccctgccagttgtcttgtgttaccaacttctaatgttaagtactgagtgtactaatatcaagcactaacactatcggattgttcaacacagttatcttagcctagactagatcacatggatgccatgtggctttacctgtgcttacaataaaaaacgacagccatttagtctaaagcctagagcaagttggggtaggctaggcctactatgtaattgatgtaaacaaatgctagatgagctaaactagctgttaatcaatggatttcctgaaatttattttcaccagttacttacaattcctgaaaaagaagtaagataggatccccttccagtcactcttcggtgactctttttaacattttttcagcattgtcctcttttgaaacatgtgaaagtattcacaaatttaacatgtagaacaaagaacaattgcaatgtacttttgcactaaatcctagcaactttaatggccttttactgaattatagacttgattgatccgagtaacaactatttatatttctctctctcaattttaaagctcattcttcatatagcatacgcttatttacattggtactttatatgttattttctatagttactttctcagcaccaccatctacgaactaaacctgctcagtttggttctgcttcctgatcttcttccacacatagctgtctgcttgacaaatgggatcttgtgacatatataagccaagctaaccctacgtgcttccacagttccatatgttgtgacctttgatccaccccaagttgttagtgtgtcctgttttcgccacccttttgtagccacttattgcctgctatgtgaattgtgaaatgaccttttttctcattgtgaagcgctgtcttgtatccaacacccatgttgcttgaagtcattatattcttgtcttcttgttggcatttactttgttgttagtatttactccgtatatccttattttttagcttctgttttgatctgggctgctccttgctaccccttttcacccagatttacaattaaaagtcacgggactgaatttctttcttattaaatcacagtccaaaatccatacaggacatatagataccatataggtattggatacagtttgtatggttctgatgaaatctgccaaggtgtacccgagattacattaaaaaggggcagacccggtgccaggagactc

SEQ ID NO: 4173 - DNA, 1012 bp, Zea mays
  misc_feature (1)..(100): optimal_loci_6422_G1, chr1:33009809..33010820, Cluster 25
acatgaagtatgggttgttgttcgagccgatggaccagcttgcacctctatcccatcctcatcctcacatcccatgttggagatatcgttgtactcaaggtaggtgttaggtgtctcaagtggaagtagattggcacactgtcttagctcacatacctacaacttagcctcttaagttgtcatggcagcataagaacacatccaaaatggcatgaaaccacatagaaaacttccccttcttcgtgaaaagaagagcaggaatgcaagattttacccgtccgtttttaataaagtaagaaatggagatcctatgtttgaggtgcattgcatagcaagcgacaatactgctccatgtacaacacttttgaggtctagcactatcgcactgagcacaccaccaccacatgtaccgttcaacacctcaacctgagaaccacaaatctactctattcaattatcacaactatttctatacaaaatatacatgcactaggagtctcattctatgaaaacatgaatccatttgcataggtttggagagttagggtttggattgagatgtgccttgagaatgaggatggagggaaagggtttgtcataggttcctccctccattgacaatgaagatggtgatgggtgttgtagccctaggagtcgagcagcatggtgatggaaaggggtggctagccttgtcgctaggaggatagtagggagaggagagaaagagaaagagagagggagataaaatgcaagcatgaaagataaggtcatggatttcttgtgtataaagaaatatctcccacacaggacaatcggaattaaatgtttcaggttgaaacataaacgagtggcattgccatgctgagcctaacattgccacaatcaaagcgacatcattgctcatactccaacatcaaattgtttgactattctctttcctctttgtatagatagacaagtgtgcatactgctcacatttgatggtcactatagatagacactataatttaag

SEQ ID NO: 4174 - DNA, 1049 bp, Zea mays
  misc_feature (1)..(100): optimal_loci_6935_G1, chr1:35881818..35882866, Cluster 25
tcagcacaatatattgcaaggaagtaaattactattgagatatgcaaaccacatcatagaggatgacacaagatattttttccatggtttagtggcttgttaatcattgagtctatgttaatgtgtgagttataaggttaccattactcttgttagctcaaagcccgaaatttatggatacccatcaaggtaggacccaaattgagcactaagctttgagtcgaatgaatcaactaaacacacacaactttagattctactagagattctcttcgccttcctttaatggagatgagctaaatagtccctcacaaagccttctctaaagcaccacataatattatttcatgctttagagataaaatcaccatgccacctaggaacttacaagctctaatggtaacaagcaaccataccagtattatgacaacctagtgcgacacacaatccctcaaacaatgaaccacattagtggcacacactcaatctccaaaggttggcctcaagcaataagtatgggatgaggtgttatcaccaagtgtatgttgttagaatgcacaatatggccctctcttatcatgcaccctactatatgtagaagagtacccaaaaactagccaagaccatgttaaaatattattcatatacattttgtcattctaggcccaaactgttcaccactaaagtcaactagccattgggttgaaccaatggcaccctagacaagaagtctagcaactctgctcgctaaaaattagttgacgaactgtctacgctaataggcaagaaccatccaccattcatgtaatagcacaatgacacatcgaatacaatctaattgattttcataagttgtttggtagagaatctaccaacataggaccaaaatatctaatgtttccaagaaaccaccaaccccaagagcatcacccctttgctttggttcaccactccacaccacaatagagggttccaaagctttacaatgttagtagcaatatgtccaaaaccttttttcaaagtaataccaccaaaaataggctctcaca

SEQ ID NO: 4175 - DNA, 1287 bp, Zea mays
  misc_feature (1)..(100): optimal_loci_7602_G1, chr1:39898906..39900192, Cluster 25
  modified_base (104)..(104): a, c, g, or t
  misc_feature (104)..(203): n is a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
  modified_base (165)..(165): a, c, g, or t
  modified_base (166)..(166): a, c, g, or t
  modified_base (167)..(167): a, c, g, or t
  modified_base (168)..(168): a, c, g, or t
  modified_base (169)..(169): a, c, g, or t
  modified_base (170)..(170): a, c, g, or t
  modified_base (171)..(171): a, c, g, or t
  modified_base (172)..(172): a, c, g, or t
  modified_base (173)..(173): a, c, g, or t
  modified_base (174)..(174): a, c, g, or t
  modified_base (175)..(175): a, c, g, or t
  modified_base (176)..(176): a, c, g, or t
  modified_base (177)..(177): a, c, g, or t
  modified_base (178)..(178): a, c, g, or t
  modified_base (179)..(179): a, c, g, or t
  modified_base (180)..(180): a, c, g, or t
  modified_base (181)..(181): a, c, g, or t
  modified_base (182)..(182): a, c, g, or t
  modified_base (183)..(183): a, c, g, or t
  modified_base (184)..(184): a, c, g, or t
  modified_base (185)..(185): a, c, g, or t
  modified_base (186)..(186): a, c, g, or t
  modified_base (187)..(187): a, c, g, or t
  modified_base (188)..(188): a, c, g, or t
  modified_base (189)..(189): a, c, g, or t
  modified_base (190)..(190): a, c, g, or t
  modified_base (191)..(191): a, c, g, or t
  modified_base (192)..(192): a, c, g, or t
  modified_base (193)..(193): a, c, g, or t
  modified_base (194)..(194): a, c, g, or t
  modified_base (195)..(195): a, c, g, or t
  modified_base (196)..(196): a, c, g, or t
  modified_base (197)..(197): a, c, g, or t
  modified_base (198)..(198): a, c, g, or t
  modified_base (199)..(199): a, c, g, or t
  modified_base (200)..(200): a, c, g, or t
  modified_base (201)..(201): a, c, g, or t
  modified_base (202)..(202): a, c, g, or t
  modified_base (203)..(203): a, c, g, or t
acctaacaaaaaccataagtcaaggttcaagcacttaaacggttgttttccacgtacttctatttaaagttaaatctttgggtatgacgaatctctagattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggggggggggggggggggggggtgtcacgggcctctaggtacgtttcgtccgggagacgagacgggcgggcggtccatgctgcgttccctccttgccgggcaatggttaaatgcttgttgacacacttcaaatgtccgtaggatggtctggcctaattcactgatatcggttcacaacgctagcacctgtgaaagatggttcgaaccgatttgtttttaaatcgacttttgttgtacaaaatttagataacacgaccctctctgtatatgagtggatcatggtcgattgagataagcaacatccgaccgaacaaaaaaccaatccaccgcctctcttttgccctttcaatattcatattgtttttttatcgatagatccaatgaccaaagatgacgctctagacttgtcaatcgacctaaaataaaccgactacatccttgctctggtaaggtccctcctaaattttggctttgaaggttactttgctagtttacttaaaaatctttgttacgtaagcgcgattgattattctttgatggttttctcataaatccttttgttcttcactatgtaatatcctcgttgtgtccatggtgacctagatgatgtaggcctagctggtgtgtgtgatccaattctgcgttaacacatcttttgacagctctgttagggaagaattgtttcgcccctacttcgtagatgaacctctttaccctagccatattattcgttattaatccatccttcctatactcgccattaccatcgtatctgccctaaaaggtagatcacatctagttctaacctccttgtgaccttgcttactattgtgcaatgtgttgctataaaaatccagctaggcaccgaagatctaaaatcatggagtacctaggtatgacactataaaactactacacttactttgcggtacagcttacaaatgcatcatatgatttcaataatatgtattgaacaaagcaagatacctactagcaagaggtagcaacacaacaacaattactactaagtataatcctcacaaatctagttgagcaagtattgtacaacaagtagattgatg

SEQ ID NO: 4176 - DNA, 1247 bp, Zea mays
  misc_feature (1)..(100): optimal_loci_7686_G1, chr1:40202561..40203807, Cluster 25
tgttttgtgggcataattcttacataggaacgtccaagtgcaggagtttttttggtgctgtctaatggtgaatgttgtagcgatggaatgaaggagtattgtgttggagtagactatgttgtttctttgttgtccaaaagaagcttaggtattgttttgtgtcgaccatatgaggatagacaatacttgaaatacttttgtgtcagtatgaaatgagtattttgtgggagtaaccgcaaaaaatgtatattttgtggaaacaattacaacgataccagtaggaattgtagggcaacaatatgatttgtaacattgtcgaagcaggacatttcagttgttgttctgacatctataaaatgatagaaaggaaaaataacacttttgtacattgtgattgagttgtaagatctacctgattttgtgtcccgtcaagttacactcggagcggcgatacccggtggaatcatcaattgttgttctaccacacttagtgcaagaaggaatacaccaattcatgtttttaggaaaccaattgtaggagcagtgcattgaaactgttccatatgtaagaagtaataataatttagaatttatttaaaatatttaagcatagtttacctgtaaatggattagagcgttgtgtgccacaaaaatatatggatccagtgctagcaattctttaagagttctatgttataaaacatgagtttcatttgattttcctgggcattccaatatttttgggagctccaactctattttttgagtggtgaatctaagtattacgaagtgtgtgtgtgggtgcaaattaacatagcaaataatatagtacatggaggcaaatatttatgaaaaacacatgtttccaagaatggacggaggaaaaaatctattgcaatacacaaaagcaaaacgactaaaaaacctgagcagcagcaaagtgcatgaagcaatcaaacttacagtagaagcaattaacttgtagtagcatgtccttgtttacatcagcatcaagctttatagtcgtcccctcagtggtagctagtagtatgggttcttcattcgctttgtagggagctcaaattttatagtgttagtgcctaggggactaagaaggcttggatgtgttctctttataattgtctcgagcatctacatcatccttaaggtcacttcactgaccataattttttagtggccagtttcataagcttcttcttttgccacctttggaatttccttatttg

SEQ ID NO: 4177 - DNA, 1005 bp, Zea mays
  misc_feature (1)..(100): optimal_loci_78771_G1, chr2:163932957..163933961, Cluster 25
ttggttggtggaacaagagggatttgtggtcggttagatgctgtcactaaaaaggaaatgtttgagtggtcttggtcataagagatgcaaaaggtgttggctctagcgctaaatgtacagtaaccataggtggagcgatgatgacctaattggctgacactgttagtataggtggcataacgacaagtcactatgatggatggtatgtgaagggtagtgaatggtagagcctaaggcaccccattgaagcatgtagtctgaccttgaattgctgtagaaaagtcaagcgtcatttggtagactagcaaatcatactaatatagactccaaccttataatcttctagactatatagttggggcaactggagtttgaagagcagttgaaggaactatctaaactagtggtgctactccagtctactagagaacatgataaaagtatgcaaagttttgagcattatccatcagcaacaactgctagaactagtcttaatgggtctgaatggtcttaaagagtgttagtctgcctttattgggcatttgactatcaatggtgcttgctcggcctcttatctgagctccttggccattacttgctattgcttgatgcctagtctatgctgttttgtggcaagcagctttgggggtggagggactgtgctagcattggaggtggaggattgtgctagaaccaacaaactttatggggtcttggtgaaggtgctagaggtgatagtggcaacactacaatccacattagagctatcatctataacatatctctacacgaacaattctgaagctctaaatggactaccccttgatggccttgtcatactcttggtctcgccttagttgtctctaagagatatcgagttcatggtgactaagagcatgagcacttagatgggcatccactacaaattatggtctatacactccataccctcttacaaaattctcaagagtcatggcccactacgaatgattatttagccttaag

SEQ ID NO: 4178 - DNA, 1321 bp, Zea mays
  misc_feature (1)..(100): optimal_loci_81992_G1, chr2:181837908..181839228, Cluster 25
taaggatacttcataacctagcatccgccttgatggcggcaaacatgtcagggagaggggggctatctggatacactaccagaatgaaatatttattcttggttttggaaggtttcttagtcttaaacataaatacattacactgatcaagcagcaggccaacgacccgacactgaccatggaccagccaccagccgaacgcggccgcgctgtatgttttgatcaaatcttcggcagttgatacaatacaatactaatctcctcggtagctatgcctattttatcaagagtaatggcagtcagagagcggctaacatgccatgaagggtctctggtctacctttggatgctgatccggtcttgcttgcatgcattgtatatataagacataaggcttttttattattagtagctgtttgatttttacaaagtccaaaagccattagtcttcagccaaaaagtacgcatgcgtactataattctatatacttgtgcaacaagaagctgcaacctgcaagttattatgcactagaaacctcttgcaagcaaagacatcgtcgacgacaccttgtttttcctgcctttttctcttttacattttctcttgggttgcaacttgcaagcaatggccaagaaggcagggaacgttccttgtcctcctcgtacgtcacgcacgtgtccaaagaaaaacatagaagaaaaagaaatgctgagttaatggctaatacatttacaaagacaaaagcatacatctacccaagatcacaaattcaacacctaaagttcataaaaaagcgtatcatatgtcacaaccaatctctctttttttatttaaaaaaatgtttaacggcacctctataatcagaagggcgacaaattacaatcagttttttagaaatgctgtatttttataaagcgaaatgacctctagttaagttggttaggtagttaccaaaatagagaaatagaagtgcatactattgagaagggcatgctgctttaccctcaccactaattgaagcacagatcaaaatttaccagcaacaaggagagaaaatcagggttcattttagatccaagatgttattttcttatagaccaatgacactgagagaaaccaaatgcaggagtaggtaaggaatattttgtgagcatcatatttggtttcatgtagcactcgaatacctgattttgagatgcataatgattagcaactgcaatcaaactttagtcaaattaagtagaatacttaattccaattagggagccctaattcatcttggtgcattctaactctttgaacatcttgtactaagaaaat

SEQ ID NO: 4179 - DNA, 1190 bp, Zea mays
  misc_feature (1)..(100): optimal_loci_83642_G1, chr2:190866264..190867453, Cluster 25
tgacatgtacgaatcgaggttgcgaattcctccagcattgcatcctccgtgatgtcacgacccatgattgtggtagtccagtgttaaggggtcgagcttaggtcggccaacttgccacaatcagcccaaactggtgcaacatcgttttggaggaactgatcgaccttattatcacccgaaaaagtctttttgtcccgttagtccaaaatggattttggcgcacaacattgtcaaactcagaataacgctagatttttttttctgcctcagctattctaatctttaccttttgttttctaattaaattgtaagttatgttttagcttagtttcaagttaaatctatttaattttaactaagttttatgaaaatacacaaacatctataggaccagactatatacattagatcctgagatataatttgattttatagactttaatatatttttctatgagtttagttatttttaaaaaaagatacttattaacgaaactaaaatgacccacactttagagtagaggcaataatttattttagctttatcttaagtcaaaccggtttaacttgaaataatttactaagaaatatataaatatttaaataaatgttctactgctttcaaagagaacttatcatataattggttgaatggacgagcttggtcgatccgttcgaaacgagatgcctcatgcatacctacgcatgaagctaggagagatgtttaaagctttggcatcgcgtacacatgcaactaagcaggggctaccgtttaagtcaatgcaagtggaaagtctggataagcttaaccaatcaaacgattagtgaatactaatgtgttgcccgagatgtttgtctactttctacataaatttggtttaagttaaatatcttaactttggagaaagttgaggtgaactgagttttggaacaaatagagcaattttttgtgtttgtttattgatgttcagatttcagaaatcgaatttgacataaaattgcaatagatggccgcgggcccacgtcacggccacacgggagggccgcaaccgaacttcacactccgacggaaccaattcgcatccgcacggacggaacgtctgaaccccaccgccgcaccgcgcgcgtccatcccccaatgcccccagcagcggcagttcgtcgggctccctcgccggacgcggcgggcg

SEQ ID NO: 4180 - DNA, 1100 bp, Zea mays
  misc_feature (1)..(100): optimal_loci_8391_G1, chr1:44169956..44171055, Cluster 25
ttaaaaactagtaagtattgtaatatatataaaataagtatcgttaaatgtatataaaatacaaacattaatacattttttatataaatctagctagtgaaagttaagataattaaaaactagattttatgctgcagcaaacattcagtggccaccaataagtctcgtcatgcggacctggtgcaaactttgcaatgcccaccaaggcaccaatccgaaaaatagttgattcagatcctttatccacataggagtgaacgattaggtaaactttgcaatgcccggggctttaactttggttagaacttagtagaacagagagacttcataataagaaatgtaaaagcttcccacggtggttcatcttttcatgaagctgatggcagtggcaagctgcgccgcgcgtgtgtatctggacaaccggaggaggacatcacgaagatcaactcaaattcgtcagtaccacctgcagatctgcttccacttcatggccacgttttccggaattcttctgaatttctgataccgagcattaccagaatgcgaccgtacaagcttgcgcaccccggccctgaaagtggagcaaaagcagcaccgaggaggcatcggaacctggaaactttcctgtttcgaccgctcaatgtcaatgcagccctgcaacagctgggtggctccatgcatggtgtgaagaaccaaaacactgctgcctttttccggcctacatccatgatccgccaagatgtttctcgatggtggtagacattttcagtctttgcttgcgagataactgatgacgctggatgatgaagtccactccgctgaaactgcaaggtttgaaggctatgtgtatgaaggtgactggtcactaatctgcttttggcaagaagaagccacatcccacagcccggatgttgatctgatgcacaagtcagagtcacaaaacgaagcagcggcacaatgccagtctgaaaagagttcaaaattaggttgtatagcattaagtttccttttaggaccagtccggctctagaaaacttaatagagttggtgttatgtgctaaaaaaatcgtgaaagtaaaaaatttgaaccttttgaaaac

SEQ ID NO: 4181 - DNA, 1013 bp, Zea mays
  misc_feature (1)..(100): optimal_loci_87009_G1, chr2:210723636..210724648, Cluster 25
ttgatgactacaaggggtgaagagtggagctaacatatggtaactcgaggttgacaatctatcatattgggaagacgatccttccaaaggtatgatcctcaacaactccggtttgagagtatatatcatgtccctggtttgaagagcaatttgttatcatccccttgattggaaagaagttcattttggccataacatgtgcccatgtcttagagagcgaaggtggtcgacttcattaattggaattttttttggaagattgcctagttggaggaatgatattggtgctacttataagttgattttaagttcaaattttgatagaaaacaaaattactctagaggccatctagagaacttttttctatatggggtataatttggaccttttttagaaaacaaatatattaatatctacatctaaacaaatacatttgttaaaacacatctcatgaacaatttaataaaaactagatgctttgtacgttggtcactttatccctataaatttagtgaaaattagacaagtctaaactaggagcttggacaaattcaaagtagactatagtttagaacaaagagatcggagtagtaattattagaatgcaacttgtcaagaagtcaagaaccatatgaaattgaggcatgtggactagatagttgaaacgatgcgcaatagtgaaagccagccatgttggaccgttgaagattttgctgtacgactctctcggggttgaccggtttcaaaaagccaaagagatcgccgtgatccttctcccgatctactgtattgtagttgagatttgagaaaggttccgcctttttattaaatgcaaatcgaggtaaaaagacgcgccccagctgcatgcgacgatcataacgtgccagtcacatgcaactacagttattagtcgcgcatgcatggtcttggtctaagctttctttcggttttttttttttgccgcgtatgtatgtggttgacgagagatcctatggacctctatttatttttc

SEQ ID NO: 4182 - DNA, 1181 bp, Zea mays
  misc_feature (1)..(100): optimal_loci_87130_G1, chr2:211245074..211246254, Cluster 25
cctggtgatcacctaatatgcggcaggaagaaaacaaaagaatatgaaaaaggcggtgaaacgttgcaatctcatgagcacctagatcaagcactggaattagtgggcagtactggcgcctttacgcatcacatcgatcggcacaacgctgtagaaatgtcggtttcctgtcccaatctttcagcacgtaacgccacttgtcttgcactcatgttcccacatcagcaacgaattgagtttaagaagctaaatttgcatataaatcgcaacacaagccactttaatgcgaacacatctgtcaggattcgatggattggagaacgatgtgacatgtaattacatcggacgagatcaattgaacggaccaacacatggccggccgccgctacgattggagaatgatggatctgatctgatgatgtgtcagctacacagttttttttttctttaacgaactggcaatttcctactgtttgctggttctagacttctagttcagtagttctgacctctttggggctattgtttcgttgtattttcttcgcttgggtcttttcttattctcagtacgatcggcgtgcgtgtctcttccgtctaatttcgttcttcaaaattttcattaaacaagactaaagtaatggatggatcagagtttgttaggaaccttgaggcagaatctagtgtcccagactgcgtcggatgatacgtgtgtgtgagattaacgggccaactaccccgtcttcagcttttccggccggctcacacgattccaacacgcccgcatgccggtggaggtaattaagacaactaataattaccctgacatgaacacgtcgccattgcccattggtcgacgacactgcttggattggatttcgcacagttgtttgagttgttttcaccgacaagggagatcaaatggggaattagcaacgtaactcactgtgatttttttttgatatatattcactggggttcctcgtactgtttcttagcttccgtacgacttgtacatgcacttttatacatactgtatatattttcccctctccttggcaacagcaaagcttagatttttgggattttgtttattaaaaaaaactaggaaacgactatggcagaagatgctataaaaagaagtttggaaaagaagttattcttcagctattagtactatcact

SEQ ID NO: 4183 - DNA, 1058 bp, Zea mays
  misc_feature (1)..(100): optimal_loci_89921_G1, chr2:226194062..226195119, Cluster 25
aacataggatgtgatgtgatcatggcactactgatgacggtttgccgacggccacgaacaatcacgttgcaattcatccgagcgagccgaaccaaatcccatgaaaccgactgcaaaaaaaatgtagaaaatcagattgttttcaacctgtgatggattgtttggcagtactacctaccaacatgcaccgtaccaatacgcgcggatcacaccgccattatacgcgtttattttaatccaataacaatccatttcggatgccgtcagcttgacaggccggcaagttaatggcctccttttgaattctgcggctctatctaccggtgaacgttgttgtccaagatgcaaactaaagcatgcgtataaagcatatctccgtggttacatgtaggggtagatgtcgatctagctcggatgtcaaataactcggatcggctcaatagaatactaagcaacctagctcagctggacttggttgctagctagagcaatctcgtttgacgcgtgagcctaaggaacaaataaaaatatgtttgtccgattattgtacgtgtttgctgttgtaaaggacttaggcctaacccatgtgccaacctctatgtataatacacacgcgtgcgcacacacacgcgacagccggaacctaatgaaggtcaggcttttctttcctccaacgatgctgaattgtacaagcaaaattagaagagtgtatctcattcatagagttaatcggatctgcacacgaagcatcacattcacgcgcacaagcacaacttacaaatagttcactacacaagttcaaaacataatcggatgttcatagagcacatgtcatgccacagttaaccgatcacacgataatgctccaagttactgcattcatcacaagttgcccaatgtaaaacacaaataatagacgagatgttgcaagctgcaaactaaacaaattagttgatgagtgaaataaagaagtggtgaaccctgaaacataagcattgaaatggtgaagtgtttaatagtgaagtaccaaacagtagaggcaaacaaatggttaccaa

SEQ ID NO: 4184 - DNA, 1116 bp, Zea mays
  misc_feature (1)..(100): optimal_loci_90733_G1, chr2:229652370..229653485, Cluster 25
  modified_base (585)..(585): a, c, g, or t
  misc_feature (585)..(684): n is a, c, g, or t
  modified_base (586)..(586): a, c, g, or t
  modified_base (587)..(587): a, c, g, or t
  modified_base (588)..(588): a, c, g, or t
  modified_base (589)..(589): a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
aatacacaccacaatccaaaacaaaatccaacactactttgatggaaacctcaccgctcttctttgatgtaaaagaagaggtcgattcagcaatctttgtaatttgttcttgaattactagcaatgtacttgacttttttaggtatgtctaggacaacaaaagggtggtttcttttgatcttcaactacatgagagatctcatgtacctcgttctccctatatgaccaatcatagaacacataatctccctcatcgtcttcaaggtcaatactgccaatattctcaattccggacaaacaagggtatttggaataacatgattatcactcataggattccaatgatttattttatcattaaaaatatcacaaacatttgactaaggaaatcctaattttgttatgctttcttcttgaacttttcacacctaaacatttgaaaaacacaagaatatcaggccgaccaacaaaactagtttatatggtaaacattccatatttgtcataagaactaggtgcacccttccatttctttgccacttgttgtcccatgctaattacaccttgtgtgttgttctaacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcctttgcggctttgcatcatctgtggtccccagaccattgctacttgtcgaatatgaaacacatgttgtgtgttgttctaacccgctctcgctcgccttcgcatcaaccgttgccaaattgtccaatctattttcaatctatctcacttgttcttcaattatgtctttgataactcaatttttgtcatttgaaaaaactttgtgatacctgtttggttggtcacttgctttgattactaaaggggacccaaaataggacaacatagccagaaataagagacatccgttcctttcaatctatctaatgaatagattgaagaaaggaagtttaccataataaaaaggccttcaaaatagtaaaatagaaatgctcgagagagattgttattgtttgtgttcccttcatcaatttcccatagctacaatga

SEQ ID NO: 4185 - DNA, 1096 bp, Zea mays
  misc_feature (1)..(100): optimal_loci_95359_G1, chr3:17162365..17163460, Cluster 25
ttccacaatagaccctacaaaattacatgcagatcaaataaatctttgtaagtgttagaaaactcttagtcgacacatgtgtaactcttttccattcaaaatataaaacactcctaccaatatttgaaccaattatcaatataatttatgctagttctctctcatcatgttgttatttaaaaattcattttgaaaaatattttaaaataagataaagttacacctttgaccaagtcaagtcatggaactacttttatcttttctagacagctataagtaaattgttttatatccatcaattatatatatatatatttcgttcaaaataatatatattcatccacgtaacatacattcacaaacaatccatataagataaattcaaaaacacatatcatctacatcaaatacattaacacatactcttccacatcacacaaatcattcatgaactcatgattaaagtcacataaatcatccacaaaacataagtcttcaaatatcatcagttgttcaagtattaattgaggttgaagcatcggtagaggaccccattgcggtagtggcgacatcttgcgtataaggggaaaatgatgtttattcctatctactgtaatgtattatgtgaataaaatagatgaaacaccacgagtgatgttaaaacctaaaataataatagaagatcagtcgaacttacttgcaacatggcttgctattatgctatgaagttgaagaaatacttgtcactctattggtcatagtacaacgtcgtcatagacgcctctcctgctcatcacatagccttattactttttgaatttgaagcaactcatcttgtgtgttgcttcaccgactactagctccagtgctctatgactagggaactcaattatgagctctgatcttccaggagtcagtcactctattaaacattgaatacctacaacacaagtatttctgaacatcaatttcatacttgcattacaaaaattgacaaaatatagtaatgtacctttcgtggctctttccaccttcactagtgtgcatgacagaaggatcaacgactggtagcgcatgccaaatgcaatcctctaca

SEQ ID NO: 4186 - DNA, 1065 bp, Zea mays
  misc_feature (1)..(100): optimal_loci_95371_G1, chr3:17190089..17191153, Cluster 25
aaaggatgagaagaagattgtcggccatcaagtttctactgagaaagatgaggccaacaagaataagctcaagatcactattggcacttctctatgcaagggatcaacaaagacgacaactctaccacaagaaaaaatgaagttgagaaatcaaataggccagttttttgaaatcacttgggtcgactttaatagtccaacaactttggaagcgcattgtgcgtactttcagaccacgccatctagagattggtatgtggaagtttaatatgtctaagaacatatggaaggtggtgagaaatcgttgcagctttgacaagctcatggacaaatataaaaaggaatatgatttgtcctaatggacaaataccaattctatgaatcgtcccccaaaaattagagtgttcacctcccaagcaatatgatttgtctaagtagattgttgtagcttcgactttggattagcaaaggaaagctcctcatgtctctcattggggtcctctggtgtggcttcctactcatccaatgtgggggcctatggtgtgtgggtaccatattggcaatggtgcctatgatgcaaccaatgcaaggagctatttttggtcctagtgtatgtcatttggtgtttagtcctagtgtatgtcattcggtgtttagtcgattgaacttcggtcaatcaagatataataatgacatcaaggacatttttggctcgtgcaaaggggaatacacaatcaatcaagtctacgtgcctaaaaggaaaggtcaagcagctgttgtctctacataagaagttgatcctccttctattccaatcggctttgtagaagtgcgagttgtcaaaattgatgagccaattgtaattgaggatcctacttcagagaagtgcccattgtcaaaattgcttgaataacatctgttaaattgttgctgccaagtgccgagatgtgcataccatgagccatgcagacaagcaaacatgttctcatggctttatagagaatgttctctctgtgaccgttgaaattaattgataaaatctgacattttatttagccaaacaaa

SEQ ID NO: 4187 - DNA, 1318 bp, Zea mays
  misc_feature (1)..(100): optimal_loci_98002_G1, chr3:31469379..31470696, Cluster 25
acattataaaacaaggtacgccacttgaaacaagaccaatgatttagctgcaaataatgtgcaagtttataggtagtagtacaccataagtgtacatttgtcaagaaaggatgcatatacaaattagttctagacctagttgtacctcataaaaaaatgtaacctccctcaatttctacaaataagttatacaactaatcaatcgtcatgagatctatttgtcccacttccatatattaacttccatgagatcaaggtcgatttccatgacatccaagtcaacttctatgacatcctgatcaacctccattgatataatttcatcgagctcaacaaacgattcaccataaattagtttcttctattgggataggatggttggaatgtccaataatcatgtgtccgaagcactactttagtgctttaatgaggagaataagaagacatcaacttcaaatccaactggtgttcatgatgaaaggcatcgatactccgtgaacacctagtttgggacattggagagagaaatcactaaacaatcatgatgttagacaaatgccaaacccactcttctactctttcctaggtcagcccaataggaccctaaaatggccatagatggtgagacacatataatctcatcttgccatagcgagtcctcttttccccactagctcataaaaagttttggtagtaaaaaaagttcacaactagaaatggaaaacacaagtaattatccaagagtgaaaactttttttgccaccagtcaaatgtgaggctacgcgctgctctttcaggatgtggtgaaaattgctttcgccactagttacacaaatgatctggtggcgaatatcaccctactttgcaccacaagatgcctagatcatatgcttaatcgatagcgaaaactcttttcactacttggacaattgcaaaatgcaccctcatagatctagaacgtgtggtgataagggtgcgaggatagtgatttatgtactacatgatcctcacacggtcattgtgtctgcgtgtcatgagtaagatgataagccatttgtctattaaatttcttatgctcaagtagataactttgcaagtgcacaaaataccattgcagcacttaatttgtttgagagtattgcaaagtattgtatttttttatcctcatggaaaggttatgactaatggtattcataaatacagttgttttttattatatcacgatcaactaccaaagtcatatatatcaactaccaaagttatctttgattatgactaatggtttgagagctgctaggcagttattcttcagtgcttc

SEQ ID NO: 4188 - DNA, 1151 bp, Zea mays
  misc_feature (1)..(100): optimal_loci_98088_G1, chr3:31914732..31915882, Cluster 25
ttttaaaatttaattttgaatagcaagagatttttctctctcttcaattctctcgttatgagtagtttaaaaacttaaatcctctctagaattgattagattaagagaaaatttaattcattttctctcaaatctctaaagttaaggagatggatggttactttataattgttgtcgttttaaacttatctagttgcttggagaggtcgagctatttttagaatcagcctggtccagtgatgtctcatgtctacgttatttccgacgtttcgtaacttattttatttttaataaaagactatataactcactggagatcatttacgtaaccacaggatgccgcggcgcgtggagcacgaggattggattcgatgcggccggccggcgagggaggagtgtgacgtggcaacgacgacggacgaggccggtcggacgggcgcttccgtgtcccgcgtcgctactcgcgaggacgtatatgtagtgccttgtgttcgatcagcgacgtgcatgtagtgacttgtggtcgagttttctggattcatggtacgctcaacattgggctacaaaaatactatcccgatagtagtatttacaaatatagcattatagcagttacatgtttggacttttgttatcatggtccagtttaactattcaaccctccgccgccatcaagcgataagctccctaagctaacactccccacttagctaagaatgtaaaccccatttcaatagacaataggagtcaacaaatcttaaatttaattgaattcatagagcatattatctatatctatatctataattaagtttattgtaatttataatgtatctaatggtacataataaacattataaatatcaatatcttttttacatatatatttaatcaaaactaaaactatgcgattccgccgatagcgagacttattttttttaatagagggctagttagatgtgcggatgttgctatattttttttattttggttaggtagttgtgatttgtgaatattaggtttagagtcaataagtattgttgaaatctctatttatgtatttgttttatttttatatagcaaagtagtatgtgttacgctcacggaaaattaataggcaaaggaagaaaaaattatcccgcgctcactca

SEQ ID NO: 4189 - DNA, 1261 bp, Zea mays
  misc_feature (1)..(100): optimal_loci_98857_G1, chr3:36820181..36821441, Cluster 25
atgggtaaactgttagacacagtcttagttctatctcaaaggtttccaaattgatctttcagtttcactcttctttgttctacaaacccatcgaataataggccccgagagcacgagctttgagaataaggataggtgaaatatagttatttagaatatctctaacagatctcctatctcatttcttattttattctctgtttcaaacttctatctacaaaaagtgtcaaacaatgtcatttacagtttcgcgtctcctattttacacactccactagagagacttatgcattctgtttggttagatggataagacaagctatttttagatctatataagagttgatgggataaaaacagctaacaaattgtgtatcttatataagaaacaataataactaactatacattaacaaatatatagtgacactaattttgttacgtatgtactaatttaatataaaatatgttgattgggactactgctactaccctatttagcaaattattcatatactaattattgtattagcacttattaaaattaatcttatcatcataattactaagtgataatataacatgctagtaatttttaataatccttaatttatttgctgataatgataaagattagagaacatagatgactcctcaaaacgtttttgtaaaaaaatatctaacctacaaaaatactcttgtgtatcggtataactctcgcgcgaaccaaacactatttttgactatatccaccatcggcgtctttcatgtcacatcatatcagttaggactactttagtgatcaagaaagtggagggaatctatgaggataaatctcctagctatttaatttttaattagttattcattccccattgatctcctccaattccctagtcaccaaacaagttcttaaactaataaaaagggattatcaattcacttatattctcttaaatatagaataagaacgggctactttggtgattaataaagtggaggggatctatggaaagaaatcttctaactatttaattttttaaatagttagggatttattcccctccaattccctaatcaccaaaccggtccttaagctgataaaaagggattgtcaattcacttatattctcttaaatataaaataagaacgagcaagaattatttttatttattatgctaaccagaataacatagaataagagcgagtagagatgggtaattcgcttgttggatgtattctctaacagtctaggttgga

SEQ ID NO: 4190 - DNA, 1212 bp, Zea mays
  misc_feature (1)..(100): optimal_loci_994_G1, chr1:5061072..5062283, Cluster 25
tgaacctagaaaaataactgtagagaattttgattattgaacctgcacaaaacgtctgccatgacgcgatacaaagaaaaacacttagccctaactatactagatatgtggcagaagatgaaaccaaatccatctattttaatgtttttctgtggttatataaagagtttatacatgcatattcgttggcattgtgcatggactgcacaaaaaataagtcctatttatgtgtaccacaaaatatgtcttgaatcttaatagcgcattcatttgacattgtaattgttaatgtatttttttataaaaataattgaactataaaaccttgacttggataataatctatattttagaatggatgaattaattgcatggttacataaacaatctctagaatcacctagttttttcctagtcacagatggataaaaacgcctctaaaatggtcatgaaacattttttttatttttagatgtggtaagtgtttccaattgcccccataaacagaggatatctctacaggtcacttaaaacaccaaccacgactagaactaaattttcaaccacagtatcgtaatgtgacacgactcaagaaataggtgcaccacaaacaatatatagcttttaaattaaaatcaagttggatggagacgaattttatataaaagttacaaaggaaaaaatttataagtttaatgtggataaaattaccatttgaaaccaattattaggttccaaatacatgtttgtaagttttcaaattttgaatttaaagttccttttctgttgaaatgacctcagattgggataccaaagttgtactcctcaatgagattcaacatttacaattgatttgtaagaccattcaagtttgtacgtacattcagtggcaacgacactctaacggccgggaagagaagtgagaatttatcttttgattcggttttctctcttgttcttgtcagcacggactttgaattcagtagatccaaaactaacttacgagtatgcctcacaagaaacaaaaaaagttgcattttctcacaagattgagcgtctacgccgaaccatatttcgtcattttcgaacgaatgtcgccagaagttctatcgcacacttctaagtcaaaccatctaattttgagtaggctattagaaggagtggggggggggggggggggggaggggtacacaggctgggaaattttaaaac

SEQ ID NO: 4191 - DNA, 1048 bp, Zea mays
  misc_feature (1)..(100): optimal_loci_99566_G1, chr3:41613326..41614373, Cluster 25
atggcatttcaagtatgagtggtgctcttaagctctatttttttttctttctcaaaaggtttagggataaactctggacaatcaataagaagatggttgatcctgtgtgtgcaaggcataccgctctgttaaaagaccaacatattctcttgagtcttatcgatggtccaaaggaacggaccatttgaatcttaccaagacataagaaatatgagggtgctggaaacaagaatacaattttcacaaacagaatttggttagagtatatggatgcatgtcatcaccactggtcaggaagtcactctgatggattggggaaatgccatcattaaagaaatcaggacagagaatggaataattactcaattagtcaattggttggtcagctccatctttagggatcaatgaagttggccaagttgaagctagcttggctgcctggtactgagggccctgtatctcattcgttggttgagtttgactacctaattacgaataaaaaggtactaaccacattagagacattcctttgctacttatttgctacaaaaagttgtagcttgtaaagttcggtgccttttcacttggataagccatatacatttcttacctgtatcataattgattattttatctggtgaagaaaaacacctagtgcccaacttatcttagcagttcaataattttatgaaccgaatggtcataaaactcatgacagtacttgaagagcttaacattttaaggaaattgttcatctactcagatttcattatgcatttgttcaatggtagtggaaaagcaaacatgtggaatcaggttccttgggcaaagtaatatcgttcatcaataagggaacatgtgcaaaccaacctactagtgtgaactgtgcaaaccaaaaacaagaatggaggtgggaagacatttttaaaatattatattttaaatcaattccacatcccattggatattttttaaaaaggtcctctcacctctattgttgtgttggtttacacagtttacacagatatgttccccatcaattaatcta

SEQ ID NO: 4192 - DNA, 1081 bp, Zea mays
  misc_feature (1)..(100): optimal_loci_197372_G1, chr5:158680601..158681681, Cluster 26
agaacgggtcggtatcgaggagcggcgagataatagaggcaatgtgacaatgtgtaaacacttagggtcctagcatccttgaagtatgtgtatgtgctaaagaaatagcacttggctccttggaaggtcctagagacgaggactctgggctcctcgttaagggtgcaggttgaagtggagacccagagctactagcaattacaggccatgaggagatagtatccctcatccaacattgagtatccatggtataggtacttatttataaccaactgctcttgttgtcttctttgttgtatgaactatagtaactcaagcatatatctagatcagtagtgatggtgaaatccctagtggaagtcgatgccacacgtaaattctttgtttggctactcaatagaagaagatttatatacccacaccccaagaaacttgccccccagccatccatcaatccaaagataacccaaattgtagcactagatgttgaaacgagtcgtgttgagcaaggaacaatgtctacactgaagatggtggcaggacaggacatcgagcttgcattaactagcaaagtgattccttccatccatgcaagaagctacatcccagtgggtgcggcaaaagccacactaacacttcatgagttgatgcctttcttctgaatgttcaattcaaatcttgcatgggcgagggagctctagtctaagctgtatgaaaaggttggagacttccatacaactgttgtgtgtcgagtagtagaaaccaacaacaaagtcattgtatggtacttagagtagatagggacaacatgctattgtgtgccaagtagcaagaaacaacaatggagccactatatgctacttagattagttggactagcttagaccatagttttccaatggcttagagctgaattggaagatctggtcatgtctgagttggacttgtactcttgtcaaactaggtttggaccatggttgtttgatggcttagaagctgacttggaatacttggttgtgcccatgttggacttgtactcttagttgaattgggtttggaacatagttgtcccttagcttag

SEQ ID NO: 4193 - DNA, 1267 bp, Zea mays
  misc_feature (1)..(100): optimal_loci_10631_G1, chr1:56896107..56897373, Cluster 26
ttctaagtcatttgttgtaaaaaaatatttgagtcttgatttttttttcagctctaaaaagtaacacaattcaacatttccttatttttctcattcataaggctagaatagttctatgctaattttaatctgtaggtttattttaccttcattgaggaggaatctccaaatcagagagtatccatatgattgatgacaccttttagatgttataaacgttgatttggtttttttaaggaaacaacaaaaactcgtttatatgggagagtagcctgtagttgtatcaactgaggtttaaccgagtggggcaagtcatccgtccattctccctaaaccctgtactcggcacattaagaatgtgttttttttcctttacctttggtgagtagactaaaaaaatcaactgccagtcgaaacagtatggaacatttgtcatggaaatggccatagtttgaggttctgccaactacatttcaagaaggtttcttgtgaatctttcggaatttgattgtgtgatccttgagttcttgaatcttcaggatgtctataataattcttgaaaaagagatttccttgataatcataattgctgatggggaaaagggtcaaccataattgctgccctgaagataatataatttaatcctagcttcgttagaccttaataacaggcacactgtacactgcccctttgtcgatttgtggtttcagaatagccatggagttaagtgtttattcagctgtttactgtggttcctattaatatttctatcaatcggcgagactccatatttctaggcaatttgttacaatttacaaggggccacagtcgaactgattgtacatgctaccctacaatgtatttctcgtcctactctggccctgtttggcattggaaaaacagcttacctgagaaactggtgaagaacagagtttagattgagaagcagttgaaatggtaagctgatgtagccttgtttgatacagattctgtttaaacttgtgaaaagctctaaaataagccgtgccaaaacatcgcctctgatttatactcatgagataggcctttgccggcgttcatttgcattgtcttcagcacatggaatgacgttcttttggcacctccagcagttaaatgattacttctcaaatgatttttttcacgttatccagaactaatgtagtctttagggcagttccaatgggtagtttccatagcattaatcagtgtgtcaatatgctgatgtggcattggaactgaggagag

SEQ ID NO: 4194 - DNA, 1050 bp, Zea mays
  misc_feature (1)..(100): optimal_loci_10633_G1, chr1:56898426..56899475, Cluster 26
agaaaattaagaaagataacttgaggaaatacatgtgcaaatgactagcttagcatgaagagtcagcccttctttctctccattctgcatcggaaaaaaaatgtggcatagatttaactagctagcactacatattctctcctttacatcgagaaaaaatatggcatggatttaattagctaccgaggcggtcttagcatctagctttgactgatgtttgacgcatgccaaatcatatggcgtcatgccgtcatacagagaaagcacaatgtcttatcatttggtgatgtgttttgatcgcttagaaaattgagcattttaaagattaaattaatattctaaaacaatcactatataattcacgcatagaaaataaaaacatgattatatagttgattatatttatcttaaataaactcatcattactcgtagagtcgtagtagaggttgctttagtctgatcgaagatgggttcacatagttgttgaagtctgtagacgctgtagtacatgttaactcggtgcgtcgtcgtatgatcgctgcctaaaaacccaatttgccccaacccatatcagttcttcagcagagcaaggtttcaaagacactcctcttcttgtcgtcatcatcacaccaacgtcagggttgaaggagcttgagatcatacaacatcgaggactttcttgtctaaaatcctaactcatagtagattggttgtttctcgttcctttaggagagaacaccctctctattatataggatgatagacacatgattattatgcacaaaagaataggaaaatgatctgatggatcctgttttaaacttgtcacacaagataaggcaaagttgaaaacatgagtgaacctttaagttttattcttggaattattgttaacaaaagtatataataaaactcaacaataggaaatattgttaaagaaattgtacaataaactctaaggcaataaaaatattgttaagaaaattggacaataagctccaacaaagatccacaaagatctggaatgcacaacatgacctagtaccaaa

SEQ ID NO: 4195 - DNA, 1159 bp, Zea mays
  misc_feature (1)..(100): optimal_loci_110785_G1, chr3:117262010..117263168, Cluster 26
tgagcttttcgcaaaaaaaatagtcatggcccctgctgccccttccctttactctgtcactgggagtctcttaacactcttatattttaaaaactatccaaaaactcttggttatacatgcccatggctttgtcttatttggtggattaattgtgaagaacatggagtttcgtatgtataaaacccatggtcacaattacaacataaaaaatctgtgacagtcttgataacaatcacataaaattcaccattgagatcggtctcatcgaaaaaccatatttacacgagaagcaagacatacagaggaagtgttatgagagaagatagatgattggaccaacattttatctgttgactttgtccattgcattgagtgtatagtttccacacatgatgtcaagtttgtaattatcatatcgtatatcatgtattttctaggttaggacaccgccttatgccctactctcgaaccacacatacttcctttcctccgcccgaaaataatacaattccaccaaaacaccaagttaaaatatgatagatttatctatttgacactggaaccaaatttagtctttcttctgtggcactcaaaattctgaacttttctacttggcaccaagttaaaattctcttccttagatggcactgtcatgttggttttttctcgaatataatgtaagatgttttatctagctattttatagatggtgtcatgcggaacaacaccgacatccgtaaaagtaaataaaatatgagttttaggagagagtaaggtgtatgttagagatatgttggatctagtcatcactaggagctatcacagggtatttatagagtttaacgctatagtgtgtgtaatatcatatgttctattgctactcattgagttaggaaatacaaatatgaataagattataagctcgtaacccactgagcatcacgaccacctagctcaccctcttgttgcgatgagagttctagcctattggtcctaacccattattctctgtgcccatttaatagagtgaattcaatcctaggatagttggagacctctcaacccttcatcccactttcccttggaatccttcggttgagtttattaagggttgagtttattctaaatgttactttattcattttgtagagcaggaga

SEQ ID NO: 4196 - DNA, 1046 bp, Zea mays
  misc_feature (1)..(100): optimal_loci_113785_G1, chr3:134772453..134773498, Cluster 26
ccatcacaaaatggttgccgtacctgctgtctaccttagcagaaaaggtagtagataagagatgagtcatgaaccatgatagctacagcgtgtggtctcccgacccttcttttgatcactgcacaaatgtattggaggcacccagaaataataattccggatcgacaacgcagacagtgagcaacaggagagtaggctagtgatattattgcttctggaaccctagcctctttttgcagcaaactgattcattcactcttttttgaccgaactttctacgagagacatgcttgcacaattcctcttccctgccggccaatctttctttcttttctgcaacatgagcagttcattccactacctctggccggtagctttcgtgtatgatgacttcaaatagtttatccttagaaatttcagtctcctgcttgtgatccaagagtctctcaaatagtttatcgcgttagaaatagtttggaatgaatctcttttggcgttttctcagacatgccatttttctaatctcgattttacaatttctcaaggacatctggaagatttgttttttttcttgaatttttaaatagtttttatttaaatgaataaagtgggaggatgcatattctaatcttctaaaaagtgtgatgttgctgaattggcagtcagctgtttgtcttttgagttttgcatatataattttgagtttggctcatatatagctagcagcctgtggctgtgtgttcactgtatctacaacaatgcatgtggctattggatgcaggagagctctgtgataaaactaattatatatacagggtgtatgttttgaataattttggtcatgtattacgttttctaaacatattgaaaatacaaatttgtttcccaatgtacatatatataattcagaaacatctgtgatatatatgaccggactgcatgcagcaacaatgcttttttgcaggctgcttgaaattttacttattcatgtgtagttttcccaataaaactcaatgagagacgagaaagaaaaaaaagtcccctca

SEQ ID NO: 4197 - DNA, 1069 bp, Zea mays
  misc_feature (1)..(100): optimal_loci_116545_G1, chr3:152171238..152172306, Cluster 26
tcacttagactcttaaagaccctttaataaactccatattaaatgtgtacatgccctaatacataacaagtactagtaaggtttatggtttatgaccactgtatatagctcgtatgggctgcgtgcacgcaggaagcctgccacgccttttgtttcttgtccggaaatgtagcgtgctgtctcccgtccacccatgtgtcccacacaactttactatgcgccgggcccacccctcattctcgtactacagtacgtattattgcttcgttcgttcacgtccccctcgcggctccaactccaaacctgcgttcctggttttcgccgcgtgcgccgcgtccaaatagccgccttgccacacaggccagcggccagccatacagcccagccccatcaggaaaatgagctaggggactggtccccccaaatcttggggatggaaccgagttggggtctcaccaagtcaccagcagcaagcagtaggcagcgcaacatacaagcaacgactgagtgtctttcatgactgcgaaaggtcgctaacgaattctcgttgaatagtcaaagtattctactaaagcccctttgcaaccaactagttaatctattgaggcaaacacacatgcttcgccataaaagctctagtgtgtcttttgacatgtctctagaagatcgtgcatatcgacgtacacggtatataacactgtttgtagtatagagtttgaaatgtgagataatgaatatgataagagagccgctagagataactttatcccatacatgtttatctttttctcttgctgctgcactaataagtaaaaacacaggatagttggtcacagaggaggaacataatattgtcacattcagatcatgtataaccttatgtaatatatggttttttgagggatgtgtagagattaataaaaataaatataagagatgtgttctttgtgaagcacctgtatctacacgaccgtttatacatattatcttgtaattgtatctacgacctaaaggctcataatagtatcatgcagttgacctccgaaattaaaggtaatacataattatg

SEQ ID NO: 4198 - DNA, 1003 bp, Zea mays
  misc_feature (1)..(100): optimal_loci_118877_G1, chr3:166428826..166429828, Cluster 26
gctagtctttggcgacgtgacggtggcatcgcgatagaaatttgtttctctagatgtattctattctgagcctgatttgagaactgtcttacgtgaacaggccaacagttgcttccgatctatgttgttacatgagcaagatattagaggctaggttgtccacttacatgaataggatagcaggtcgtactagcattgtttatggttggactaaccaagcgaatattgtttggaccggttaataattaagtattatttgaggaggctccaatattttagggccttgagcggccgcccagctcgacccctcaggtccagcacagagcacgtacatgagtcgtttggatatttccaccacatacatgagtcgtttggattctcaaactaaactaattatcctagactagacaaaaaatgaaactatagcaagcaatttgaaaaagttgaaagcggagaatgaaagaaggtagcgagtagtgaatgattgcaggctctcataaccaggcagacaagtaaactgacaacaggacacggaaggaagcccactgtggttctttcttctctctccctcttttaaaaaaataataacgagcaagtgctactaacctactgcataaatatggtccccaagataagcctgcaatcttctccgttgcttttctttcagagatgatgaggattcctgctaactttaattaattagtttgtccactgcaaaaaaacaaggttaggttagctaaactaaactagtggacacagacgctccttcaaggtttgctggtggtgcagaacacaacacaacacatacatccagcacactttccaaaagctcaaagagtgaccagacacacactacaccatggaggaattagtggtcagttttttcccagcacccccccccccctccttaattttctctaatccatctccaaataaagagtggcgatcatcatcacccaaaaccagtccactgtccacccctggttccctgcccctaaaggcg

SEQ ID NO: 4199 - DNA, 1109 bp, Zea mays
  misc_feature (1)..(100): optimal_loci_121792_G1, chr3:183390948..183392056, Cluster 26
agtaggataaaacaaacggggctaaagtttggtcgcttgggagccaaagattcaaacagaaagtgtagtgactaaattgataatttaccattgtagtcaatatattcctgtttgaatctttagctcctaagtaactaaactaaactttagttacttttattttaattcctggataacaaacggaccctaaatgtgtaaattactaatactaaaatataagaggtgttaagcaaaaagcagtccagtctataggctcgaaccggtttcaaaaccagctcagaggctggttccaaaattggcctggcctaaatctaccaagtttaagtccaactttatttcaaacttgtggctttaaatttgtctcggtgtccctattttgttgtcaacacaatggctatatgaaaattttaatacgtggttctgagtcaggaactcaagattcgtgcaggtacacctcacatcattcgctccaggcgtcaaaggccatgtagatgaacatgcgcagcgtgtcagagcaacgcacttgcgctcgccgaggccgccatcaggtcatagtcatactcgacagcgacaggaactccgatctcagacaggggtacgctgtagtaggcagctcgattggcgtcgccctcgcccggcacggggtcaaactctgatgcaccgtgtgcccacacctgcgtgcctgtcctgtctgcctccgatcatccgatcaaaagagttccgtactcagggagtctacagacaggaatttatctgacttgtcaacagatgccccttcagacttcagggtacggaattcttgccaggtgtggagccagaattaccctacagaagggacgaacaattcacccataatacaggtaaaaaaaatacaggatggtttctatattgtatagacaacatgctaaccaaagaaacttgcaccatacacttttatattaattaaatccgtgagattaaaacaattatgcttgaattttcctctacgaggaccggcgattaaatgatgagagctaatctttgctgcaaattctttctcaatacggatgattatgtaacttcacagaaaatctaccatgaaatttgaagaacgcattatctatttttat

SEQ ID NO: 4200 - DNA, 1045 bp, Zea mays
  misc_feature (1)..(100): optimal_loci_122927_G1, chr3:189359689..189360733, Cluster 26
aacgaggtagtgaaagggagtcgtcggtgtttgggcggcgcggggtggtgtcctatattgctttttaaaaatgaatcggaaacacacatctttgttcgatggactatgagtctatttggttcgttgcctaacttggcatagtttacctaacttttttttaagttagttcttcaatttagccaattaactttagttaagttatatggtacttagccgagaaccagccctatagctctcacaactccatggactttatgggtgcctttgatttagcattttgaacctgcttctactttgaaaaaactgatgccaaagtgattcagtttttatgcaactactttaaaaaacaacttgtatgtggtacaaatttaaaagctgcttagaccttgcttttgttgcttagccaagttcgttgcaaataataaagtgctatagtagatgaaataaaaaatagttttaataaaattattaaaatagaaatgtaaaattgatttgtttgtaaaaatatcatgaacacaaatgtcaaaccggtttttaaattagatgtattgattgattaagagaagtagttaaacaaagtttatataaacaatctacaatttgtttacaatgaacaactcagatcggtttgaaccaaacaaatttcatctttttaaggcagcttttatacaactcagagcgtttggttggcttgaccagctcctttttgcaggcttgctctggagactagagacataaaaaaagcccggtattagcccacgtagtcttctgtagtatttttaacaggttggaccgactgccggccctaaagcaaagcacaaaccgcgcgctgcacaaatggacagttcaggtaaaacccaaacgcaagagcctatttgaggcctaaagcgttttgcctggagtagatccgttgggccatgaggcttgttagacaggtccggccctcgtaaaacattatacacgtcgccgtttcaaccagagtgtctccgatgccaaccggagcacacgtcggaaggtatgatccggtggtgacagggaggatctc

SEQ ID NO: 4201 - DNA, 1327 bp, Zea mays
  misc_feature (1)..(100): optimal_loci_123298_G1, chr3:191120255..191121581, Cluster 26
tcggtataacttggaacccgtacttgtggattcctcgaccttctctttgtgcttttctcctaagggcgctttatctctttgttcttttatcataatttttaagtttgaggcagcaatatttgaatcactctggtagatatggcatgcacttcactttggtggtttctaagttccataaccatgacataatcaaacaattcctgcagccatgatatacacttcttctttggtagtttgtgttccataatcatcataacaccataaaatagctcctcgagggttttctctacttttggaactaatatcttcattttgttttttcctcaagggttttctgaactaatatcttcatttttgggattttaataaggtgtttctctacttttgaggctaatattttttagattcttttaataaggcgttgcttgatgtgccatagtttcttaattttatttttatattttagttattttgttctatattgtttatatttacaaattcatgatagttggatagtatattaattagatcgagtttgtattataatatttagaaattattaattaatttttataactttttgtgtgcctataaaagaatttagagtatgttttctcaaaattatagcatctattttccattctctcttttctcatgttccctttgaattgtactgttgtacctatttgaacgctttttgtttggttatattgtgttgtgttgcagtattttttggatgcacatctctactcaatagtgtttcactaccagctaaaattatgtgaattaaacttgtggatgtaaggccaaagtcaccatggaatgttcggtgatttcttttctttcgaaagaaaaaatgtctagcaaattgttcaaaattataagtcattacaactttttacatagattttgctattatacatgtgtagatgcgtatcaaatttgggaaatttcatgtaaaaaaattaaaaacaacttataatttagaatagaacgaagagagtaacgtacttgtgctctatagttggtcaagtgataatacgtccatgtctgtatcctgagctagatttagctttttcatacaatggtacaaagagtctctcaattaacaagataaaattaacctgatttataaaagattaggcttacaaaccttatagacacacgatttattagtaaggcataaagtttggggaaaattcagaaaaggacagccaagacaacaaatcctaagcaacccacatgcacacaaagaaaacacacacccaagggagcccatcacacatcatcgttgttgagcttaccacacatagtaaagcaactccac

SEQ ID NO: 4202 - DNA, 1135 bp, Zea mays
  misc_feature (1)..(100): optimal_loci_123299_G1, chr3:191121635..191122769, Cluster 26
cacatactagcaccaagccttgacctcacaataaagtgaaagcattgtgtcatcgttgccaagatttgttgcacctagaacataagtacctccgacttcatcactacatatcacccctatgagagtcagagatgcatcgtaggaccacaagcaagtcgcaaacccgaaaaaggatggcttgccaaaaactagaggcttgtagtttagcattcaatgtatcatgcgaaacaacatccaataagatggtgcatggcctctaggtgacaccttaagtaaggaaacaatgttgatcgtcactgtcatctatctaggaaccataggtagagtttactcaaaagaatctagaaggatgaggagatgcatttggatgacactttcaaggaagggaacaatacccaaagtgtcaccaccattagctccacctaatgccatccagggctttcgccaaacgttcctcctcataaagaagccacacaccaaacatcggacggtcctacaagcaccaagatgcatggttataaaccgatgtgtgcggccaacacaacaactccctcaaagctatgtgaacttgccaaccattcacactgcatgtagctcaccacatgagctccataaaccactgcatatgtaggccatgccataacaaagactctatgaccaagagccaggaagttaacttctctcatggatatagattataataataagttgatagatactataactctcctttttaaactatacaataaaaatgatgtagtatatggttttgtcaggttgaaaaaggttgtccctccaaccctttctaataagaaagaatagcttgggatgatttttttgatgatgacgatgatactggtatgcttggaggtagttgttcgacctttcctcctaatcttgatttttcttggattgttcctactttcctaccgctaccttctacaggcaacaagttctgcttctagcagtggtggtagttctaaacttgcaacctatctagaccgtgacattttttattatggaaacaaaatgttcccgccttttgcaatctcttgcatacggcctacaaatcaaaaaatgacaaacatccatcataaagattctcagaaaaaaaacatccatgaatcaagctccc

SEQ ID NO: 4203 - DNA, 1329 bp, Zea mays
  misc_feature (1)..(100): optimal_loci_123868_G1, chr3:194356820..194358148, Cluster 26
tagaaggtaggttgtgacctattttggtgtactttgtgggctaaaattatggtatagtataggtgttatcgggccacgaccatgacaacgaccctagtagccttggtgctagatcagcccctggccacagatggttgagaacacaccaaatcaatccaccttaacttttgatggttctcttcctagcctaaattctctttcaagttctgagcacatgttgttcatctagctatagctgatgccttagttttgatggttcacacctagtttctttggaagctagtgcttattgtcgagcaactcatgtatcatctattgatttccttgtaagtctagccatttgaaagtgtctatatccgtaattcggttttcatgattgataatgacataatccttatgactaacatgtttttacatcgatgttactttaatgatgttacaatgatgttgattgattgggtaatcgtggttttcatgcccctaatcacggtattcatttcagttttaaaggatgactgcaaagattaacaatcgacaggttctaagtgtcaatggtgttgagagacgcttaaagtagtgatatgatctttgttttttctttggttgtattatgaacgggtagcttgacctagtgaagtctagtgagtgaatgtgatgtaaacttgtgaaacctagcgtaggtagcttagttaaaacccaagatggagtggaaacaaaacccaacacaaatgtggtttgaaatggatgaattggtgctatggtgcactcatagaacaagtggactagatgcttactatgccctattttcatgtgaaagaaaagggactcacatcggtcggttggtgtaagtagacttgggcaccagataagcacaccagacagggcttgtgaagaattgatgtgattaggcacagtcaagttcactcgctggacatatccagtgatgcatcggactggtgcactacatcattctaccagagagcatggtaaagtgggtattttggtcttgtattgaccaaacatgtttgataggcactagaccaggcatcaaacatgtcatattgttaatgtgtagtttggaaactagtgattgggacaataagtacacatgttcggtgcagttccttgtgtgcatcgggcaggtctgtgcccatgagaacgatgaatggaggctaacactagctcctttgcttggggctatatatacccctccatctcatgcatttaaagtcttagcattttgaagttctacatagaccctttcatgtctaagagagggacttgagttagtggagtgatttggatttgctaattcaatattaagtattg

SEQ ID NO: 4204 - DNA, 1237 bp, Zea mays
  misc_feature (1)..(100): optimal_loci_124234_G1, chr3:196195342..196196578, Cluster 26
ggtgtttctcatgccctaggtacctaacgatataagccctcagaatcccacatgccatagggtagtgtggagcgtgcttagtgcaggatcgtcccccaaacacatgctacatgtggtttcttagggacccgtagaggagttaaggataggctgacatcccagccccatcttagggataaattatgtggcgagcccaccggggatagtacgacccaggtcatgggccctacatctaaaagacctaaaagtggtcccataactatatcttaatggataattctcgagtacaacacattaaatttttagtgggcaatattaagggactaactcagcgtgtagacatgcaacgtaggtcctaggacacttgagaccactacatggtgcatgtgtaagtcctgtaaccacacaaacacgtgtatgatgtacagagaaatataataaactacaaggaactatactggcaaccaatcaccccaaattagttggctaggaccccgctattcagtggtgtaggttatcatacctaccccgaaagaaggtgtggacatcgctttgggaaggaacaactataatagaatttcaaatcaaatatgagcacaatattacaggcacacctccgcatgtgcatgggggcatgtatacccaaagctattgtacaagcatagtttagtgtttacaaccatatatgattaggtaatcttgcgtactactagactggaaaatcctcatggttgtcattaaatagtacaaaggttctgacatatgataaagggtactagaaacattactaggattcattaagaccccatccttattttgggtagaactatgactacatgactccataggaatgattacgccaatgcatgcctgttgtaggtctcatggttgcaagcctaaggcaggacaaaggctattgacccaacgacaagtagagaccatatatggtatacacatataaaactatcgctcttttagactataaaagggggtggtagagcaacattcaattgaagctcaactggaggctgaacattccacaagtaattacaccaagatccaccaaacccaagccaagggagttcaatttaatctggccatggcatcaatagttagagttattatatcttgtctcacccacttcctcaacaaggaggcactgtagctcactgtactagagcttgtaaccttgtgaatcaaccatatataatagcttgtgattagtaagatgatgtag

SEQ ID NO: 4205 - DNA, 1235 bp, Zea mays
  misc_feature (1)..(100): optimal_loci_125225_G1, chr3:201906051..201907285, Cluster 26
agaaagaatgaaatctaattctattacaaatacattccttcatttattatattcggtcagattacttgccttgaagatcacacgacctttcttcatgtcttcctggtaatatgtgggttgacccatctccttgccaggtagtcggccttatagggaacccttagggcctttgtctatcaagcctctaagctcttcatttttgaactttgaagcattcttaaattccctagtcattgcggaggataatcaagtagtgctcgaagtacctttttaagagaagccatcaagtgcttttaaagtttgacctctaatggtgtgtgctttcttgcaaagcacacccattgggtttagtctttcagactagtgctatttagtataaaaatcttgagggtaattcttctaatcttttcaagaatttcaaaatcattttctaaggatatatatcacatagccccgagcataacacttgaatacccgactaggacttgactcttagggtgccccatgataatgatcaaggaccactcattagtgagtggtttgttcctttttgcagccacgttgagtgtagggttcttgtactctacttcaacacgtttttgtcatgatgccttacttttggcgatgagtgtgctatacaagttggcatgcactaactgccttggcatagaacatgaatattgtccttatccatgggcgttgggctataagtacccctaatgatttcaagactccactagtggtagcatcaattgaaaactagtcttttgtcttgaatatgatagtccccgagatgccagagcccttgggcatagtcaaaagatttgaaatcttatcttgaaactagaagaatgcttgtgatggggtttagtctaaaaccaagtaattgtcaactgcagctacaagaactcttatgatagttgaatacacttgttcttctaggttactatgatctatacctaagattgacctatggtatgaagtagaatattactagtggaaatgatctgtacctaaggttgacttatgatatgaagcagaatattaccagtggaactagaatatatcttgttagactgtcaaaggtggcatctcaagctgaaccccttgatggttcttccaatttcatgcccaagaggaggtttgctcacaatcttgctcttggggaacttaggatgtaaagttgtcctacttagaccaaactctttgacagaccttgattcactaccgtcgag

SEQ ID NO: 4206 - DNA, 1311 bp, Zea mays
  misc_feature (1)..(100): optimal_loci_125809_G1, chr3:204648410..204649720, Cluster 26
attaaagaacctctaatcaaattactcttgaatgtgatgtcactcccaattttaggagtattaagaaatggttgctatatctcaagttatattctcgatcggtagaacaaaggtaaacgttcatgtttacaattggaaactcacctacacatgatcacttgagaatacaatggtaatgatgcaaatcctccttaaccatcatgtttgatgattgcaaatataaccctttcatcatttgtattcagtgtttttgaccattgttgttttaacatggcaatatgtggacatcgatgacatctatccaatagagactcgagtcgtcacactcgaacttgaagtggagttcatccaaggtgataaatagttgttagctttcatggaacaatgaaacaaaattaggagtagaagggatacatgtcatctgaaaagtgggttagagcaactctagcacgacacccccttgatcccctatagctaaacaagggtgcatagacttagaatgcaacttcagtagggatcctactaggtccctcaaatttgggtgggcacctaaatccccctttccctcatttggggatccaggacaagcccctaaaggacaattttcatcagcttttttgcgccaagctcattctctccttgtctgcatgtgatgtgttttcctcacctcacacatgcaactaggattttgtccctagcgagtgttggcatccaaccacacatgacatgactctcatggcccacacgatgagacatccataactcagcatgacctcgatggatagtgagtcctccccaatcctcgtcaattctcatcaatagtggttgcgcctgacacaccactctacggtggtggtcaccaacaccccaatgcttatcctcatcagtggttgtgcctagggctctcactttgatggcaattgtgccctactcatggttttgctcttcctcctccaatttctagtgtttcggccgagaaaatcattgataaaagaatttgaggtatcatcctgaattgaaatggatttgagggctattactagagttgctctaacggtaactcttatgcacccttaaaatgtagagcttgttaattatgattgtttaaggctcatgatgaagttgtttcaaaggaaatttaaacttcagcttttaatctatgaatctataagaaaaaataccgcctagcaataattattggtgttaaagtggcacagggcaatgttttttagggttgtactcatgtatacatagggatgtataggagaatgatttgcatggcaagtaacaacattgcctatatgtaacttt

SEQ ID NO: 4207 - DNA, 1187 bp, Zea mays
  misc_feature (1)..(100): optimal_loci_127005_G1, chr3:210518942..210520128, Cluster 26
agacagactactcttgctctcttaatatgttgtacagatttgaatatacgcacaagtcatcgtggcagtaatataaatttttactccattgacgagaaacgcgacagcgcactaacacgcagcatttcagaaaggaaaaacgtccagccttctgcagtgtcggtaacatatgtgatggtctgatgggcctgttatacgtagcttggttcatttaacttatcttagtaatttagattctcatttatttccttttttaaagtattttccattattcttgtgctttcatttcttttttccatttataatatttgatttcgacttctttcatttagtctttcaccttcttttaaaaattaatcgctggcagtgattactaaagtacatgttgtgtggaacggaaaaaaaaacctgtgttttcttttactctccaacttgtgcctatttcaactgatctcatgtccctgcactttgtgcattgattctatatatgtgctatataacgtaaatcaatcaggttcaagcagatgcgcaaattaatggtggaggacctttgctatatatctgatctctttgctacaaggccgcgaacggagactacacggccgggcggaatactgcacgcgctgattcgattgtttctcccacggcccacgtagaagcattccgctgccagaagcccagaacagccgccgacttctgtctactcatttctttcccccgccaagctggtcggatgttgcagtacatgtgcagtgttctattggtttgcaacgggtagggacaatgtcgacaagcaatttggcttctggacatgattagccgagcaaggatatggtttgcggttatgcatgtcttgtagcatcaccatatactaggtaccatacaagtcatcgctaaggaccgtgtgacatcgtgagagtatagacaacacttggggcggtgcgcggactagtcgtggtaagtcaaagctgttggcttacatatgttctgtgcggtgcataccaaacacaccacacgacgtagacaaaggcgcctgcgtggtgttgagcatatacgcgcacaaagtctagatgttacgaccggacggttcggtcatatgagtgtgatagtgcgcaatcagattaattcagaccagagtccctgtatcttctgaggttatcataatatctcaagagagtttgttagtt

SEQ ID NO: 4208 - DNA, 1320 bp, Zea mays
  misc_feature (1)..(100): optimal_loci_128207_G1, chr3:216242543..216243862, Cluster 26
aaagaggtctcaaatttgaatcataattatgacaacttaataattaattattgatcgctcctattgcacatgtgaggtttgggttgaactggttagggtgaggctttatgaccagtacccttgcttgatctttgcttactagacttattatttatggttgtgtgctatagactaccgatgcacatcttactagttaagaaattttatttatctaatgtagcatcatgtggagtcctaggttagaaaaaatagtaaggggattcactccctctctcgtagcttgatcatccttaaatctttactagggtcatcattcttttcaaaaagttaccacaagtggatatcttaataaggaactgggctatggagtttattttcacacatgtgacattttaccaacgacaacctccattgtatacatagttgacccaaaattagaattttctatggaaagacaaggaagattctagggaacatagtttttagtagttcttttcatgaatctaaaagggcatggccccctacgttgttttattagctcaaaacataaaactagtccaaagcgctaaatagaatacaaaatagttaaaatagctaagcaaacttaagaaacaaagaaggaagcaaaaaagataagaaaagataattgaccatgctagagttcatatccatgatatacgtgatttagagaggcttgacttcactctgtaggatagaagtgtcaattcaatgaagaagaatcttccacaatcctacaaatccaatttattccttcgaagctaaggtcatttctagtcgtctagattgtccaacacgtgaggattatagcctccatgtagaattatgattgtaacaggttttgaacaaagatgtggcttttgggaaattgttgtctattgaatagtcaatgttgatgatatcccaacacattcttggaaagtgacagtcatagaaagatgttgataggattcttctactagcacaatggaaagcacacaattatatgagtccaagtgcatgttttccctccttaagagatttctggtggttagctagcctttgatcaacaacaagtagaagaccttgtgttttggctgatagtaattcttcctcaacaatttgaaggtaggatcaatctctaagtgtcccaccaaaacattataggttttggatgacgagaggactctagaacctcaagtgtaccaaggaatcattacaaaggggcatcaaagcgattgtttgctaaatatcctacaagtggtggaaggcatctgaaaatgttgggtgaattactcttggttgaaagctttctttactggt

SEQ ID NO: 4209 - DNA, 1001 bp, Zea mays
  misc_feature (1)..(100): optimal_loci_129054_G1, chr3:220518715..220519715, Cluster 26
atacttcgttacaacatttctcgttaaaagttggcaaacgatttgttcaccgcaattttggcacgacgacatgtacaagtgatcatcgtgctgttaattattgctcaacatgtccattagtgttgaattgttgattactttactagtattagtaaaaagacatgttttttccactgtgatatagtaaaaagagtggaaatgctagatgtgacgactgcaagttgtaacctcttgacctcttcctagaatgaggtgattgtactcaacattgaccatgaaccaaacacctgccacatatatttgccaaattcgtgatagctcatatggtgctaaaccaaatagttaccatagttaaatctaccacataaagttaggcatgatagcgaaccaaacaccttattcttgccgcaaagatggctgtcactactttgttacatgcctaaccttggttgagaaaactttggctataaaccaaacatgtcatgaacttctatagctcaaattgtaaatgctaagcaaaatgtcagacccaaaggagacgcaaataattctactctagcaagaaagtgatggagacgcaaataatatcctatggttcgacgactcacaagtcacatatatccacattaaggtgaatcctagaatcgccacttctctatcaagactcaatctcaaaaggttgcctcctccacttggaggctggctatctaagtagactcgatgactagaccctatcgggccagtttgacaaaacatcttttgctcatgattctatgcatatgatagattacatggagtgaataaaaaaatctagtttttcagatatcaacctcctagtttattttagagaataagcgaataattgtttctcagtaaaagaattgtttggtagagcttctcttgtattgagcctggaagctgctctaccgaaatagacctcaatacccctgttctactaaagttgctccccgactgctataacaggcatgaacaaaagagac

SEQ ID NO: 4210 - DNA, 1102 bp, Zea mays
  misc_feature (1)..(100): optimal_loci_129067_G1, chr3:220661794..220662895, Cluster 26
acctaaaggacatttaaccacatgatcaggcaaacatgttcgaactataggacaacatgtttaaacctaaaggacatttaaccacatgatcaggcaaacatgttcgaactataggacaacatgtttatatcactagacactaccatcttgaacccaccataactcttgactctggatgataatgaaagtgttaggataaccactctaacacactttctagtgacagttaaatcacttaattttagcttactatgaaatcagcccaaggtttcaacctattcagacgagagaaaacaaatgtattagacttataaatggaggaaatgacagtagtagctgtagtttacaattgatccacacatcaagagggggcgacctatttaacaaggaaaacctcagattcagatagaaaccatgggaccaagccaaccaaatcttcttccactatatatttgtgggattatatcaagttcatctgtagatagcactagataaaactatacatcgtgatttatagatcttggatataaacaataacatttgtggcagttattagagtggaaaggcctcaccaaatgatgctcaaattagacgcaccaataatgtggatttgacaacattttcctaaatgctaaacggtaaattgctagtcacatatcgtttagctattattcaagctaaatggactattaacgagctacatagtcaattaaataggataaacatgtgattaaaagagaatgacataccattgtttagcatttacactatttatatgggctaaatgaccgttccaacaaacaatgggatctaaaatttcacaatcttgagaacaaaccttctctttaatctcctttttcctctctttcctattttttggttgtcttcctttctctcacatacaaggaggaaggggttggtctttactcacacacacaaggaatggatggtctatactctctctcccttattctggtcttcatgaaggggaggaatgagtggtggtggtggctgatgttcaaatacttccttctcctagaagctaaggaagcaaatgctagatgcacacaaaagtttatccacattccaatgctgcacctac

SEQ ID NO: 4211 - DNA, 1132 bp, Zea mays
  misc_feature (1)..(100): optimal_loci_129255_G1, chr3:221624403..221625534, Cluster 26
tgaataatcatgcattacttcattgcatgatcttaaaatatgtgtatggggatagttttttttatcaagagttagtttttcttttttatattaaaatataaaataatatactcagaactaggtcataagttaacactaggtgcctttagtattcagacaaagtgtgatgaactccaaaaaagtaatagcctctccaatcacaaatagtaatgttttaaacattctctagtctgcaaaacacatattttgactaccgtttttattacatttttaaccaaataaagtatatgtttagacaattacattttggtacaaatttgctcatattattgcaattttgaatttctaaagtcgacacatgaaaaacgatatggaaccacaattttgaattactcatttagttgaacccaatacatcacttaattgcaatcagagtagtgcctctgcgaaaccaaatacattaaggttgaccaaatattaaaatgcggccatatggactacgttctcttttgtttaattaagtctttgttgctgaatttaaattctaccacctaaattctaatagatagcgtacacaacttaattctcaaaattggagaagttacctcctctaaaatagcttagagtggttttaaattttgtttttattaatgtggcacatacttagcataccgtgtctacatgtcattggttttaaatcttttaacatttcactaaaaaatttggactcagagaaatatgtcaaaatagattactcttcgttactgctcttcaaaataggtcgcgtctcatttcattgtactcgttaaaattggtttaccaaaataccccatctaatagttttgaggactcacaagtgggtcccatttatggatatgaccaaaatgccctaagaagctctctgttagctgttactctccggggtaaaagggtcgatgagcattttctcggtgtctccctggatcaccgacaaacctgctgccagggtcggcactgagggtatacagctatgctaccgctcagaccctccaagatcgatactgtttgtctagcttatgtcaaatacatatatgttaccgataaatctctattcttgtttctttgttacatctctctgattttctggtaatca

SEQ ID NO: 4212 - DNA, 1211 bp, Zea mays
  misc_feature (1)..(100): optimal_loci_129586_G1, chr3:223350063..223351273, Cluster 26
actgtggttgaagaagagaatgcaggtcaaaaagcatggatgatggctgtgaagtccctagtctttctttataggattcatataatacatttgctttgtattcatgactgaagacttcaacgtctgcattgttttctaaggaggcaatcatgttttgacggtgtctcattgtggcatttgcatgaaaaaatttggttcccacgccaccaagagttgcccatttaattttccctctttgtttccaataaacctttgctgagacaaaagagtttgcagatgttgaagaagaatatccctaaagttccactcctgaattgttaggtcccttgtgtcgattccgtcatatttcaggctagagattcaaaatttatcaaaattctcgatgataacgttcgatgtggcctgataagaaattagagaagctcgaattgtcgtaatcctaatgagaggtccatgtagcatgtcgaggttgtctgtcatagaaacgtgacgaggtccattgagcttttgattattttttgataaatattactacctagcgcgccattaatttgtcggtacctgatgacaaataagtctattgtagggttacctagagtaagaattagtgggtttcggtataagcaaagttccatggtgaatacaagataacgatttatatatgttcggctggataacgcagtaccctacatcccgtgtggtataatgccctatgttagtttgttgattatgttaccaggtagtatccctaccaccatgtgcaggttgagttatagtgaactaaaaaaagttttaatctattataaaaaaatattctttcctttaatacaactagatccgtagcctttcaccttggataacatgccactttgttccgtagctagcacgatcggatcctgcacagtcgctggtatttcggacggccaagcgcgacaagccaccgatggcggccatggacgagatggacgagcgagatggagagagaaaaggacgaaggacaaaaagaaagacaacgcaaccttattttccacttattaatgacatgatgtataattattaccaattatatatatccatgatttttttagagcactaatttaagtgatctgtagattgtagaatctaacaggtagattcaagtttattggaagatctggagtttacggagctggttcatttcactgaaaaagttagaagtgaatcagttcttt

SEQ ID NO: 4213 - DNA, 1127 bp, Zea mays
  misc_feature (1)..(100): optimal_loci_129949_G1, chr3:225218263..225219389, Cluster 26
aatcgtagataggcctaggaaggattccatataagttgcagttttgtctagattttttagcagagagtgttcttaacagagacattcttaatctgcagtgacatggaatgtgatatgcacatattcccaatttattgtttggaagtctcaatcctaccgtgtatctctctcatcgtttcataatgacagaattgtgaattgcccaacatgctcatgtgactaccagaacccaagtgggtcaaactgcgtgaagtgactttatctgctttttactcttaattcatgtcatatcagggtcctgttttttatctgtaaagtttttaattagttttgttgtattttgtaatgaaatgtgtttccgctatttgataaagtttcacaaagttacgtagtgcttcagtagttgaaataataaccattttattaaaaattttactagtattgtacaagaacaaaatagatatcaaataggcccttctttacaatctttaattcataatgtatgatacagttacaaaccataatgttttaacaactaacatcatatatccctcatgcataaagtaaatatttcatgcagggccttttgaaaggaacatagggtgaatatccacaaagaaaaggtattattgtcataatctcaacataaacactagtattatgttactactaacaatttttatcttgttctataactttaccattcgctacttgcatgtataaatgatttgcgctagagaactccttgagtgatacctttatatttgttatatacatagttacactcgcttctccatgtgtatctatatgattttccccaatggttgtgtaggcatattagctatttatttatagaacaatgtgtcttaagaagcaaaacctaagaaatttgcctatgaaattcctctccatctttattgtaggaagaacattgtacaactttttatatgtaaatacatgttgaatcaacttctatcactcatctaaacaattttgttattatcgaaagctacaattaaatagactttaacttaattacaatgaagaacgcgtgctggcaatgagttgaacgtcaagaagcaagattggaggttagaggaataggggtgccctacctacgagtagtg

SEQ ID NO: 4214 - DNA, 1015 bp, Zea mays
  misc_feature (1)..(100): optimal_loci_129983_G1, chr3:225330654..225331668, Cluster 26
ctaacaagtttggcccacatgcttaactagaaaaaagtgcaaaaaaaagcgagaaaaagtacgccacatggatgtgagacgaagttaggcatgcggcacgagtgtactttcagtacaagttcatccatctattttaattttgagggccaggaaaaaagtgcaaaagttcaccacctgaaaacgatggcgaagaacgactgaaagttcgctctcgtattcgtactacatgctagctcagcagtcagcagcagtgatttcccatgcattcttcgttgccatctcctttagctctattggctccggccgccgccagcggactgaggacgacgaggacgacaatcgatatgattagttagccgcattgtttcatcctgaatcacgagatgcgttgacttcgtttaagtgtatgtttggttggctgcactttaaagacatgttctgcacgagtagatacaaaacaagacatttggacactaattacctacatccactcatacggtcgaaacgaccacagccagcttcgcgagcgtggctgcataggtgcgagaaatcaatcagccaaaatgagactagctagctagtatcatgacacccaccatgcgtcataaagtgtttctgattcctacgagaatcgatctaagccagaaacgtttcactctaattaaacatgtctctttttatacacaccgcatgatcatgcatgtctcgctatttttgaggtaccagaacttttaggcgacaatctactagtataacaaattcttccatctgtcccaatttataattcgttcaattttttttaaaaaatatttgactgacttgtcttatttattttttaaatgaattgaaaaattcaaaaccacacttaaagtattatatgacgatagatcatatctcctagtaaataataataataaattatgaatttgtctcaataagacgagtcaagcgagtagtatataatttaaacgacaactcacaagaaatactttagttttttatatagtggaacagt

SEQ ID NO: 4215 - DNA, 1150 bp, Zea mays
  misc_feature (1)..(100): optimal_loci_130118_G1, chr3:225762963..225764112, Cluster 26
ccgttttaagaaggaagctctgttatacccttgcgctattgtgtgcagttaacagcgttaaatctaatagaaaagacaaaaacatcaatgcagtttattgttattttacccctcgtttcgatgacgtgataaaaacatgggtaaaatcataaatatataatatagcgcgaagtaaaatcatagtaaattatatgggcatttttgtcttttcacatcgattttagcataatcaaccacacataacggcgcaagggtatgacagaggattgttttaaaaacgaagggtaaaatcacaaagttgaaaaataaagggtaaaatcacaactacaaggcctggaaggggtataatcacaattgcatgtctagaaaaaggaaaaagcaaaacaagtagaagtgagtagggtcaacaagattacaagtgtgacgaaggacatttttatgttatccaaatttatccattgattgattacttgtttttagagctatattcattcatttacgtataaaaactctcttgcattttcttttcacttaaaattatctaaaacaagatcattttagtaacaacatgcattataaaaaacggaagaaatctattgaaaaattatatcatgagaatataagttcatttaaaactatattatcaatatctctaagaatattcgggactagttattacattgaatcgaaggaagagacatgaatccttatcccagaacaaaagaataaaaaaaggaaaacattttttattataaaaataggtgtttggaatataaggacatgtaaatatgtttttctcgctactaataaataaggaattgttcatctctatgtctacatgtaggaaaacattttacaaggttaaaagatgtttaatttttttattttgtaaagtaaaacatgcctttctatagaaaaaagaaaacttcatgtcacaaatcaagtggtgtacatgatcaaattcctgcaattctcatttgacatatgtgtcaacatctagagaacattataccctccgatcaccaagacacattcaaatattctggtaaaagaggctatcattgagccaattatatggggacaaacaacacctaggataccattgctagaggacctccctctccctaacataggagcccctgacaggttc

SEQ ID NO: 4216 - DNA, 1017 bp, Zea mays
  misc_feature (1)..(100): optimal_loci_130457_G1, chr3:227490008..227491024, Cluster 26
ggatcttccaagagtgccatttcagcggcatacctcccaatttgaacattaccaaagagacggcaggcactcagcaagctcctccaaacagctgccgctggtttgattggcatcttttcaatgaactcctgagcagaatgtaatttccctgaacgaccgaggagattgaccactgaagcataatgctcagtgcccgggtcaataccatattttgatttcatagagttaaaatggtgtaagccttcatccacaaggcctgcatgagcacatgctgatagcacaccaacaaaagtcacatagtttggttctactttggcctctctcatcagctggaaagcacaaagggcttcttcagcatgaccatgttgtgcatacatagtaatcatggagttccaacaaataacatccttcccacatgttgactcaaacagcatccatccttctttaatgaagccacattttgcatacatgtctacaagagcatttgaaacatgaggattaatgtcacaacctgctttgatgatctgggcatgaaactgctgcccatgaaacatgcttgccaagttgctcgccacagttactagtgctacaaacgtgaactcattgggtgtcatcccagagacacgaacctggttgaagagttttactgcctcttccccttgctcattctgtgtgtggccaaatatcatagcattccagatggccatgtccctgttttgcatcataaaaaacacagccttggcatcatccacaagggaagattttgaatatgcatcgattagagcacttcccacatagaggtcgactgaagttcctgatttgatgatgagaccatgaatctgcttactccattcaatagatgatagaagtgatgacatcccaaggagtgaaacaaaggttagtaggtttggccttatggagtaatatttcattttacggaatatatgaactgcttctgtaagatcaccttgccttgcatagccttcgatcatcgcattgtaagagactacgtcatca

SEQ ID NO: 4217 - DNA, 1039 bp, Zea mays
  misc_feature (1)..(100): optimal_loci_130897_G1, chr3:229992101..229993139, Cluster 26
aatacaaaaacaacgcttgaagtttttcttaatcagttcgatttgagcttggcaggccgatatgaggatgaggcaaaagcagatatggatgcctacttaaataaggcaactacaaaaactgcatcgctaatagaaaaacaggcagcagggacctataccaaagcagtcttcagtaggtttcaggaggaatttacagagtctctagggtttatcattcagaaaaccgaagacggctgcataagtaaatacagcatcacaaaatatgaagatccatcagacacattctgcgtgacttataatgcttccaataagatggcaaactgtagttgcaagtactttgaattctccggtattctgtgccgccatattcttggagtatacataatagttgatccacgaacacttccaactgaatattttatgaaacgttggacaaggaaggcaagagatgatgatgctttgttagaagataataacaacaatactcatgatgaggatgcttctcagtccaccacaagccgctacaataccctatgtgctgatgccatcagatgtgctgagaaaggagctggatcggaggcagtatataaggcagcaaaagatatcttacagaaggcatatgaagagattattgcttatgaaagaaatactggccagggatctcaaagggatgttataaacatcaacgaggatgtcacgattgatgatgcaatgaatgataaatctatgccagattctggacgaaaggtacacctaatatcgaactgtaaattcttcaggagaaccatattcttgtcagcattattctgtgctatgagtgcaaggacagtagatgatacttatgagataagttgtatgtttttaacctgttgagacgagcagagtgtgtctcattaaaacttcatacattttcctatttttactcctggtgctaactaaatggaataatatagtatctattatgatcaacatagtcttatataatttctttgatcaaaagctacacagaaagaatgaggcatttttgtttccctttcag

SEQ ID NO: 4218 - DNA, 1168 bp, Zea mays
  misc_feature (1)..(100): optimal_loci_130967_G1, chr3:230520318..230521485, Cluster 26
tctaatttgaaaggtgattataactctctgtcatggaaaagtgtggatgcatcatgtcatattagctacaatgaggcaagagctcaatggaaggggaaggcctagcgacaactagtagcaagtccacatctacgtaaaaatatatatgttaaagaagttcataaggctagctagaggattacttaaactaaattgtttgagaaattaaacaaattattgaatctctctacccgctaacatagaagaagacaaaaaaaaaaccatagattggccttaaaattgacataaattgtttttaattatttgtatggattacataaattttatttgcgtaattatgtaataggatgtgttatattgtaataagtaatgtgtttcatatcaactaaaaagcctataaaattaaaaatggatgtcacatcgatgtaacagcagtctaatgctaataaatattgtacaatagaatgttccgataaataaagtataataacaatgatcgacattacctgatataactgatataatgcgcgtagtattagaagaacctggatgctcgactgctccccaacaggaggaaccaacagttcctgtccttgtccgttccagcccagccacctgccagcgcccactgccacgtgggacccagactgcgacgagtgggcccttcaccatgtgaccggggtcgcacggacggatgggtccctcttcccaccacccgcacatacagctgggcctacacggtgcgcggggcccgcagtgggggtcgggtcagattggaccggtactggcgtgggcctggccgggccaccatgcatgtgatgcgaggcggactggcatgcccagcccaaccatgttttcagtgagtaagaggtgtggatctaagtgcattttgtttggtgaatttagtgaggtagatgtgatttagtagggtggatcttgcaaaatataaacaggtggattatatagtgatgattacgatgatgaataagattattaaaccatcccaactttttaaaagccaagcttagtttggtaattatctaaatataagtgcgtccatggatcacagccccctttttactgtccaaaatctagattatgtgttcgtttctagtttacaactcactctctgctttgctttagtgcttctcatcagggccgggcgaat

SEQ ID NO: 4219 - DNA, 1027 bp, Zea mays
  misc_feature (1)..(100): optimal_loci_132256_G1, chr4:4482201..4483227, Cluster 26
ataaaactgaggaagagagaactaccagtccatgacccatgaataagggaaccttctgtttcataaagattagaagctccaaacttctgaagctgttctttccccccgaaagcaaggtaggaaggagatcaccttgcacacacttgcatgccttgcctttgacttaatttgtggctgggctctttcatgttattttggaaagctaaagcaactaattaacttccatgatcatcagcttgtgtggtattatgtctccgatatgatcctgtgcaggttaagcagttacaactagtagtaagagtattttgtgttgtttagactctgatcactcagtgggcaagtaagccttaagttaatttgtttcagtagcatagtcaatgtacataaaataactccacatattgtgattatttactagaaaacacttccagtttaatttggaatgcgatttacttggtcgtttgggatttactgggaattaactaatgctttatttaaatagttgtgtccacgcaggtaccatacccacgattattaccactggcttcgtacatcaggatggatgaacaagaaggtcttgctgcttcaagaagtttgattgtccatccacgcccctaaaccatgcatctatatggaagcctttttcttttctgtgtgggtacatagctttagaaaggaaaagctgcagtctcactctcgctatttattcttccaacgctcgattcttcctgtctctactcttcctcccctttcttctcctccatgtctcgagggctcagaagattatatattaaccatctatatggatgcagaatatatacgaaacaacagtactcttctctttattactcactccatccgaatttataatttgtttgacttttttttcaacatcgctgaaaactattgatgaccaaagtttgagaaggtttgtgggatcttaattactcaaaaggttatttttatggttcaaggtcgccaagatatttgacaaaactttatcaatcttttagcacaacctccacat

SEQ ID NO: 4220 - DNA, 1377 bp, Zea mays
  misc_feature (1)..(100): optimal_loci_132435_G1, chr4:4875769..4877145, Cluster 26
gcaaagtaatataggaaaccacgacatgtgtgatcagttttattagtattaatttacttgtaactattttatggttggtcacaaggaagaacacacaagcaagaatgaggaaagagagagataaggtaaagatgaaggtatattgtgcatgtagtgaggccagtaccgagggaactggagatattatattgttctgcagattagttgacatgatcaccgtgcaaccgtccgatatagtcaattaggatggtgcagtgcaatccacaaacatcgccgggaaagtggtgaagcagttgtgtcaaacggtcccaagaacctgatcgggcgcctacaccgagtagaatcgatgagcagtgcaatagtggaagaagtgtctatgtctggtgtatctcgtggagtggagggaggccagcacattttatcagatggacgggacgctccactagtcagctgaaacattgaattctgcagttacctagtaaacatctgagtaaatcagtcgttgttgttggttaaagacatcattgttcatccgttaccgccaaatgaaaatggtaaaactttatgacgccaagcatagacacgtcaatcaagtatcagattgccacgcctcgatgcggcgcacatgcgtgtgggtgtggcttcaccttccacacattcaacttctaaataagtagccactggaatatgctatttaagttgattaccattttttttcatttagtaatatggggattaatgcccccaacaacatttagtattccacacgggccttggagttaatcagacaaaaaaaaactcatattacaattagagccaagcaagctatatgtagagaatcagtaaatatgtgaattaaaacaaaaacaatatcacacataagcaatgccatcgaaatttcttctctataccgtcgcatgtttaattatgcttttactgagtgaaagtgaaagttttttctctattcgaaatttcttctctataccgtcgcatgtttaattatgtcaccaatcgtttaactcatgtacttgaggatgttgccattcattttcttttggcactggtagttctgtcgactaggattactaacagataggtaggtcgacaacatcaatgtactcgatactctggtttgtaccatgcaaatgtcccaaaaaaagggcatcggtgcctcacaataaaaaaaccccagtagcattgctagcactatcagaggccactccttgatttgtgcaatatttgtctgaaccgcacgttgtgtatccattatcaacttcattcgagagagccatggtcgtaggattaggaagcatcgggagaaatatcgctgcttctgcatatagtttatagcggcagggtggctgacttcatctgctg

SEQ ID NO: 4221 - DNA, 1076 bp, Zea mays
  misc_feature (1)..(100): optimal_loci_132475_G1, chr4:4995914..4996989, Cluster 26
gagtacctgtcagatacatatgcagtggtagatcacagatgagcggcagcgacaaaccacaggacgttacatagatgtttggccagctaaagggcatgcaaagttctgaacacacaaagtggatgtggatccttgtaagaaaatgagcccagatacaggttgccagcaaatcagccctactcatcagagatcactgttggcccatgaatttattcagtaatagcagcgtaccagcagggggttccgagtcagtagcatattcagcattcaggaggaggcaatgaaaactacacattgaactaggcctaagtgggtctttctgatccattacttctgagagtgtctaccagccgtttcacccaattactacacattacagtctgtgttttgcatacccggttgttgatttactgtccataagcattgttttactgttactagtattgttgatttactgtccattaggatggcagaacaaagcccctagctcagcaggttttactgctaccataccactctccacttcaagttaactgtggtccactccactctcctcgcttctgttactcggcgtgtcatattttctatccacagctgatccaggtccatctttgtcgatgaggaacagcaaattgaatgagcagcgccattcaaatcatacttgtactatactggcacatcattccatgatgtcctgcctaggactgatgattcgctgaaacaattgatattatttttcagtgtactgtgtatctcgtacgtacgtatacgtacgggtaaaagctctgcgggtactgacgctctggatcggatatactcatatttactcactttgatcttcgttctgaaatcataatttactcgagctgttatttggtggtagagtacatcattaatatggatgaaatacactccaaactatggagcatagatgattctgattctaaatgtactggatgtcctttttttttctctcttcccgtgcttatattcatcaaagtttgctgtatttttcacactatgagctgcttgggatgggacaggcctctaagaataaaataataatagtaagatta

SEQ ID NO: 4222 - DNA, 1016 bp, Zea mays
  misc_feature (1)..(100): optimal_loci_132477_G1, chr4:4998073..4999088, Cluster 26
atggacacttccaatgtacaaaagcacataggttaatgcatcaatggtacaagataagcctgagattaacatagctatcattgcactaatcagtggtcctgccaaacatggaagaggtggtggtggtcctgtcccgtaccccaacagctccatatgtacctgctacagggcataacataattgctgggtggtgtatcagatttgtttcagtgtagtgtagtggagtcaatcagctgatggagtatctgatctgatctgctgtggacgcctggacctaaccctccaccggtttcagtggtggcggcattgattattagtgtacatgtagaaacatttgtcatccacatgtattataagactggcccatttttattgttttcaaggcttcagctgtccatcacttagtgatgttcttttctacacattgaattatacggaaaaacaatttatttgtttaccaccttttttcctttattgatttaacttattgagattaagttagagtaaattaaaaaaaaataagtgcatatcgatcttgccagaatacttcatggtttttactagaagttactttgaactctatgatttagtttgaaattaggcacctaattcaccatccatcctccaatctctggcgctcaaggggccttgcactagtgataatctttacatagtccgcttattaggttttattctctctctctggccgatcattggtttgtgttgttttgtgtttttcgaatctaagaatagtttgcatcgcctattaccaatgtctactttgacatcaaccttgactcatcagcctcatcttcgtctttggttttgtggtttggcatggcctgtgacattttagtgaatgtctccatgcaccacttctacacatcttcagatgcatgactcaaacaattagtttgtcatccagtccactttctggagcatctcaaccacaactcccaccatacataaccctaagcaccaccctaacgtgtttagtgcccctcataagtattaac

SEQ ID NO: 4223 - DNA, 1065 bp, Zea mays
  misc_feature (1)..(100): optimal_loci_134853_G1, chr4:16127175..16128239, Cluster 26
caaattttctcaatatcccgagcagtcgaggcctatacttgtaggacaagacaaacttgtttcggaaataaatttatagagatgaaacagcctagaagaagcaggtgtcgaaaaattcgtctagacgaggaacttaacttgacaatctagcttagcttcctatgcttcttctacctgtgctatttagctatcaatttgtacattttttaatctaattaagattacaagttgatgtctgtgtttccctttttgcaaaaaccagtacagtctaatattgaagaattgtgatatactagtactaatcttttggcaggaccaggctatgctaacggagggtgggtggatcgccgttgaccgttcaatccgagaagcagtgggtcataacctaatccagtgctcttccacgtgtaaagagcgggcagagcatgcacgcccgcaccaaatccaatgtgcgaaactacatgtaatggtatatttttagatgataggattaagcgagccgctgagctagatcgctcgattgctgtgacaccgatgagccaacgaactgcaatggtgacatcgtttgattgcgacggttcgtatggggaaaaaaaatgggaccatcagggcgttcagcttcctgctgacaattgtatttgtgagtttggagctgcagtttaaaggaacgcaacacaatcctttcgagtggatcgacgacccaggactgagggaagtatgggagcgattgcattagagcaagattgatgatataacttatagtggattttatgacgttgttatgttatatatacctatctaaaagtctaattatataatagtatatacaatctcatttgatatgtgatgtcttaagcggtttctaggtgtttattgaaaaaatacagtctatcactacaaaggactctctatacacatattgtatcttaattgcatttatgatctgaggggtcggggttgtatcattaagtcttgtagtcgtctcttgcacttgaaaacccgatcccatggactaagggttatacatgccctaatccctcttatgatgtaggttgtatatttaat

SEQ ID NO: 4224 - DNA, 1267 bp, Zea mays
  misc_feature (1)..(100): optimal_loci_135533_G1, chr4:19116477..19117743, Cluster 26
gcctctcactgaggatgtccgagtcttacttagatgcaagttgattatctccttctcagtcatccgaaataaaaagtggtagcatgttgttttgatccatttggagcaagatgatacaaccattggtaagaatgtcaatactggaaagccttaaagtttttggggtgaaggcttgtgtttgagagagaagaagatggccaaaacaatcttatagtcgtagctagatcaatgaggtctttaaaaaagaaaaatgaagtggcagaaacattgtagaggttggttaggcctaaaaatggtgtcggccaggcgactttggtctaagtagtgttatagagctaactaggccaggcataggggttagtggggccaagttggctactaggctgactacaggagttggctagactgactttaccacctttagtaggctcaattcgtcctagtcatatacatatgtgccaaagatatcgaagattagaatgtgtaaatataatgttgataagaaataggggaaggttgtgaagcaccaatgcacctttgatagactcataaaagaaatataggtagtaaaaggtcaattctacaaattcatcattaaaaaagagatagtctactcctctcaagcaagatgaccaatccaagcatattgtggtgtctctatcatagcaaaaaagttattccatgtgtgtctcattgggtcctctaatttcacctattacataagcaatttgagagggggctatggagtttggtttctttaccctccattgtcattagtatatcataaaagaagtgcaagtcatggttaggtgactacatcaagaactttgactcctcaagaataggtaaatgcacctatgcaaatctatgtacctaagaagcaagaggtgatttctgttgctactacaccaaaatctaatgatctgccatttattacaattggcttcacaaaggtcccaatcataaacaataaagggtcagttacagttgaggatacgactcctgtaatgtgccaagatggatttgtaagtgttgttggagatgttggaaaagcgaagtgtgctaagaaagatactaaatacaagcaactcatgtggtgtcctctagggttgtccaagagacatcgacgaaaattgtagcatgcttaacacaataaacagaagagggaaagttggagaagatgaggggagaaatctttaatgcagtccaaccaattttcctaaaaaataagcaatagaggaaaaaagttgaaggttcccttgcaaaa

SEQ ID NO: 4225 - DNA, 1142 bp, Zea mays
  misc_feature (1)..(100): optimal_loci_13679_G1, chr1:75391509..75392650, Cluster 26
tattttgagtaggttctgcaacaagtataatttgactgttgactaggaatgtaattttgagatcaggttgcaaaacagtagcctcaaaagtcaaaacacgtcagatacacttctgcaaaccacgaaagcttaagtagagatgtgagatcacacgcaaaaaaaaaaaaaacaaaaaaaaactcacacatggattcggaccggacctaggagactatcagactactgtgcgttaaacgggcattagtcatgcagcgttgattttattgcccatatctagtagcagtcttcgcagtaaaaaaacagtttacgactagtggttgaaaagtgagagagaaataactgtctgttgctagacagctgcttcggctgggtaaacaggcagccgaacaatcttggccattcctttatggctccgtgatgtcaaagttgttatccatttggaggtaacttgttctttcattgctttctttgaatctcgttactgccaaaattctgatgatacgatgaatgaaaattctaacaatccattgttaattgtgtagacattcaatttgggatatataaatacatgtagagagagacttgagtgcaagtaacgctggtttagacctattttgtctttggattgtgtttgccattagattttgtatacgactactccattatctctagccacacgcctatttttatgtactgataacatcatgaactagctagagatataattgggtaagatcatatatattttacgcaattctataccatcgacgactattatataagcatcgtccgactatctctattaacctaacctgatttaaaattgcaagctgcatatcatgtttgtagttttcttgatgcttatcacttcgtgctagtgttacttgacaattgcaataagtggcgaagttagagcagaattgagagggcacacttgccttgtagatacatgattttttatgtggtacataaagggtgaaattttaattaaaaatatatagatttgcatttttgggtgcaacatggcgtcacccctgattgcaatagatacaaagttgtagtgggaactacttaccgacctttgtacaactgacttcaactatatactagcaaaatatgtgtgcattacaatataccatatt

SEQ ID NO: 4226 - DNA, 1334 bp, Zea mays
  misc_feature (1)..(100): optimal_loci_137708_G1, chr4:31249686..31251019, Cluster 26
cgtgccttttcaagtggttgaaaaggattttttggactgcacaacaccaatcctgtaggtaccactgtagatacagagaattaaatttaaatattattgctgaagataaataagatatagagaacataactttttagagaatactgtaaaaaatataaaatatttttttagagatcgaactttaaaggatgttgtagacatccttagcggcatctgccgacacgagacgaggcagcaaagcatgctcgctgcaaggacgattactactgcaaagttctccatgctttcctctgtacaagacggggtccagaccacccccaaccacggattgtcgcttttggtggatcaatgaatgccctcaaaaagttgatcatggactggcgcgcggcggcggtgagtgagtttactgcacggcctgccagtcaccaacgatggaagattgcctacctagagttatacgatgatctagtagagactggcatacatgcatggagatagagacacgccagaatgtgtgtacgccgcccgcggcccgccccctttcttccatgtgcacgggagtatgtagttgtaggcgcataccgaacttgccgatcgaacataattcttctgatccgacaattaagactatgtttgggatagctttagctctaaaaactttgatgggttagtaaaacattttagaaaacatttagataagttatttcagttattatttatatttaaaatatgattaaatctatttagattgataatataaactacaacttaagattcaaaaatatgattaaaactatttaaattgataatctaaactatatcttcacactgaatttgaagccatctcaaacatccctcactaaaggtcatgctttgccgaattttggcatgatggcgtccatgctgctctccagtccacactggggctggagatgggaatgtaaagatacaaacgttgcaattaatcatacccgtattattgagccttgacatgaaagattccatctagtattgcactatcgtactagcacatacatacatacacgtacgcaccaaaacactccggccgtcggtgtgcagtgtgaaccgaactaccaagcccgtacatacacactaacactagcttctctggcctctccctctcactctctcgaggacacaacagtagacgacatgattctctttctctctctccacatatcatccatgattgctagctgcttcaagcaacaagcaagctaaggtttactaccaagcaccaacgcaacaagcaggcgacatgatcccaattatacatagccaagtgggctgtactatatgggaccgatccctca

SEQ ID NO: 4227 - DNA, 1151 bp, Zea mays
  misc_feature (1)..(100): optimal_loci_137709_G1, chr4:31251094..31252244, Cluster 26
ttttagtatagtaaggtaaagagtcagatctacgatgcgatggatttttcctatcataacaaactcgagtcattctatgttcacgttgatttgaacaatattcaccaaaacgattctcgcttataaggtgaaccaaagcatgcacttcgttttttcttggcacctgttcagctggttcgtttgttgtctaatttctatttaacgaggattgaagggtgtttttctttgtcagatcaagaatagccgaatcgttttgtaaaattaaatttgattatttttagaagaaaaacgtcttcaatagaccaaaatgactgttcagatttagtagctttccacctctcttcattcaatctctatttttgaatagcttgctttactcatcattcagtttgttagtttacaataatctgctggaatagtctactttttttaaaaaaaaattattttagataaatgctgaatcttttgaagttgtcctcacggtatttatggacgtgcacatgaggagggtagtagacggaaattttgtcttcctatatccaccgttcgtcttaatagcgtgttgatttacagtaatgaattgttttttttataataaacaatcggcaaaattcatattgctctcaagttcgtgtcaacagatcaatggatagcctttgcagcgcctagtgtttttgtgttgatcgtccacttttaacggcgcctccgtttcaacgtctcaactctcaatcgttgccatttgccactggacccgggctgagagggtacgtcagaggcccgtcgttgcggggttgcttcctcttactgggcctggcctaacaggcgcaagccgttacacgcggcctgctaaagtccgctggccggcgggacacggacacgagcacgaaacgctgggccacggttatccgtttccttttcagcgtgaggctgggaccgtgacagtcggctgcagcccgttccctccgtgtgaggtcggcccatatactgcatataacttcagcctattttttctttaaaaaaagctgtgctgcagcatataacgtcagatgtttgtgccgcactacaatttagtttaatggttaacaatgtaactctcaatttccttcaatctacgaggcacattggcaatgttatcaggttcatccgtcgcc

SEQ ID NO: 4228 - DNA, 1038 bp, Zea mays
  misc_feature (1)..(100): optimal_loci_138653_G1, chr4:37009178..37010215, Cluster 26
aaaaaattgttgacaaagggtagttatcaaaacttgcaaaattgtaatggaactcatccaaatagcccataaatcaaagggtgcaaccctccaactttgctaaccttaccttgctcctctccctcccatttctatccccctcaccccagcctgcatcgaccatgccgctaacctcccatcactagcctcccctaatcccaatcgaatgaggaattgttgacctcattatcctcgttgcgcaccctcaactctatccccattatcccctaatcccaattaaaggaataaagctaggtccctcaaccttattgtttgatctatcgaaccaaatgttaccccactaccttgcccatcgtccctccaaccactaccatcatcggtctagcggctctctgatgcctcctcttccaaacatgtggccacaaatccctctccttgacatgaaaacttcaaaccctaacccaaaacaagagtctgtcatacgtccttaaaggttgaggagatcgcttaagaataggtaaccatcagatttggcttcttaatttctccttcattccaattctatcttacttatttgccggaggaccttaaataaggcggagaacatcggagaagaagaggtaactattagatctcgcttcttacttcctccttccttccaactctattgtacttatttcttttttggttttggttgagtgagacatcaaatttatttccatttttggggctctcgatttaagctaggtctatttgattctagaaagaggtatgggtttgatccatcttatttttttgggggtgggatgtggggttagcggggatagaatggttctatcttttgtgtttggtgaggggataataatgtccatgttccacctctagtctcccctaatcccaatcaaacgaggaattgttgaccccattgtccttgttgcgcaccctcaactctatccccattatcccctaatcccaattaaaggaagaaagctaggtccctcaaccttattgttcgatctatcgaaccaaatgttacct

SEQ ID NO: 4229 - DNA, 1054 bp, Zea mays
  misc_feature (1)..(100): optimal_loci_138700_G1, chr4:37326912..37327965, Cluster 26
gccacggacagctcatcgaacctcaacaatatattatatattttttttctgcattgcttcctactacttactgtatctgccagcgtaatatatcaatctagcctttcattttcttccaaggcaagtaagcacaaggaaattgatttactaagctaaagaaaaagatttattggggggcgcggatttggatggaatgtgtttataatggctaacggattgcgaacaatcaagctatagccacacacacagacacagaggagtcaatgtccaacagtagacgaaagcagaacaacgtgtaagataaccggattagctgattgagatagggctaatggcaagctttgctccaaccctttctcaggcatgttcgctgtggcttgctacgattttaatctggctgcgactatgacttttacaatattttgtctttatagattgtagctgcagccagactattatgcatctatctatgagtttaaccagcaattgaggaggaattttagaagaaaaaaaaatgaaagaaaaaatgcatgcgtgcaggagggatcatgggcactccaccaccctgtatgcaaccaaatgtttacttgtgggaagacaggcaaacaagcaagcaggcaaaacctaaaaagtaggctaaggcatgatgtactttgaggatgtgatggtgggcaagtggatagcttgttcactttctcctgcggtttggagagaaaaaaaaaaggtgggggaaagtgattagcaccagcttagtcgcgagtttaggtggaaatgcatgctccatggctaactgaggggaccccctccatcaggaaggaaactaacaagtggcggcaaccacgcacagacagcttggtgtcgtagatgctaaccctatacaatacaagacaacaaaagcagaagaagcccatcagctgttttgttggtttcccccagcttcatggcgttcgttcgcttgcacgcgtggaccggataagggacgacgtcttaacttgtcttttggtactttctgtcgatctgatccaaaaaagggatttcattcaggcttcaaatg

SEQ ID NO: 4230 - DNA, 1393 bp, Zea mays
  misc_feature (1)..(100): optimal_loci_143784_G1, chr4:68792934..68794326, Cluster 26
ttactcacctggcggtgtggcatgcatgcaacttggccgccttggaattcgttcttgaaaaacaatgttttgtttcctgttgagcatggattgttttcaattggatgtacgtacgtgtcactaattggttcctttctgtctggccttttggtggttatgttaaggccgggcgatagtttgcttactgacgatgctacttttgtttaggatagcatatagcacccttgttgaatatatatacacactaccttaccttctgcagaagcaactactaccaccactgaggagacgctgttgttagctagcatcgtgtgatgatcttcatctaccctcacttgcttgctagcttctggtttaactattagagcaaatgcgtatatatacaatgatatacaggatggtattgcatacacatcatccaacgaaggaagctgcactgcaagcatatatgcagcaaacaagtcaaaagcgtactcgccggggtgtaatttcgcggacctgcttcgcctgaccaaggaagagatactgacaagacggtatgtgtgtgtgtgtgtgcacaacaatcgtacgttgcttccaatcaatagggcagccagtgctggtagctcagatgttgtttgagtatcctgtgtatccatacggtacgtgtactgtccttgggcatacggaagggggaaatgaaggatctgatgaagaccagaaaatgtgactggttaaacattctgcagtagctagctagctagaggatatgcatggtacgtagcaagttataattaactaggtttcaaacaaaaaaaactgtttccgtttaatccttttagtatcacactgagcaatttgagatatcgtgtgcccaaataatcatgtaaatcaagtaccagtttttggggaaaaaatgtactaatcagtttgttgccagcgtgtgtacgtgtttccttttatatattttctatatatataggactaacagatccgatgcatcgttctaagtgcacgcatgcaccttgatcatgctgttctctctttgcatgcatgcaatattgcgagagtgtttcggcttgttattctcatcaaactgaattgaatgggcaattgggcatcgctgtcacaatctatatatacattgctagtggattatcacacaatatattaattaataataatcgctctaaaaccaaccaccccaattaagatgcgaggtcccttttttttttctcgcaaacagaaagtgcacgcaggaaccggaaaggtcgtcaatgatccagtgatcgatatgaaacacagacaaagatgcatatgctcccaaaacacagcctacttgatcctcatcgccaactgttttttaccgcatttattaaatggtttggaacgccgagattaaatttcataggat

SEQ ID NO: 4231 - DNA, 1069 bp, Zea mays
  misc_feature (1)..(100): optimal_loci_1450_G1, chr1:7557487..7558555, Cluster 26
tttaggtcttatttggtaggactcttccatcaccggcttcaactgtgcgtctagctcatatgaaaaaatagcttcttccatagtttcaagaggagcccctatagaagcacttcatttggttgtaaatgcagtttcacctatttttacgagagataatgacgatatagagagagagagagccgaagaagctttttttgggctcccggctttactcggtttttaggacaacttattcctatttttatggagaagctagagagtacctcaacgtttggtagattgtgtgaagaagctgtcgaaagtatcaaaggtggacttactagggagcacacttctgtatgggtgagcatgtgcttattctctcttcctccagcaccttctcctcatatatttttcttttttatttctccctttcgcccttttatttattccttattcagttattcttttaccttccgtttctgtttcgatttgcatatgaatattaaagtgtacaatctataatcaataatttaaacactaacattttattataagaattaaactaggtacggttacattttaaccatatataatattacaaataatcatacacaaatgggtaatcagtaaaaactaatttacgcagaaaataatttatttctcctaaaacttttactgctgtaacttttgaataatattcgaaatttaagcatattctaatcacataggtttttcaggataccctaatcgttattactacctttgctgatttggcaaccgtcaatttaaccgacttgaatctttattttttgtctgtcacaaagtccactgtactcggttggccctgcccaaaggagcaagtcgtgactgactcttaccctaagcacaccatgccagtccagccaacagccgtaagcaccggcatgcccttacaacttagctcttcctagcgcccctcaccctcaagcctcatcctaaaccaactcaccaccttgtatataactcctttactgtggagtctctgtcccaaaccctaaatcatttattctcccttccctggccatcggttatgtgccctcgactcatg

SEQ ID NO: 4232 - DNA, 1211 bp, Zea mays
  misc_feature (1)..(100): optimal_loci_14898_G1, chr1:82157015..82158225, Cluster 26
tttggatccggcacgtccaggtccagaaggccgatggaatctccaagcaaaatatgaaatacagccgtgttcgtgtatatttgttcaccgtcatcaatattgtgctggcaccaaagtgttcgtatgtcgctacggtttctatttatacttaactatagaatataaaatagactagagtgttttgttagataggtgagattaaatataagtttaaacctaacaaccgggcacataaaccttacaccaacactaaccccagaggccataaaatccgtctcaaaccagaacccaactcaacaaagcctgcatcgaaacagaaaaaatccttttacaactactccaacgagatgttcacagacttccactaacagcacgacgaatctgaccacgcagcggcattcttgtcaataccataccactgcaggcttgatctcttccagccacaccaagatgaagcttttgaaagcctccaagctctagttgggcagcaataagatagttctttgttgacggcttaatctcatccaccgtactcttctatcactcgttctattctgttgtgaacggaattgctcagttctgtggtaacccagcaatcccgtgtagaagcatctccatgcttttccagcctactttctgaaaacaaagcccatttccgagtttccaaatactccaaaaaaacctgcagcaataatagtatttaacaaccatgcttttatcgctaagcaaaaacttccctatttctactagattattacctacgttaacttgaacaatctctcagaccataatccaacacagtatagcaactacacagattcaaaaatagatgttgactagatttacaaatagtacagaacaaacatctactactaccatcaaccttctttcttcttttagtcaaattgtctctagttaagttaatacttaagtaccaatgaggagcaagagaaaggaatgtactctagaggtattttgattttccattaagaagaaacatggacgggttgaatgctctgaaattgatgattttataaagccactgagacgagtacatgccatgaagtaaattgccacattagtgcatcttcttccctccgacgattgaacagtcaatgataccaaaccaagaatttaacatctctctaattaaactcttctcctaaaagtgcactttacggttttgccatcccacagctatgctactatag

SEQ ID NO: 4233 - DNA, 1401 bp, Zea mays
  misc_feature (1)..(100): optimal_loci_158487_G1, chr4:165694343..165695743, Cluster 26
gtgtttgggacagtttagcttcacataaaccaactaaggttcataaacttcactgtaaaggagctttattttaaagttatagagtttctgacaatgtttggcttacagaccagctttagattttaaaaaataagattttactaggaaaagtcccttatacccattttcgcataagtattaattgtggcaaccggatgattttatgaaccaccaaaagaagactttgtttcaggacatctgaaactcattgacttctagttgacaaagcaacgaaatcgagagaatctgaaatcaaatggtcacaatctaaggttcaaatggccaagcactaagctaatccgtgattattatttgattgctgcaaacaaagaacaacaccatggagtataatatttcttcagcaacaacagaaagctcttcttgcctcgatgagttctggtagaaaaaatgtgtatctccctaaagcctatctaagcaatgattgttcacctgcagaaaggattgccactcccgcatagatgtcaacgacgcactggctggcatcgcccctgttcggtacgatgaagataatgttatctctccggcaggcggcagccctacaactacaataccttgacagagccggtgttgcagaacgcatctggcaggccgccgacaccaactaacaattagcgcattatagttggttcaacatagctatacaagaccttataaccttttgttttgatagatgcatagcttaagctctaagtgcttaactgtggctgaaccaacccgtgtttcagcggaggtagtttcaagtttctacacatatgatagctttattgtaggtattttttttgtaaatttttcatttcattgttcctttatatgtgttttaaaattattgataagttggtgccagcaacatactaggaactacgagatatgacttttcttttcgtacatcgatggtcctaatatgattttcatttaaagttgttcgtagaccacaagaaggtttatacttattttatagagaaaatttgatacaaacttttgggagctaaatagtgctgccgctgacatgtggttctcacaagtgtgttggattgacatgacatgtaaaacagtgaaaataagtaaacactagtttagacctggatgagaaatccgttataattctcagcagctaaaaaatgtattttaggactttcgagacctagataacacctctagacaacttttgggatccgctggtgtttcacaaaatctcttaatggtggtgcatttgtgattttctgtctaaagtcgtccaaatgccagtaattattccccttttttaaagaaaagatgtcaagactagtatttactatatcaaagcactagttttaatggccttcccgcgtcatatttttacat

SEQ ID NO: 4234 - DNA, 1042 bp, Zea mays
  misc_feature (1)..(100): optimal_loci_159206_G1, chr4:170922654..170923695, Cluster 26
gcggaggtgttggtcatcatcactcatcagtcttgaaatttggccggtgggccgatttctttttctttttattattaaaaggcaaacaacaaatgttaattattagttggattatataatctaaatatctaaattatgataatctataggcaggttactaggtatttatataatatataagatgaattatataatattggaaggaaaaatgtatctaatacatcttgtatacttcttcctttttgtacatatacttgggcaaagctagaggaatctgagctagtgctaccaccctgaaatgacttgatattcgaataggagggagtacaagtaaggtgtgttttaaagtacacgatggagctcgtcctgaacgcgcgtgtcacgccacgataaacttttgattaattggattaagtttcaaaacaagaatgaaatatcgagctaagcgctagattgcatcgatcgattgtgacaagacagccgtcgtcatttcgtgactggatatatatatttagttttcaaagtcactgctagatgtgtacaaatgtatgcttttctcattataagagaagtgagtttatttactttagcattactcaagggggcttcgctgaaatggcattattaaacttggctcaaacgctaaaacgtcatttcatcgtttaataagttgaaaaaaggatcgttttgctttgattttccctaactgttcatcttataccatagcccagcctccaacacttgcttagtatgcattaatgcatatcatctttgactggtcttcaggaggtcaacctcccgaacaacataacatttgtcgcgagccgcctccttgatgcgatgtgcaacttgccgtccttgtgctgagacgtgtcgtggcccagctcccgtgccaagatcacgctcgtcgtcttctcccgccgtggccgcctctacgagtacacagggaggagggcgaggtggtggtttgtcgccgccgcggagaagcacgagccgctacgacagacgcggtaccatccatgccgcgaagagggagcaagag

SEQ ID NO: 4235 - DNA, 1239 bp, Zea mays
  misc_feature (1)..(100): optimal_loci_160592_G1, chr4:178592059..178593297, Cluster 26
cggagtaataaactagcgtattctttctgtgagcgactagaagaagaccatagcaaaaatcgtgttgtattttacgcagtacgaacactaatgctacgcggaaagcacgtcggtgagcagtcggcgtagccgaccggtgtaatcaaatacttgatcttagctggatcacaatcacaatcaggaggatcttgacttggcccagcaatcacaatcacgagggccttgacctgttaggatcggatacttttctataactagaagacacctcctatgttgccgtgggattttatagcgttgcagattatggaaggaggaatatttctttgtttttagatggttttagcctgaaatactaatggaaaacaattatccatctctagtaaaacctaacaaaacgccgaccgatcgaagatatatatggataaagaaaatacatgtacctgatatatgataaaaaaaaagagtaaggcatctgattaattaattactcacgtccagcctatacaaacaaattctctgcagtttctcagatatgtttcggtctccaaaaaaatataatttagattttattataaaacgcatacttcaaatttgttaaaaaaaatgcacatatagaacacacacaatgaaatagatatactttttaaaatataattaataaaaatatgataatacttatgtaatatcataaatatgtattatgcgacctgtagacaccatatttaactcccgttggattaacaagtacactaagcccagatgcgaaaaaattacctcattattaatttagactctgatgatagaaaggcaaatattttctagtttcagaacaagcgaatcctcagaacttgatccaactaacaggtattactctgcaccatactatgtcaatacattatttactaacagcctctaccagcatggagagtctagtcacattttatatttctatagaataccctaggaaatcaataaatatgttccctggagaatatgatattcttgatatgcagatgacaggcaagtacgtagtaatccaaggcccggtgaaaacggggtagcggcatggcaggtgtacccgcagttcttcaaatctgaaaaacagataaaaaagaagagggtagaagacattatcaagatgtcaaagcagtattaccctggttagagggtagaagacattatcaagatgtcaaatcaataagcatcaccaaaagttcagttatgaattgtgggctttac

SEQ ID NO: 4236 - DNA, 1112 bp, Zea mays
  misc_feature (1)..(100): optimal_loci_161223_G1, chr4:183122297..183123408, Cluster 26
tttgggtggatgcaaatggtggagccattcatgaatctttatacagaagcaacagatggatcctatattgaaaccaaagaaactgctttggtatggcatcatcaggatgttgacctaggctttgggtcttcacaggccaaggagatgctggatcacctagaaagtgtactagcaaatgaaccggtcgcaattaagagtggacagttcattgtcaaagtgaaacctcaggtttagtatttaccacttccagttcttccaagggtccttgttattttactaatgatttgtcagattttttttgccttcaacagaaaaacaaacatacatgtttttatatgatactaccttctcctgatttttcattctgacatgcatttttgcatagctattaacttcttaaattgtcttccttggcggtagggtgttagcaaaggtcttgtagctgagaagatactcacgttgatgatggagaaatggcggcaagcagattttgtattatgcatcggtgatgacaggtcagatgaggacatgtttgaaaatattgatgatatcatgaaaagaaacattgttgttctgaagacaccgctatttgcatgtacagtggggcaaaaaccgagcaaagctaggttctacctcgatgatgcatttggagtagtcaatatactaagcttgctagcagatgcttcggaacctgcccatgtaatagagttggaggatgacttggctacatctgtctcatccatatatattagtgatgaaccgccacagcttggtaatagaagggatgaaggatcttaggcttgaactcctataaattacatgctatgaggattgagttgcaaagttttccctgttgatggatctcaagttgtgggacatccaatgaaaattgacagcagggctaaagatgctttgcacgacacatcagcaagctaattgattcattatagatgatagtctgtttctccaggtgagttggtgatcaaaacctactgacaacaatcctaaattctgcagttcagagaggaatattacataagcaacttcaattgcctcattctgcacttggttcgggaaccatggtcagttgctgccaagaaaattcatctatc

SEQ ID NO: 4237 - DNA, 1124 bp, Zea mays
  misc_feature (1)..(100): optimal_loci_166986_G1, chr4:212311368..212312491, Cluster 26
cttagaagccccagccttgatgcttgagttgttgatcgttgtattctagttggttggttttatacctagctttcacttaaaaaactagaccgacaactttttttatattttcttttactaaaatgtatggtaaatgttttaccgtcctttaatggaacaaaaaaaatgtgccagtgattgggagctcgaagtagtgcctgcctactctatttggtattcgtcagtaatgacggaatccagctttatggcaagaacaaaagttaattgaaccaaattggtcatctacatagttcttcctgctttctcccctacatccatccagcgagattatttcgatatatatatctcgaccttctagaagaaacatgtgcgctagtcaatttctagatcaaagagatcaagtgcaagcatccgcgctaacgacccatcgaaatctttcatcgattggatttggtcatcttctctagcattaaacaatgaaatgcaacacgttcctgctaacggcctaattccaaacacggtgcacattattcttaatcatacatatatcaatcgctttcggcagctatcttgaaataaagtggcggcatatatattttttttgcgtgtgtgtgtccatagagctttttaggtatgtgactaaacatcgaagcaacacacaaaaaaaaactgggttgctttcaaacatgacttaaacagcgaagcaacgtaaaaaaagattcaagctgctgggacataacatgtgttggactggtcaaggaacacagcaacaattaggatataacatcatatcatacctgaaagggatacatctgcatttgctccctttagttaaaggattagatgacatgagcagaactaatctcttctccacaaccattacctagcatagtgggtatacaagcaaggagggagggagagaaaggacatttcagcggcagatggggaccaaacggaaagtgagcaagatcaaacgacaaagatctggtttagcaaaagctggattctagtggtaaaagcatggattgacgtgtgcgtgtcgccagtttgattgctctgctagctagtcaagggtctctaaccgctgcaagcattaagtccagcgagataaaagtggataactt

SEQ ID NO: 4238 - DNA, 1242 bp, Zea mays
  misc_feature (1)..(100): optimal_loci_170547_G1, chr4:230795288..230796529, Cluster 26
taggttttttgtcactcatgttctgttttgcttctcgcagtttgttcggcgcggcgctgctatcctagatgacgagcgaggagacaattccctccatgcaggctatagctagctagtgcggtccaaaaccttttggatttcttctaccgtaccatcggcacagcatggagagtggagagtttagtttttgctggattagctgagctcttttgaagctccgatccttgtaggcggttagtgaatttgggaggatcggagaaaagtgtggaggaaaaatattgataacggccctatacgtgcacatggctagatttcaacttttaaggtggatagagattttttattattttcaattatttttaaaactatttctaaataataacatacaagattgttttttaaaactaatatgttttctggcgccaaattttctgacatggccaaacggctctgccatgccaacccatctggcgcagctagcatatgctaacatggtagatcagctgcccgctgaccagtgatataggtctcttgccgcgccattaactcgtcgccagccaccaccgtcgtccacgctccatgcactacccaccatcactcccagccaccgcgacatctccttctatccccctaccaggcatgacctctccgtctccgcctccccctctaggcgcttgcatctcccccactctgagttcatctccccggcccctcatcccattagtaaggtatattttgcgttcttgatttatcatttatatgatgattgctagttagggtttatactttagaagttacagtcagttacttagtttaggtttaggtgtaggtaagatttagtttatgctagatttaggtttagttttcttttaggtttagtttaacattagttcttttatttttttaaactattttgacaaataaaaccagagttagtatctataggttctatgtattcagtagtaacatgttagattcgttagaatgattttgaagacatgatacagtttgctaaaatgattttgtagatggattgtttagtctgttttatgtaagatgtgtttgagaatatggtagatgaactagaaaagttcgatatgtcgcctaactttagtgaacgttttttttgtgagtgaaggaacaagtttaagtatggtttcacattgaaggggaggtttgatagtggaaaggttatgacacacttgaaagtcgtatgtgcgaaagattgaaagcctcaagcta

SEQ ID NO: 4239 - DNA, 1380 bp, Zea mays
  misc_feature (1)..(100): optimal_loci_171141_G1, chr4:234348886..234350265, Cluster 26
cgagccgctatagctagctatatatttgctgttgctggaagatcatgattcgctgctgctgatcggtagcaagccacctacctacctatctagctagctagatcagtatgcagatatttttatttgaaaaaaaatcttccttttgctacccgttatatatatatgagcatttctttgaagacaaaagggaaaggacaaagagaatttctcgcccaaaagtatatataatatagtccctataatatatatacatttaactttaatagcacatatatacaaactgatgaaaacgtacgagagtagtgttgcctgatatatttattttgttctcatacatggtatattaccaacaggttggcacatctaactttcttaatcctttttttatttacgaaagcaaacagatgctatctaacttgatctcatttgagataaaaaaaaataggaaagagaaggcaaccagctggtaatggtatccaacgccaacttgggctgaagtttcttagaaggtagagcggtacggtggtacctttaattttaattttaatagcaacacgtggctgatgatcgagatatataccagcaactcatcatttttctgcagattatcacccgcaactgttttcagggcgtagattctgtgaaatgaagaagcttactaccacacaaagaaactttttttcgcattcaaattttgatttgaaaacatcagctggctgcaaaagacctagagctagctcttgttcccacactctggtaccaccacaaggaatctcagttcccaatatcttttttattaataaggaaatgaatcgtccctaaaaatcaaacaaatgtgacctgcaagactcagttttcccggcagatagactaagttttcccggcagattatacagctggtcacacaaacctgtctctgaactctcgtcctttctttctttgctccgtggaaaaaaggaaaggaactccctatgggccgggggggggggggggggggtgtagatagagcatcaaatcctttgtgtcgaccgagctttccctctcattccttttccttcatgccaaaccagcaggccgtgatcgatcgttcttcgttcaagggaccgacgcattggcccagtcgctagcttggaataatctgtctaataaaacttgttataaggctatgtttggtgtagcgtatgcttgctagctctcccagctagtaactttccgtcagtagtagtggttgaacttggcttgtggaatctggcgatcgagccaacaactaactagtcgcggaatgttgggtgggtgctcccgacgacgacttgagtgaggatcacaaagaagcatgcatgttcttgcattggcgacagattttccaagcctcagtttcag

SEQ ID NO: 4240 - DNA, 1271 bp, Zea mays
  misc_feature (1)..(100): optimal_loci_171635_G1, chr4:236480899..236482169, Cluster 26
gatgtaaataaatgaattcaagttaaggctataagtacgggttccactaaaaaactacaccttttcttctcttttcgttaggacattgctttggcccataatatcatattaatatattattctatttgtattaataaaaatataatataggtatctctattttgtgtaagttaaattattttaactttaacaaactctataaagaaaactactaatatttactgtatatataaaaggtaaagtataaaatatattttgtgattgacctaacgatttttatctgatggtgcgaattgtgttgtttatacttaggatatgttggctaagacaaggaaaaaaactttttttgtgagggagtattttttgcgatacaaaattatatcctaggcaagctttctaacgtgaatataatatagtgagatgctatgttcgtgtcatgatcactatgttttagtaaagcatgtcctgatgaaacgaaataaactgtttcaaattcaaatagagggaatatatataataattcagagatagtttatacacatatatactataattgttgccctatatctgcagttttttaaaaaaaaattattggagtaggagtacatgcgaaggatcgtagtgggtcaaggacaatggaactattcaaactacgtactgttcatcagcaacaaaggaaagggaggaccacgaatctatccatccaatgtcagtgtcactataccagcacgttcgcacaaatgcagagctcagatgagttgagcatccaatgatatgatatgatgattatattgtaaagatgggaaaagcgttcaacctgattatactgtaacagactaactaacagagacaccacagatagcaagcaatttaccggcaagagataaaactcgtttgtaatctatacaaaactagatagacaaaaaaatgatataccaaatagaagtaattgtaaaaagtaattgtagagtacaaattacacggcacaaaaagatggcacaagatttaactctgagattcggttgtttgtcgttacctatatgtcctcgttgtgacaagttcaagctagatgatttatgcgtggattcgcatcacacgtcaaacctacaataaagacatcataagaatcactctagagaagaattccaacaagctactatatttactctctttgcaactcccacaagaaataagcacacgagcctcacatgataacgatcagagatgtcaataatcatcaaagccgatcaacgatcttctgttgcctcaaa

SEQ ID NO: 4241 - DNA, 1224 bp, Zea mays
  misc_feature (1)..(100): optimal_loci_172513_G1, chr5:934525..935748, Cluster 26
gaatgtgtccggtgacttgtttggtgcacacatgactcattttttaccattaagaaagtggccatttaaacaatatcgacgtgtttggtacccctgatttctatgagcggggttataacagctagatttctttgagatgctataaacacatcctatggttagctttggtcatcatcccacgacctctagcacctatatacacatcttgaggaatgagaaacatactccacttagtttgatcatatagtttatcacttgagtgagattggggcgcttctagtgtgttgtgttgtgttgtgtagtgttcatgtgtcttatggtactagtagagtgagttgaactagctctactcctacacctattactcttggtgattatctcctaaacgatctaatgattgcgggatcattaatcatttattggtgattgttatcagctctacacaatatgatttacatcatattgtgtagagtgatctttttcttgtagtaaatcctttacacgctacttagtgagaagtaaattggaactatatcaagacataagctttcacatatattagcttgactctagttgttttgctaagttttatcagaatacttgtgtgtagggtattcaccccctctagctatctaggtcctatgacacgacatcgaatatgtgtatggtaagaatttagtatagagtttttagccacaacgccatggtgtatggtatgcatcgaacgggtggcaccaaacatttccagtgagagcatgtaaactttgcactttacttctttagctttatatatacctcattgggtgccacaccaaataggaaacataaaagagatggtaaaactacataattcgatcctgaacgcaccaaatgtgttcggtgacttgtttggtgcacacatgactcattttttaccattaagaaagtggacatttaaacgatgtcgacgtgtttggtgcccttgatttctaggagcggggttataacagctagatttctttgagatgctataaacacaccctctggttaactttggtcgtcatcccacgacctctagcacctatatacacatcttgaggattaagaaacacactccactcagtttgatcatatagtttatcacttgagtgagattggggggcttctagtgtgttgtgtagtgttcatgtgtcttatggtactagtagagtcacttgaactggttctactcctacacctattact

SEQ ID NO: 4242 - DNA, 1053 bp, Zea mays
  misc_feature (1)..(100): optimal_loci_173131_G1, chr5:4305718..4306770, Cluster 26
taccgttaacagatccttaacgttttatcttattcgatttttagtataaatattatttattttgtcataactcaattttatctagaaatactttaataatgacatacctattttgtattttataaaaaaaacttatatacaaacgatgatatctaaaagtcagaagcacggcatgtttgctacctaattcattccctcaataccctcctgctattcagtactggcttagccttagaaaatttatttacgagactagttgaagttttttttttgtttttttaaaaagcatgccctctgtcgtggtgcctaacttaacattatattctaagtcacctgattctatttatacgaatattagacctatttgctaccgtctagattttattgtaaattttcggcttggggttccgttctataatttagtgcagtaaaacttaactaaaatccatagcttgtaaaacttaattaaataaattaaacaaagggtgcatattcatgtaggtttgatccggctcaggtgagctaaaatgttaattcagattgttggaaaatacaaaccagctaaaagctacgtagatgcgagatccaacctccttccgcccgctttttgttcagcctttttttccacggcagccccggtcgatcccatttcttttcttttccacgcccaatcctgcctgccttccctctcgtcgcgtgacacacacctccacgactccagcctacctttgatttgccaaaggtgtgtgtgcatgggcctgacgcatcttgctgtcctgtctcttaccatcggcgtggttggtattgggctatcctccgctccgtgtagtctatcttccaaatagctgtggctttaatatgaaaacagccgatagagttaaataccaccggcatactccgtacagctgtggccgcattaacgcctgcctcgatcgctagctatggccttgtgtcagcgattgctgatgcatagagcgccgcgcgccgcagctcgccgccgctatggcctgtgtcctggctgctagctgccgcctctgacgacctccgttcaga

SEQ ID NO: 4243 - DNA, 1026 bp, Zea mays
  misc_feature (1)..(100): optimal_loci_174676_G1, chr5:13643721..13644746, Cluster 26
cattacacctagcaaatagacaatttatgttttatctagttagaaaattagaggtcgtagttacatgtatattttaagttgcctaattcaccctattttaggcgtcgtggtccctttagtgcagctaaaatagtcagccattttataagattggatgcatggtacatgttagttgatgttggcttttacaatggtagaggtggataattgttttagacaacatgaaatatgcagactatcagtgaccatggtcattaggtctatttttaggatttatttattttagcatgtctcacaagaataaatgggatactatattaggtgttccaaatattaataataagatacaataacatggagataacaccacccacaattcaatggcatacgctagagtcctagccatatatgtgtgtgttccttgttcatatatgtgcatctatatatctagtaatggatgtgcacctatagaacacatgtttatggttgtaataagtgacatcatatcgttgttaaaaatttaagattgtatgatctctcataatatttggaacacacatttacacataacaagtgtgatgagcaatcaaacatgattacatagcacaaatctagtcactagattaagcaccatcatcctaatatatagtgatgtattggcggtttcgattgacgacatgagtatgattttatttaaagatcttggtgttgtagttcatgaagtgctaattgcatgtctatataagacatcccttaaggcctcaaccgggaatgaattgccaacctctcgtcgatagattgcaacattgtttagcattgttcaatgattctacaccaaaatgtagaatcattgttttaaacattgttcaatactcctcccaactgtgtttcaaacatggtttcccactattccttcctaaaactactaaggatgtcatttggaagtcattcatgaaaatttatagcttaaaatgtaaaagtcgttagtaggagatttctaattgcttgaaaatcataaataagagt

SEQ ID NO: 4244 - DNA, 1205 bp, Zea mays
  misc_feature (1)..(100): optimal_loci_175817_G1, chr5:19908687..19909891, Cluster 26
tagacaactttagtggaattagatttgcatgtatggcgaatcgctacttcaaaggcaatgggagtaaactattttctcacctataccccataagagatttgataagaaaataaactttggatgttaataacccatcttgcagatcctcagcgaagtcctcaccaatatgtcctgtatagacggatataaatataaaatatgacaggaagatcaacaaatcatatttaatacacttcagaaattgatactccatacagtcaggtacagtgtgcatgctttcagaagatttaatctttgtatgttttgaccaataattagtcaagaaacgtctggtataaatatcatataagtacatttaataaatgactttgcactatattagttggttttgtagctacaaagtacaaacaacattcttgtttgagaaaacaatattcaactagttttaattttaacaatgtaaaaataaaacacatcatatacatttttggacagtatcatagatagctcaagaacacactaagaacaagtgtgtctctacctaataatgtaaattgccaaatcgtgcaatggctcaatcattagccttcaatcgagaggccgctgaccccagttcaaacccaggtggtcaaaggtcgtgtgtctacataaaggttgtgcaggtgtcatcttcttcccggagttgagtttagtattttatttagtgaactgataaagtgataaatattggcatacacctcataaataacacagtagtaattatagatacacttcttatcaacaaaatgatttataaaccataaaggctgagttaaaaatattgataaacagtggcaaaacagttgcacagagtaattcatgttaaggctgaactttcagaaaaaggtacattaaagaaacaagaaacaagaatgcaattacgttgtacgcccctctttgtcatcttcaatataatttctgaaagatcactatatacatctctgacatagtttctaacaaatccttcaagtttttcatccaattcttcgccccaaaaggacacacagctttccttatttgattgtagaatctcagcagcctgaaaaaaaggtttaaagccatttttaggagtgcatcagaatgataaaaatgtgcacattacatatccccatacctttgctgccagccatactccaagatcagatatgcaatataagaacattgca

SEQ ID NO: 4245 - DNA, 1045 bp, Zea mays
  misc_feature (1)..(100): optimal_loci_1760_G1, chr1:8970263..8971307, Cluster 26
tatagggaaacagaattctgcagggacaagctataggcacaagaatactgtatttggcacttcatacactcgaaagtcgctccataaaccaaactaaactgtacagtaagccttctacacggagaaacgactagctgaggtttgattaagctctataaaaaacattgaatcaacctatatgtgtgaacccagaaaatgtggacctatccattatttagttgtggggccaccatgggctgcaacaagccgtttgctgtttgtttacaattgtcatgcttcgctacttgtatgctatatgcaaactctaggtgacatttcagtcagttgctgtttttgctacttagtactagcaaatcaaaccatgcaacgaacacctcatctgttgatgatgtgaatcattgtgttctcagaagctttggcatccattttttgccatgcaacatctcccttccccacttttaatatctgcacttgtgttgaaatcaatgtcttttcattccttttcatcacttactaattcatttcgattgctgatcagggatgcttcgatgttccaatttcactgctctcaaagatcttgcgcgccatctccagtacctcacttatcatgggatggtgcctggctgcctggcttggagcaccaggtttttttttttgacactgaagcgagctgggctcctgattttatgctgtagtccccttgaagccttctatcagttagactttcaaacttctaagagttgcaagattatgctcgcctcttggcctgttttggtccagaggtcactggtgaggtagccttgacgaggaccgtgtggagaacagaacagacaggtcgcagcttgcctgagagcccccgtagggacgggtggttttgtgtcctctttttgtatttgaaaaaatggaatcagtttattgaggacggtgctttctgggtgagtttagaaatgtaatttgtttgaacaatattagctctatgcagtgcatgcgaatcgatggttggaaccatacgaattgatggctggaaccaaatgtaatatatgtt

SEQ ID NO: 4246 - DNA, 1272 bp, Zea mays
  misc_feature (1)..(100): optimal_loci_176023_G1, chr5:20978451..20979722, Cluster 26
  modified_base (974)..(974): a, c, g, or t
  misc_feature (974)..(1073): n is a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
  modified_base (998)..(998): a, c, g, or t
  modified_base (999)..(999): a, c, g, or t
  modified_base (1000)..(1000): a, c, g, or t
  modified_base (1001)..(1001): a, c, g, or t
  modified_base (1002)..(1002): a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
  modified_base (1062)..(1062): a, c, g, or t
  modified_base (1063)..(1063): a, c, g, or t
  modified_base (1064)..(1064): a, c, g, or t
  modified_base (1065)..(1065): a, c, g, or t
  modified_base (1066)..(1066): a, c, g, or t
  modified_base (1067)..(1067): a, c, g, or t
  modified_base (1068)..(1068): a, c, g, or t
  modified_base (1069)..(1069): a, c, g, or t
  modified_base (1070)..(1070): a, c, g, or t
  modified_base (1071)..(1071): a, c, g, or t
  modified_base (1072)..(1072): a, c, g, or t
  modified_base (1073)..(1073): a, c, g, or t
agtctcttgacaccctcggctgatattggtatactaagaaagcttaaccaatcgctcgtttcacttgctaacttgatgaccatattagtgtgagattgagaatgttataacgcattgcaaattttgatttacgtcttagtggcatgtgtggtctttgtgaccttgtatttctttttactcttggtgattaccgtcatctagctagcttggttttttggaagaacattgagaggatcttggtgattgttgttgtctcagatcattgactattgttagggtctttgtgctcatccctttgtgagaattgcaaagagtaactaaagtgaaatcaataaagttttggtgacattcttagtgttctaccataagtgaagtggtaaacttatgactcacttctataaggacataggttgatgacaatgaatataaccttaaagaaaaatctatgtatcacttgtccttattggttcggtatctaaacacttacatttacttttcacatcatgtgcttatgttatgttgttgctctactaattatatctagtgtagcttagttttattggtgtagttttacttagctatctcctagtttgtttagttggtaccttaactctagtaaatagttcaataactcttctggttagctcactagttggctaaccatatacatgtcccgatgatctccgttatacacttggaatgcctttttagataagatcacttagtgaagctgactaacgtcatttattagggataatttggatcaaatttgtacggatatgagttcaaataccattacttattatcttttattccaaatgcaaatgttattggatactataataaaagatatatctcaaagttagattcaaattccaatatttacttaatttaaagataacacctaactatttagttacatatagtttccccgtataataaataagtatgaataataggatttaaaatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttataaaatgaaggctcgtttgagtaatcgtatttatcggaacagataatggatggaatggttaaatgattggatggccaacttatataagtttagatgtattcgaaaagggcatctatattcacaagaaacaaattagattttgaagttctgatattcagacatcacaatcttccgtaatgctagccggaggaaa

SEQ ID NO: 4247 - DNA, 1056 bp, Zea mays
  misc_feature (1)..(100): optimal_loci_179377_G1, chr5:37922492..37923547, Cluster 26
catagagtccatcatcctaggtgatgaataacatttaggtgtgtgtctacggcgacactatttatcacttaggcccatcacccaaatgaaccccctgcttaatcatgattgaacccgaaccaccagctcagccacaccccattaatcctgctcatatgttcctcgcccgacccacctgcccctgcacctagcaaaaaacgcttgtggcggcgcctcccctcgactattagatcctccttggcgcactgacccgctacctctcgtgctcgacttattacgttggattgttgatcttgaatggttgaagtaatcctttaatgtttgaatatttctttattgtacattaaagtaaacctttaatggctgaagtaacccttaaacggttcaagaaccttgaatagctaaatatctgttcttgatgtacttgaaacaaatcttgaatggctaatgtaaaacttgaatgactgaactaaatcttaaataactgaatatttggtgttgtgcattgcggaagatgggtagatcaactcccgtaatcacgtgtggctagtgcggttggttttctgatgcggttaattagtttcctaatgagctggtttggttggatctttttgagtccaggtgatggaccataaggttcagggtatatatggaatactcagctcactcgagctagagttttttttcaccattcaacattcatgaagattaaattatttgcagcagcctgaatatacctgacttctgcaatccgaatgtagtatttctgcaattttgtagcacgcatggactatctttgtgtttctgaactcgcatgtggcaggcatacaaaggtttgtgtatttttaattgggcacaaggaccatgtctagcttctcatgtacccgccttgctcagtgatgtatctctgtttactacttagaaagtgtacttgttaactatcatgaagatgcttttttaagaaaatattattattgcacgaaattgagcaggtgttgacactatacatatccatggaccaaatgaagtatattgcaaccataaaaaaaacaattt

SEQ ID NO: 4248 - DNA, 1020 bp, Zea mays
  misc_feature (1)..(100): optimal_loci_179775_G1, chr5:40234417..40235436, Cluster 26
agcacaatatcaatggcacgagtctatttttatttttcaaatcttagtctcctccttgttttcctcctaatttgtttttcaaatcttagtctcctccttgttttcctccaatgagtttattttccaaattttagttttctccttgttttgtcccgtgatatcttcacactttattttttaagctttttctgcctttgttgtcttatatgagtacttctatatagtatagatactatctaaactacagagagtatagatattgaattcctctctatggtcagatactatgatctagttatttaacaacagtggtgtctcggaaggatgtcttacctaccctcgagttcaatctcgagtaggcgcataggcagggttctaataaggtcatcccctcctagggatggccccattccaatagggtttcatccctataatcagggaaataggcaggaaaataataagtagaatcatctgtgaaccatttgtgacaaaagtagttgtttccaatgacgggataacatgagttagtgctagccacctacttatgataaccagtaagacctaatgggaggggcttctcatatgtgttttaattatttaatgcatatagtttactaaacaaatatgattctatcgaattaaaaatgcctttagtaaattacataagaacaatgtcgaggatattttggagaactgttggctcccctgatccttctttcatagtccaaggtgaggaggttacatgatgaatatcgagttggtaacctagttgtatatgaattcaactctataattataattgtatcatccttatctattatgatcttttccttatctgttaaaatattaatcatatcatttatactgataagatctttgtcatctttatcctttttggaatcaacctggtggtaagcctccttgccatggtgaccgagtctatgggctcttagtcaagcccataggcttatccctacaagcccttctcgttgagcatgatctagttaccccctggtgtat

SEQ ID NO: 4249 - DNA, 1309 bp, Zea mays
  misc_feature (1)..(100): optimal_loci_179978_G1, chr5:41550767..41552075, Cluster 26
tgatctatgtagcttagggctacaaactttgaactaactacatggatgtagttatttttcatgcctactctgcatggatgaacataaaacatcatttatctacatctgttcaatagaaacacattggacgaatattgagattgatagctatataaaagagtttaaagttgattatagttcagagtttagacagttccaactttatataaaccatatatggggtatggggatgacattattaagattaaaaaaaccaaaatgttacatgaaactaagaagcaattaacaaattatagagaaagccttgcatcatattggcttgcatatgttttcatagattctttcacgactcgcacatgtatcgtggtgacgacactagatacacaaggtgatgagaaggagtttcttcaaagagcaagagtgaaatctgatgttgtaaagcatgtctactaggtcatgccatcacgagcatagtaacacaaagatttcataaaagttcgagccatatagtgtgtaatatcatagaaatgtataaaattgcacaactccatagggaaagggttattactttagtgataagctaaggcaagctatgtatcttgaaagatatatctctttttggccttggtttgaaactcagctttgaagtctcttgtctaatggttgtttgtgtgaatctaaaattggaagttgttataccacccctttatagtctaaataggtgatagtattgcatgttatactttcgtggtcctggccaagacatttagggacctctagggtcattggggactctcaagggcactaggatgtcttgggccttccaatgctctcacaaagctttaggacgtcgggagacctctaggtccctcgggcactctcaaggcatcgagtctctctagggcccctcaaggcactaggccttatgaggcatcaaggccatctaggatcattggggccatcagggtgtgactggtgtcgatgccctatgggagtcagggacatttgggggccattaggtctgtctaggggcttcatgactgtctaggggtttcaaggccatcaagtgtgccatggccattatcttgtttataaatagtgtctgggtgggtttacttgccacctagatctgttaatggaggagaaaatgagtggattgatggaggagtaatggacctctaatggatgaagtaacaagcatacatcacgacaattactctattctaatatcttcctgaaactcctacaattgttttctatttatagcacacaagctggcacagaccatagtgaactgacacccctcact

SEQ ID NO: 4250 - DNA, 1091 bp, Zea mays
  misc_feature (1)..(100): optimal_loci_180888_G1, chr5:47574485..47575575, Cluster 26
taactgcacccataaataaataaagctagcttgtcgattacacagtaacacggcgtactgggagctggatgcatcgcggtgagctcatcagttagcaggtagctggttctagtcatgcatgtgctcacatcaaagccgccagccctttatacgtttgtttatttaaaatcgagctgttgctgctgactgaaagagccaaattaaactaagcttgtgacctaaccgctctgattggacggcgcaacgaatttacggtacgtatgaacgggtcggagatatatagataccgatcgaatgcgtaggtagaactacgagctgtacaggatggatgtacggtatcgagtctgtgacgctcagcttaatttcatggcagttgggaacacatacatgagtagggcgtggcacagcagtatttccttctttttcatgaattctcgagatcccccactcggtttaaatttgtaccacttcaagttccaattattttgaagagtcgtcgttcgtgcatcgcttcatatattatatatgtgacgattggtgtgtgtgagaggcgaaatggcattgccgtgttgctccaagtaatggagagttcaagatgctttttttaaaggtacaataccattttccattcgccacagacatgtatatgccgcatatatatacttacgtcaactcagctataacaatgttcttaaaaagaggcatggtaattaaaatggtatatggttgctctgattgagtgggtcaactattagtgcatattgttaggcatgatatagtgtaatgttatatgcgtgcctcaataatattatcccattcatcatcaggaccattgcctgccgagtgccaactacttgagctggaatcagctggtagcacgaagactttcttcagtaaacattctgcttaacctgctattatatatggcttccattcgattccattccatgcgcttgacagggtgtatgtcatgggctcaaggctgtacgtatgatcggccacgtactgcctagagaaaaaaaaaagagaaagtgttgcaatagaaagctagccaatatgagtgatgagcatgcacacacatcatgccggcc

SEQ ID NO: 4251 - DNA, 1253 bp, Zea mays
  misc_feature (1)..(100): optimal_loci_184489_G1, chr5:72683187..72684439, Cluster 26
ggtcattccatcaaatggtctttgttgaactttgcccatgaaacacagaaccatcgaaagagattttcatgcttctgatctaagttgttcacttccagtgaatcccttttgaattctgaatcgatgcagaaggttttccatattctgaaagagtgcacataattaaagacaacacacgttcacgtgcatgcacgcatactctctcacactggcttaggcttagaacatatatgtattaaaatttcataggattatatgtatttgtagtctctatattagacaaacattgtatatgtaaacatacttgcaagcttatggaatggtgtatatacatgtatctgttgttaaactcttggctcttgctaacttgaaaagttttaaataacatgataacaggtatgtttctggaggtgctagagccttatatattgaaggatatgcttggttctctgccccctgaggtgagcagcatcagaatttatactagtgctagaataagaatccataatgaatttgcatgtaatccaattgtacttgtagattatgcaagcactagtggagcattatagtggcaaagggtggttgcaacgagttgaacaatgcatccttcacatggatatttcttcattggactttaatcaggtataggaagcatttgtaatttatttatgtgattagtgcaataaattcttatgtatcgtttttgtccttttgcctatattgacttaggaaacagcattttaatttgctattggatttattttggttccatttcgtagcttgagctatagttgaaacttgccaacacattttgtgcttatgttgtgtgcaggtagtcagactttgtcgtgaacatgggctatatggtgcactaatttatttatttaaccaaggcctgaatgatttccgtacaccactagaggaacttctatcagtcgttcagaacaccaacagtaaagatgatgcttctagtgggtatgaaatattctggctagcagcagatctatgaagcaatacgatactattttacattctgattttgtgaacaccattcctacatataacatgatacgatattttagattgtccattagttgtggattgtgaattggccaagatattgttaattctgaaattcctggtaaaagtgtttatagcgaacaccgttgttgctccttatctggttatcatttttatttcagaatataacaaattaatcttgatttgccccctcattcttctggtacacagtt

SEQ ID NO: 4252 - DNA, 1139 bp, Zea mays
  misc_feature (1)..(100): optimal_loci_187455_G1, chr5:92365096..92366234, Cluster 26
ctatattattcacaatacttagagtaaatattattctattaatttgcattaccataaccatgcatgaagattcttctataaaatagagaaataactagcatgagaattaaaatctacaaattctaaggagtgatgcatgctactgacattaaagcaagaagattgtatccatccttcaatatctaaaaccttttatgagcattttggtgaaaatagccacaacaatggaggaatatgtggagaaatacaccttcttgaatgagtctgctcgggatggaaagaatgggaattttgtactgtgtggctatcactactggctcaagccatgagccaacagtaatatatcactaccgatttaagtcaccaactagaaattatagtctcaatatccctgtcgattcttgtattaaactcacaatgatatattactatcggtacatggcatgagccaacagtgatagatacctttgttgttggttctttaggaacccaaccattttttgatttttatgttataaaccaatagtgatgattattactgttagtttaagaccaattagtatggatggatagacaataaagattggttttgtagtgataattcatagaggaaaatgcacaaaaatagacatgaaaatttttgaattaatgttagacctccaccatttaatattttcttaataatatggttgtacgaatcaaatcgagctcaaataatttcatgcataaagtgcacattaagagatgacaagcaattagttgaaattaagcatattgtatgcctcttggtgatttactaaatgctaggggtatgcacaataatgtcacattagctatttcatgacgtaacaacatcagtgaaatatatatggggatgtcaggatgtgagacaaatacaacaatgatagagaatgtagtccatctcttcactaaaagaagcatgtcttggagatttgttgggtaaaggatgggtgtttgtgatataatcagaatccgtgggcttaatactctctaagaacactttgcacattcaatactccttgccaagcaatgttaaatttatgattatttgtagcatggttaatataatcatgcaagtcgattaatgaactttatttattagcctcttcaaattttat

SEQ ID NO: 4253 - DNA, 1207 bp, Zea mays
  misc_feature (1)..(100): optimal_loci_19015_G1, chr1:106899870..106901076, Cluster 26
acacatctgactgtgtaagatcaatctataacatgaatcttaaatgaagcaatagactgatactacataggataactagcatatcttgccaataacaacacttaatacaagatctataaaaacaaagcagaacactccacaaccccagtgcgatctactagagaccacaacaaggcatcatgacacttactgtgtagaacccttaaaaaggggtggcgatgcgcctaatggatgaaaaacacatgctgcttgggaacatttgtcttctgtttattgataatgagaaatgtccattttatagttcatagactctaaacattagacacttcctaactaactctatttaactgatacatatcgacagatacacatccaattgggacactttattgcctccgtcgattggcttctaaatgttgagtccgtcggtcaactcccattgcaccaattcagctaggatttagtggcaacacatgctcccctagtttcgaatatctacttataccaaaactaaatcattaccgcaagaaaagagtctaagacaagacattctcccttgttgccctacttttccgaagtcaggagtctaagacacaaaatggcagtgatcaagatgatcaacaccgcaagaaaagacattataagactaatcgaagatccacaacaatatgcaagagtttaagacacaaaatggaaccaagatagacacaaaatatcatgaagaaactaagaacataagagaatacaaggtgctaagctagagtgtcaaatctttgcttacattgttcttctcacaaaagcataatacccatattgttcataggacattaaaccataaggtggattgattgactaaggataaggtgttaatgcatctatcaaacctatggcccagacaacattgaaccggacaaagacactaatccataaatggcccactagttagtctaaaggatgaggtgttggatcccgactatagtctggtggtgtctgatagctctcggataactatttgaagggcatcaggcataaagtccataagtctgacaagcatttgatttagagacaccaagccattatgcaattagtcattggactataatggctataattcaatggctacaaacatgtggtgcaatccgaaggcgtcagaccacacactatggcctaatgatggatcattggatggtctgacgatatgcatatg

SEQ ID NO: 4254 - DNA, 1279 bp, Zea mays
  misc_feature (1)..(100): optimal_loci_199118_G1, chr5:168893221..168894499, Cluster 26
agcatttcgacgcctctgtaataattctttcatgacgtgcaagtaagtacctttcaagtacgcccgtgctcggtgctcctcacaggcctgatacggcggcgtttctttgccttcatggactgtggtccgtgctcattcttcttgagtgacctatgccaaagttcctagatagtagtagcatataatttggagacaaagaaagcagccctctagttgtgattagggggcctcaggcctgctctttcaaaaagaaacctctcacggttcctgatcttattagctctataaacacttaaaataagcatattctttgcttttttagctggtagaaaggaccgctaacttttgcacaataggcatttgtggttgttgctttgcacatcacacactgcttgtcaatcaagatttattccaatctgtctgaaaaaaatctcctaaagcaaatagtacaccagttgatttgaagctacaagaatgtgtgtaccagaggccaccggagtgtgcaacggtatcatccttcacagctgtcgattcttcataggccacgcatcgtcggcggccacctgaacaccacagatatacaggaggtctcgatatagctccgattgctgcaacaggcttccaatacagtttttttactgtaacgtcaaggcttttggctgctgcgtccacaactgcagcagtgacgactaccgatcacaatcgattcttatatctcagtggtagcacctagcttgtcataaaggcgagcgaggcgacgcatacccatcaaattgcaagggtcgttatcgcgagaaaagcaaacacacatgaacgaccaattttctttttataatggaaagttttattgaaacctcaaaattaaaaacaatacatcaagattttttccgcgactggcgaatacatgacatagctacaaaaaaagctctcatagcacatgttacaaatcaccaagctagttacgagtaggaaacaagaaaaaggaagaaaagaaagagtgactctatcttcaacgcccaaaacacaccaactgagccaacaagagtaggaaacaacatcacaaaggttgcttacaaagtagacaatgccatggtaacaaaatatccaaccaaagaagagatgtgagcaaccagtagcaacgacgacaaagcatccaccagtgaagacatggaaatcaagcgcccgccaagtagagggcaacagctacaaagcatccgctagtgagtccatcgacagccaagcatcagttgggaaagaagggaaggcgcccacttcgaca

SEQ ID NO: 4255 - DNA, 1216 bp, Zea mays
  misc_feature (1)..(100): optimal_loci_199355_G1, chr5:170160267..170161482, Cluster 26
caaacatgggcagcgatgtcctcgcagcaggccccatgggccatggcccttcttgcaggctttgtagcatgcactcaattcatcatgcaatgtgtgtccataaccctatgccagtagttgggtggtatcgaaacttttatttgctttgacctgtttgagctagccgccgggatacatcatgcatgtggctgtagaagagttgtatagctggctgcagaggttacgatcgaacatcagagttgaacggcgagtagtcaaatttgctgctgactgatccaggatcactgtcaactagcgtgcttcttcccatgaaatctatacggcaggattgaagattcggtggacagaattgtcttctctagtcgagctactgtctatatcatgcgtccttgccagcgcaagtaaactgtgggctgtaatagcaagctaggataagcatttgactattgcttctgctgcctttccactggttggtcccaatgtcaatttatggttgtaacgggtcctcgttttgaaatttgaaccaattgattaactagttgcattggttgcaccttcttcgttcaatcaagcttgatttatttcgtagcctgtgcgtatggatgttgaacttgcagaaactagcagcgcctcgttcagcccggtgaacatggcatctgacgtgcgattttcagaatatgcatgctttgatgtcttgctaggatgtgtcatgtgtgtgcgcaactgcgcacagtgcagctaagctagcatagttgcttaaagtcatctagaagcgacgacaatggctgcgggagaaatcaagtgattcaggtggtattttgcacccatgaaacaaaagcaataacaattcaaaactgtcataaactcgaccaatttaatatgcttggcttactgatgaaatgattaattgtaggatcctgcgtcctgccacaacgaatctgtgtgttgtatagatggtacctccaaaaaaaagtaagtacggtgaaatggaactaatttatataaaagcatacaaaagaaagttatcatgcatggttttacagaaaaaatatgtacacacatgaaacgtgaccgttgcttcctgaaatgtatgaaagttaatgcagacaaattcagaaaattttgtctttagaaaagagcagacattaacgcaaatcaaaagccaaacgcagcctcgatcgaggactgtatgtcaaaagaggaggctcgtttcaga

SEQ ID NO: 4256 - DNA, 1110 bp, Zea mays
  misc_feature (1)..(100): optimal_loci_2003_G1, chr1:10580955..10582064, Cluster 26
ttcacacaggtatgtcaaggtcaagaggacaaggatgaattttggggtgaaatacctaacctagacacaatagaagaccaagatgtggagaaagaactttgacatctggaaattcatccccaccatcatgtgagagtaggagatgcattctcccatatcctcttgaggtgtgtggaccatgtacgacactaggctcatgttgttagatgcctaaggaggtcgcacacattgactagttcctactagttgaggattctcatctaaagtagaggtcatgaccatagtgattacgctatgatggggagtgaacacatactaatataggatgaaaaaggcaagaggaaaaatgagcgttttagcaagtgcaacagattatgcgaggaagcaagagaaggaaaagtggaaccacatgtccatatttaaagacctatctctctcacacaacttctgggtgcagaacccaaagtatcacacaactcatacaattcgggagccaggcaacatgataatagtggagtgcttagactatagagcaatgaattgaaacatgtggtatccttgacacgtatggcaggcctataccattagacagtttcaagaagaatgtgatgagaacatcacacctttggttataaacgttgattataaggtgaggtcaatcttatgtttgcataacaataaatctaataactggttgctatctaatattggtagttcaaatgtgtttagaaataatggcgatgataatcaacaatggatattctatgaccaagaccaatgccaaagtgcaagttcatcgatgttgaatttttagtcattagcggctcgatagtacttcattaggaatgtcataactccgccatctgtagtgagtttgagctagatgagaacttaatggaaatattatttgataatcatttaaatggatctaatctcaccttaatatcacgttggcaagaccttcaaacatgttgtcgttggttctactaggtgctacgatgtagttgtttgcttgatatattcacccttacgaccctatcccaagttaggacattcccaataagatggagaacgcatgaaggaatccttggacaccctgcttggcaacca

SEQ ID NO: 4257 - DNA, 1238 bp, Zea mays
  misc_feature (1)..(100): optimal_loci_201553_G1, chr5:183141550..183142787, Cluster 26
ccctatttagatagaggcagcaaagcatatgcaatgtagcgggtctggggacgtcgtttctcggccacgttctgcacgatgtttcagcttacttttctgctacggatgacgaaatcaacgccgaaaacattttgtcccctatcctgtcctctccgtcagttcgggcatcactgaaaaacagaggcttcattctacagaagagaaaaggaatgaagcgacgttttcactacgccgtgggtgcttttatgtaccacggacctgcaactagtaaccattgttttagaggacagagtaaccaaacctttatttttctaccttcatttttttactatatcctggtagaagtagaacaagaaacaaggagtttcttacagatcctaaacaaaccactaaaaccatgcaggcttcacctcgtatgggctgttgtgaaagagagagcgggccagaggcccaaagcaggtgaaagggggaaaacgagccggctgaactggcatgaacacacgatgcacgcgacaaacccgaaattcgcgtgtttttcttttcttacccacgcgggaaactgttcctgaacgggcggattttgtgccaggagcaaagcacgacggccggtgcgtgcggagtggtgactggtgagcagtacagatgagtcctgcccggcctctttttcttcttcttttgcgtgcgctcgtgcagagaacctagcaaagaagagggcagccaaacattttgatgtgaaattgttggcagtgccgcattttgtttatcacccaaacaaaagaatgacgcaggttaaagcattgccattgaaccaaacaaaacattgtcatgttatccgtgagcaagtttttttttccatgggcaagccaaagtgcaagcgtatataacaaacctccaatccaaagacggaaaaaggaaaaacaggctgcgcttaacaaagcctatgcccacaacacatggcgagcaagaaagatatatatgctgtatttgctctgttagttagtaatttttaattccgtaaaaagcaaattaaataaatggaaaacataaattaatataatttgtattttcctctttggtccaaaaaaatctattttctatacgctggttacataaggttctcttttgaatggctacccttgataaatggtaatattagaataaaaaaactacacacagtgggtatagctgaatggtaaatatactattcgttccattaataaataagtttgaagtcggaa

SEQ ID NO: 4258 - DNA, 1166 bp, Zea mays
  misc_feature (1)..(100): optimal_loci_205629_G1, chr5:205732027..205733192, Cluster 26
gagatccaaatgggatgttgcactcatcacccaaaaaatgatattagtagctccatcgcccaagactagttcgttgacttcctagacaattccacgaaacgattgtttagtgtctcgtgtacctactcaaaaagattggtgtgtgaacgacgctggttgtatgtgttccttcgttttgagcattgtcttgcgaacgggaaggtttaggtagcaaatatatataacaccctacattagattgatgaatgtaaatataaagaaattacgtgtttagacatatatcggtatctctccctttccttttggttctggtgagagttctaaactcgtggtccctagttcacctctatttaccgtaccttttgtgaacctaagtacccctcgtctaagagattctatccaaaacggagagatcgagatcgatctttctctatgctgatctattcctttattttagaggtcaagaaagggcagagtaatacatggctgagtaatacatggttgtgggtcataggctcaactatttatatcttgtcttagatgtggagttatactcgtgcacaccttggacatgccatagtgttgagctcgtcatggtaaaaggatagatacatcatatcagagtgacaagtattggataccatgccgacgggtacaacatagttggtaaacgacatagttgcttgcactttaactcccactcttggccaagtcttcagtgtacccgctcgtgcacaccagactaaattatgctcggctgaaaaactcgaatgtgtgtgtattggttgacacatcccatggcacattcgatgccagcaccgggagcacaactctatctctatgcaagtgtgctaactctcaaatatttcagatagaatatttttcacaaaaaacacttgcttcctatgtgtgtcactatgactaaatgcacatgcatatagctccaacactctattacatcttgactagtaaaacaaaacacatagcttatacattttccttaagcccaatagcccatacattttgtttttctcttctttttcaaaaattgagcacttgaccatcacttgtggccacctctcatcatctcgaggagtgccatcattgatcaatcttggtgtgggcttaacctatcacaatcacaacactagagtagaggttagttg

SEQ ID NO: 4259 - DNA, 1170 bp, Zea mays
  misc_feature (1)..(100): optimal_loci_205642_G1, chr5:205772515..205773684, Cluster 26
acccaccaaagttcaaaacgtgcacaataaatttatttgtcggggagaggttcaaaacaccgacaaatcttatcctatatggcaagctgccaataaacttaatatcggtaacctatggtgtttctatggtgaaaatgattaaaatgaaaatgatgttgaacacttgataattttaaacttatttaaagagcaccagcgtcttaaactcacatgattaacttcgattctaggttggtcttccacacagtcttggatttgaaaaaaccaccatttgacacgttagttgtaccaaaagaaaattgcactgcgtatagacaacatatacagagatgaataccttagggcacgtatagcgcggctacaattccacccatttcgcaaaaaagcactctcgcgacctgaaatgcgcgtgatggcatggcgtcgtctgttgggacgacgaccacagatcgtgctcctagactagcaacgcgagaggcaacagggacaggggtagtgcaaataacgatagcttgtgttatccttcacaaatttaaaaccatgctcacggtgtaaataggtaacttattgtgtaactcgtctgtttattttgttgtgtatgcattttctaatatacattaattaagcatgctacggcttagttttgtattagaagttatattcattacactatatggctctcttgacaagagtgttgataaatacttatgtggttttttttaaaaaaagtcaacaaataatatatcgaaagagttactcataagttataatccactgcaatttgatctctctctcgtgcatctactatatgaactaatgtattttaaggtacaggggtagttactatactactagtaggccctgagtttactatatcaaacatgcaaatggcgcccatttcccgtccgtactaatcaatcgatcggcgtcactgtctcacccagtcgcgttttcccagttgcaatttgccagctgaaaatcgatgtgcggggtagtccggacgccggacagctcggccgctggcctgatacgtctctgcttcggcatcaccagagccaagcgactggtactgaaacaactgaatatgaccatgaagaataatactcctacgagccatgagacaagaagagaaacaacatgttcgcttgacttataatccgcacaggtttt

SEQ ID NO: 4260 - DNA, 1049 bp, Zea mays
  misc_feature (1)..(100): optimal_loci_207615_G1, chr5:215663837..215664885, Cluster 26
aggtttttcggggtggctaggtcacgggtttgcccggcacgtcattgtggacaagtataaatgtgttataactcccaccataaccataaggagagtgccctagaaggtcttaatactcactggtgcttgaggttatgatcgctttctccttagtgtttatcaattgaggagtggcaagaggatgtttgcatgccagctccgacttgtgctgaaatttagcatgatcactgacccgcacatgtgtttctcccgattctctcctttttctgttacgctatatactctgatgttattatgcaatgacaattgtagactaaaaatttgatcaaacacaaaccactttattatttttagagggagtaagtatgcaaacataattttccactaatgcggcggtagaagtacacattaatcttaatttatttgatatattagatattaataatcttttatctataattcagattttagatactaagatcaagaatgtgctacaattatatttttggggacggagtgagggtgtcctagagggggggagggtgtccatcgttcgtgccgtttttttttcgtgcgtatatttatttataatatgttcccacgatggcatagggtcctatagtcatggacagtgtgttgtaccctaggacgaaggcactagcctaccgatctaacgagctagccagcctgttgctcgccatgattctgggatttgattcataaaatgttttctttcttcgtatttatttgtttatttatgcctagggtgtcattattggttgatggcataggcagtacgggtttgtttggatggagatcagccagagcccagagctacctggataggcatctaccacaggcgtttgttttcggtcgccttgggctcagataaatgcctggccggcaaacagcccgacagggcattaacaagctcatcgccgctcaacaaatctatactacactattaaaaatctattatgaacacgtagtgctaccacggttttaccctttatactaacacatgttgtgccttgtagacccacgttcag

SEQ ID NO: 4261 - DNA, 1193 bp, Zea mays
  misc_feature (1)..(100): optimal_loci_220737_G1, chr6:84374461..84375653, Cluster 26
agttacctttttttaggctagctagggactaaaatatatgcgtttgtcaatctaggtgatgtttggttctccatagattttgatttgagagaagatgcatataatgcacaaaactcaatacaaaattatattatcaagttgtgttgagattgtaagattgtgtcacaagactcaatacaaaactcgatcagaccatgtttagttaataatgagattatagaacgagattctaagaagagaaggacagttgcaatgagtgagtagcatactagcatcgcattgcattgcattgggaacataggccacctggtactgcaaccgttgagtcggattctagtgcatcatcctgcactgcatgcatcatgcaggccctggtctggtctctggtcaggactctagtacattctagtaccagagggacctggtcacgtatgtagggcggcggaccaaatactttctatgggccattgatatatggagatgcaggctgcagcacaaagcaatgggcacaccgcacacgcttgtatgtgtagattaactagtaattaattaactatcctcggtaaacagtaaactctttttagacttgcatgatcttgcagggtaagttcgtagtcttctatatgtctttctttcatgaggtgttgatcatctcgatcaccgctttgtcccgttccagcttccctttttatatattcagccttgccatgcatggtctttaatggaggctaggccacgacacttgagttgccatcactcattgacactgctacatatatacatgtggacggagtgagtcatcaaaagatttattttttgctatctgcttctttgacttgtttacggttgtgacggagttgtgtgcgtgacaccctctctttatgaccgatcgaggacggagttgtccttatgattgctagctagctgcttttgtgatctcagcggttttggtcgtcatgtttgtcgcgcatcatttcttctgcgtttgtccaagcatatgtcttcaaactcgtcagtcttttttcgtcttatttgtacgtagtatataataatataacatagaatatagcaggtaggagtaggtgctttgcttgtgacgtgtgtaggtttcttccatgctttccatgttcctacataggaatatactatatatgaaatgttaagcatatatactgcactactgcacgcccgta

SEQ ID NO: 4262 - DNA, 1023 bp, Zea mays
  misc_feature (1)..(100): optimal_loci_224042_G1, chr6:103863995..103865017, Cluster 26
agcatatgatcatgttttatacctagccactcacactcgtgggttttgggccattacacttgtcacaacttctaaacccactcgaatccattgtattcgatactgggcttcttcgcgcgcttgttgtggcgtcgttccttgcccacctgcaccttcgtgccaacgcattcccattcacgatcaccaggtcacaggcttgatcaccatggtcactgacatctacataccaccaatcttgattaagactgtcactagtatgtattgcgggtcagacgttgtctaagacattccaccctagcggcccaagcttggaaggtgaatggcgagtcgtgttagtgaccaccaagacaagctaggcgtcaaagtcatacgtggataagtgcatctggcaacttcgcgctatattatatcaatgtcgtaggaggtccgtaagaaatttacatagcaattaaataaactaatatgacaatgtatatatacgaataaataagagatatactcagatccttataagatgaagtgagtttttatgacgacgaaatttatctgcagtgcttctaagtaatccgatgcaggcaccgaggcaagatggccattggaagcaacgcgcccagtacttgattgttttgaaacggaactactgatatgttgattcttttacgttttttacacgctgatgatgagtgcaagcaacaattggcatgacgcgaccgcacgcgttggacggattaattcacgaaaacacgcggcgtatagactttcacttgaatttcgtagcgctttggagtgcatgtacgacaagggtacacgacaacgattgccttgtttcttatctagatggagtaaaataaatgaaaaaggtcccaaaacagtgcatatatatcaataaacaaattagtataacataaaaagtgtaatcctcgaacggcaaattttttttgaaaaccggctagagaattgcctgttacattaaaaagatgagcctgcaagagctaaagtaaacaattacaccactgatgacat

SEQ ID NO: 4263 - DNA, 1154 bp, Zea mays
  misc_feature (1)..(100): optimal_loci_224749_G1, chr6:107387911..107389064, Cluster 26
aaagactgcggttggttaatcggtcctgctgcctttttttttaaggactcgttccagttccactctaaactataagttattaatgtttttaaataaaaacatatttaatttataaaataaaataataataattagtgttgagaaaacaacatactctaagatatataatcaagacgtagattcccacaaaaaagttttagggctcctttgaattgcaggattttttttggttaatcggtgctgctgcctttttttaggactccttccagttccactctaaactataagttattaatatttttaaatgaaaaacatataaaatttatataataaaataataataataagtgttgagaaaaaacatactctaagatataatcaagacgtagattccgataaaaaaatgttagggcttctttaatttgcattatttttttccgtttcatatgtttttcctgtaaaaataaattaattcttgtgaatttcctgtgttccaaagaagcctttagagaagtcacgcattttcgagacttgtgctctcgagaacctatatcaactctggctaaaataggggaccatcatgagaggacctgatctcgaagtttcctcaacctctaaggctctctgtcttcgactcctatcagaatgaatgagatccgaaaagtgtgatactctctagaagtcgagacggctaccaaatttctaggatatctcagtcatcggacccgccccctcggacctatgagaccactggcctcgaagccttcctgaccaatgatcgggtctcaaggcccttaatatacaaaccaaaactatttatccaatcaagtatggaagctcttgtagacagaataatatggctagccttacctcgagggtaggctggtcctaaaaggtatgaccctacagaataatatggctagccttaccttgagggtaggccggtcctaaaaggtatgaccctattacaatgttcatctctactctaaacattcatgtggcactagaggtctaaataaggctctcgtccatcgtattaaataaaatgggcgacattgcgattaaagaggtgcattgttgcaacgacataggtaccatgtgtactctagatcactattcaatatgtaccatcatccatatagccacgcttaaac

SEQ ID NO: 4264 - DNA, 1050 bp, Zea mays
  misc_feature (1)..(100): optimal_loci_225457_G1, chr6:110817029..110818078, Cluster 26
  modified_base (219)..(219): a, c, g, or t
  misc_feature (219)..(318): n is a, c, g, or t
  modified_base (220)..(220): a, c, g, or t
  modified_base (221)..(221): a, c, g, or t
  modified_base (222)..(222): a, c, g, or t
  modified_base (223)..(223): a, c, g, or t
  modified_base (224)..(224): a, c, g, or t
  modified_base (225)..(225): a, c, g, or t
  modified_base (226)..(226): a, c, g, or t
  modified_base (227)..(227): a, c, g, or t
  modified_base (228)..(228): a, c, g, or t
  modified_base (229)..(229): a, c, g, or t
  modified_base (230)..(230): a, c, g, or t
  modified_base (231)..(231): a, c, g, or t
  modified_base (232)..(232): a, c, g, or t
  modified_base (233)..(233): a, c, g, or t
  modified_base (234)..(234): a, c, g, or t
  modified_base (235)..(235): a, c, g, or t
  modified_base (236)..(236): a, c, g, or t
  modified_base (237)..(237): a, c, g, or t
  modified_base (238)..(238): a, c, g, or t
  modified_base (239)..(239): a, c, g, or t
  modified_base (240)..(240): a, c, g, or t
  modified_base (241)..(241): a, c, g, or t
  modified_base (242)..(242): a, c, g, or t
  modified_base (243)..(243): a, c, g, or t
  modified_base (244)..(244): a, c, g, or t
  modified_base (245)..(245): a, c, g, or t
  modified_base (246)..(246): a, c, g, or t
  modified_base (247)..(247): a, c, g, or t
  modified_base (248)..(248): a, c, g, or t
  modified_base (249)..(249): a, c, g, or t
  modified_base (250)..(250): a, c, g, or t
  modified_base (251)..(251): a, c, g, or t
  modified_base (252)..(252): a, c, g, or t
  modified_base (253)..(253): a, c, g, or t
  modified_base (254)..(254): a, c, g, or t
  modified_base (255)..(255): a, c, g, or t
  modified_base (256)..(256): a, c, g, or t
  modified_base (257)..(257): a, c, g, or t
  modified_base (258)..(258): a, c, g, or t
  modified_base (259)..(259): a, c, g, or t
  modified_base (260)..(260): a, c, g, or t
  modified_base (261)..(261): a, c, g, or t
  modified_base (262)..(262): a, c, g, or t
  modified_base (263)..(263): a, c, g, or t
  modified_base (264)..(264): a, c, g, or t
  modified_base (265)..(265): a, c, g, or t
  modified_base (266)..(266): a, c, g, or t
  modified_base (267)..(267): a, c, g, or t
  modified_base (268)..(268): a, c, g, or t
  modified_base (269)..(269): a, c, g, or t
  modified_base (270)..(270): a, c, g, or t
  modified_base (271)..(271): a, c, g, or t
  modified_base (272)..(272): a, c, g, or t
  modified_base (273)..(273): a, c, g, or t
  modified_base (274)..(274): a, c, g, or t
  modified_base (275)..(275): a, c, g, or t
  modified_base (276)..(276): a, c, g, or t
  modified_base (277)..(277): a, c, g, or t
  modified_base (278)..(278): a, c, g, or t
  modified_base (279)..(279): a, c, g, or t
  modified_base (280)..(280): a, c, g, or t
  modified_base (281)..(281): a, c, g, or t
  modified_base (282)..(282): a, c, g, or t
  modified_base (283)..(283): a, c, g, or t
  modified_base (284)..(284): a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
taccaccctgccaaaccctaacctaatggcatcgacccttgattcctcaatccctcctgttcggttgttgtcgctcgctcacggcccacccatcccccaagtcagttctctccgcctttcctccctactcccggtctcccgcttgacccccgccgctcccttccatgagtcaccgcccacccgccccatcccctcaaccctcacctccccgcatgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccatatctcacaagtcaccaacaacattaaggtatatatagtctcacaagtgacaaacccaaaaaggcgtcttgatgcttgctttattgtgcatagcactatatcgtgcgtataggacaacactagtcatcaccctaggtgataatcatccacctgaaatgacttaatttttctatataaaaatcgcgaataacttaataatttgttaagtcattccacccgggtgggtgatcatcacctaaagtgacaaacaacatctctctctatctatcatgcacatgtcctaaaataggacaactaaaaccaactaaagtcagcaacatatgtatgatttgaaactcttctctgatcttatatgaattagcggtgctcctgcttttttttcaaaaaaaaggactttgacatgctatcgatgtatggccgagcatgcccttgtagtagttatttggtagcatgccttatatgaccaagtagtaggtgtacatgtagttgtacaaaacttcttgtaatagtgtaaaccatatatgcaagcatatggagcagctgcatccttagatcaagcagcatcactagtgttcatgtgtgtgctctctgatctcccctttacttttacccccagctgtgttagtgggtaaattaacaaagctggtactaaagccacagttgggcggtcatcggcattgttaggccaacaccctctcccccgtcaaccaccgcaacgataaccgt

SEQ ID NO: 4265 - DNA, 1005 bp, Zea mays
  misc_feature (1)..(100): optimal_loci_226509_G1, chr6:117083703..117084707, Cluster 26
  modified_base (323)..(323): a, c, g, or t
  misc_feature (323)..(422): n is a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
tgttccagtgcggattttaattctaaagtttagaacatggtctaaacagggtctaagacaacttcaaattaggttgatgatcagtaacctcgtaattacgtggcaccagatgagaatacctatctataagataacaccaatgtacctgtgcctcagaaaacgtcgaataaacaactaaacacacatgggccgattattggattaatgaccaatcccatgtgcgcatggacgcaaacactcgatctcaatcgccatttggatctaatcacacctccaaacaaaacatacagtatactatccccggaccgtgcagcgcctacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggcgtagccagctagagggagagcaacgtccgatttccacaagccaccgacggccttgccggactcgaagaccacggggcggaagccctggcgagcgcgtgcttgcatgccgccaggccgctcggccggctccgacgatcgccacgcgtttcttcattgtgtccatttgcttcctgtatgagctgcccctctttcacatttgtgaagccccttcgtgcgcgtgaatttgtatgagctgcgttgacgaagttaggacacaacgcctgtgcaactttaatttccctacattttcctctcgtcccgtaaattgtgggtgaaagcgacagaaactgatttttttgtagaggcggctatgataattttagatgcggttgacaaaacattcatataaattaatgtacagcttagactcaaactttctaaccgactacaaataagtgattttcagtggcaattattattttttgagcgaacgacaccagattgtgctccgttcctattaataaagaagatctacaacatggtacacaaattaaggatttacaaaaggtagcatgagcgcacacgagcacgcagaaa

SEQ ID NO: 4266 - DNA, 1271 bp, Zea mays
  misc_feature (1)..(100): optimal_loci_226579_G1, chr6:117447924..117449194, Cluster 26
gatggatcgtgtgccgcacgcggtgcaggggtggaaggcgagaggcgcggaaggagagaggggcagaggcagaactacagtgcaccggcctatattagagtcttatagaatagtacagactatagttacaacttcatcctaatcctaatctattatagactgagtccaacacaactccaaacctcaccgatttgattcagctcaatccgatccgttctttcaaattccagcgtcctaatccagtccgatcctttttttttagcctgaggaccgatcctacactgcaattcaagggccctaacaattaatgctaccactagtatcccaggtcgttaacagggcattcgaaagcaattatcatgtacaagcagtctaccatcacgggagtagatggtaaatgtttaaataaataaactacaagttacatccaccagttttttcagctgttgcaaaaaaaaatcgcgtgcaaattatgttgacttgaattaagaataatcccatgcatatgacttcattctgtggcattttcttcgtcccttggatcattataaatgaatgagccccctcatcttgaaatagtacagatacagaccaccaagctgatacaattgattgaaagacacaaacaagaatactacatttacatcccaagtaactatggctagtgccaagtgacctggagaaacagagccgcagaactgtggaaacaaatccagttttgtcgctgcacactacagcaaataactctatatttgtttggggtctctgaagaatgcggcaatgaaccacagccagcgagtccggcagtccctgtacacaatccctactgttcccgtgttttcttggtcgtctgaaagactgaaaccattctaaaggctagttcagttaatctctgaactaatacacgaacactaccaagtaccaatcatagggttaacaagcagaataatacacttgtaacatgacaacaaaatctctgaaataacacagtttactagtaaactaatagtacacagctacaataaaataaattaagtattagtaatttgacatccaagtagaacctatgaaacccattgagctctgccctctcctgtacgatctaagtacaatctaaacggccaattcatttctgatcggttaggggtggatcccctttgatccaacaagcacttagactttatttagatattttagtattttccccggtacatatggattgagatggattggagtgtaacttacaccataatccatctcaatccatatgt

SEQ ID NO: 4267 - DNA, 1163 bp, Zea mays
  misc_feature (1)..(100): optimal_loci_226942_G1, chr6:119158207..119159369, Cluster 26
gcctcaacggttgttcagatgttagctaagcactctattttagtacttgtgtgcacgagttctgggagagcacgcctccgaaacgacagtcacccaaatgttcatcgactcatgtgaaggtcaacaatcatgttttaaagtcaaatttctctttctttactaaatttttaggaaaaaatgtgtttttagcataatgtgtatgaaagttcaagctgcatcctttagaaaagatgaatcagcccacaaagtattactaatgcagttaataccaccaacattaaaccatgtgagaaacaaatttacattgttacactacaactgtctgtgaagcaaataaaatgcttacggcagtaaatatcaacatgaacgcacaaagtaaggtacatcagtactaacttaggcgaccacattttaattagcccttgaccgcctattagcgtcacggcttactatgcatcagaagagcctgaaaacggtggtccaaaattaacgcacgctcatctgtaggagcacgacgacgagtattgctgaacgtgagcggctgccctgccaaccggagcgtgggatgtctttgctcgttcgttacccttcctgatcctcgtccgtgctgtactatcgagcagttgaattcgcaattatggcctgtggttagcatcttcttcaagagcttgcaggacagttcgtggctttaaagctactcaatgcaagattaattcgaaggttacacttacaccccaggaggacgaagcatattgctgctatgcatgcagaggtagacgagcaaatgtcctggacccaaaatcccacagaacacgggcgtctctgcctctacacagccgccatcaatcgtctggcttctcaagataataagattggtttccctctgttctagaaacaatatatagttctatcacagagagcccatgttttggtaccttataagttttggatcaattataaataagaaaaaaaatattcgaataaatactatcaaactaattataaagtgtattttcataataaattggtttagatccataaatgtgaatttactagaaatttggccaccactttaacggacacgaaaaatgcataactacgttcctcccttcatgatagagagtatcaactataagtccctattgctgtctactattataaag

SEQ ID NO: 4268 - DNA, 1028 bp, Zea mays
  misc_feature (1)..(100): optimal_loci_230771_G1, chr6:138065453..138066480, Cluster 26
caagacagaacaaagcttatattaattttctacttgcatgtgtccatataatattgcttttaggcaactattatcatttttttccttttctatttatagtgtgcgtacttgaatttatacaacaatgggcgttcatatcatatctagtttattgatttatgcttccatatgcctatggctttctacaccttttattgtccagacatcttattatttggttgtttaagaacaatattggtcgcataacacctactttagaggatcccccccacacggccaatcacaattctttacttgacaaccaggagctagtgaatcctactgaggaccaatattctatgcataatgatattttggatgcacatcatcatatcagaaacatgcaaaatgttagtggttttcacagccttaacacatccatatctcaaacatttgcatctgttatgacttcagctgtttctagaaattctacgtcagatcctcattatgttggcaatgttgcaagggtttctagccctgcccttccacatgttggtgttagaatcacttctgattataaccgtagccattcaacactgtatcttcaaaagtagttgggactgatgatattttatctgcattaattgtcaaacatgaacttatcaaaaagtggttatctgaatacgcacttctgattatattttttcctgaatacgcagcagttgcaataagtgttgaagatgaagaatccaagatctgctgattttttgttttcctgaatacgcacttctgaatgctcgcatcgtattccctggccctcttttgttttcagcaataacaagcagtccgttagacattagtgctgcttgttgtatgtgctccctcccaggtggacctccatttcattggaagggactcaataatggaagtctggcctcgttctccatttaattggaagtctgacctcatcccctccatttcattggagcatttcgaagttgaaataggcgctcggctgctacaatcattggtgaagtaggtcacgcttt

SEQ ID NO: 4269 - DNA, 1033 bp, Zea mays
  misc_feature (1)..(100): optimal_loci_231101_G1, chr6:139583116..139584148, Cluster 26
tgtgttgtgtgttctatacttcacagttgcttgatggctcattcttgttgaatgatgagtgaacagcagctttcctatggcagatgagaaaaacagttctatgaccggtcttggaggaaataaattggtgtagtagctgggatactgtggttccgtgggtaccagcagcggtgttaaatgcttctgtgtgcaaggcaggcacataataatgtccagcagaggcacctcacctcctgtgtcgtatgcttacgtaatactccctccgtccctactaatgatagtcggacagtgaaaagttgtacgtaccagtagctgagccatggatatatggctaaaaattagctctaaatcctctaatgtatccatacaagagagctaataaagatggctgatcttgtaggcgtctttaactaattattagtaagctagctaaactagccataagtgattattgtatggcgaaaaccaaggtgctccatgacaaacagcctgtggtatttcccttataattctagtcggggttatggccccgtggtagttgtaccaactaaatttttttctgtgtacatataggggttctcgggccaggaagcacaggaagactagacgggaccccatggtattgatgcgtggtcccagcccgcacaggaagactcactagattggcccgctagggcagatacacatacactgctacatatgttagcagtttcaataggttaggagttttaaaggcaaagtcggttcatgcctcattttgacaaccttattctagaatctcattattagccaaacagtttctgaattttgtattggattttgtgtcataatctcacaatctgaacataagttaataatagaatttgtgttggcttttatgtagtatgcaacttctcaaaatctatagagaaccgaacaccactttagactacctctaagcaaggacatgtaaacagttctgtactcttatgagggtgtttggtatgacatgcttcactaaaaaatagttctattctaggtttttagtatggtt

SEQ ID NO: 4270 - DNA, 1007 bp, Zea mays
  misc_feature (1)..(100): optimal_loci_233008_G1, chr6:148240776..148241782, Cluster 26
aaaggcgcataactattgtgctatcttggtgacaagatgaaacccacactagagacaatcacagtcaccaaaaagataagacagaaatcatgccaaatccataatatgtggcatagatcgtccaagactaacaagtgctagcttatctcctgaattcaatgtaaaaggaagtcttggcacatgttgcgactaagaaaacatctgtcgaagcctagaaagtgatccaagaattgttcgcctcacaaactcgagcctaagtaccaaatctgagatttgcgctaacaaatacagagaaggagactatgacaatggcatagtacatcgataagatcaagaagtttacatatgaactaacctcaatagggaagttacttgataaagaagagattattatatataaggccttcgtttaaaaacgacgcctaaagaaagctttggccaagagaaagacatatgatacgtatgtatagtgaaatatcaatatgcacccccaaatgtaaggtgttactttgtaaaggaaaggagtaaagttgtaattgtatataagagcaactccaacaacttcttacattatagctcctaaaacaagaaaattgagatcataaatccaaaaaaagacaatgtttcaatagctccttataattttccaaaaaaatcctcacgaggccagagctgcacagcaagccacgaccgcttttattttctaccatgccgcgatctccacatggcaattgttttctaccatgcagcaagccactgttgaagcactcaaggcactctctttccttctcgttctggttgcctcgccaccactagcacccatcatctcactaaccatccaccaatgtgtcggccatccatctcaccaaccagcaaccaggtgtccggacgagggacctgaggccaacggtaccggtacgctgtgcgactcatgtcgtcgtcactcgtcgtgctggtccaagaaagtggataaaaatgagtagaggtacgaggaggaggcgcgggaa

SEQ ID NO: 4271 - DNA, 1328 bp, Zea mays
  misc_feature (1)..(100): optimal_loci_233639_G1, chr6:150883918..150885245, Cluster 26
tgatattagtctatataacccattgtaagttcccttaacactctccatcatgcgaatatcctggctaaccctcaaacacgggtttgattcaggtttgatcatgtcctagttcgacatgttggactttcaatgtattttggtccaaatacaataaaaataagtaaaaacacatatgtcatagttctaactacggaccatatagcctgcttcgccacctatgaggccaacagaaatgatatacatgagcccataactcaaagtagacgatgccaaaaagaggaaaaagttcaactaacgcccctcaactatagcagtctattttttcctccccaattaagcttatgaatttagactctttaacttttgaaaccatttgatttctcttcttaaacggtttctactgatgtgatggtgcgttagccacaatagggatgaaatccgactacattaataaatcaagaaattaagttagacttaatgaaagttgtagacacagtattgttttttttaaaacgtgaccaaaacaatttctaccgaaatatgcaattaaaaattctataaatccaaacctaccttaaagtattcataaaaaatggtttagcacataaaaacaaaaaaaacaaaaaatagattgttttttcctccaaatgcattgggggcacaacctccacgtcggttgtattgtaacccaaacggtgatctcgatgacacgggcccagcaaggtcttgtgggctgtggcatcgccttttggtaggtaccagcgggatcttgtatgtggggcagtggggacatttgcgttgccacatgaggggtcgagggggatgccaatctagatgttgccaaacaccaaccaactctcacgtgtcggtgtaaagagctcgcagtggctgtcactgatgctccggtcttcggtgaatttgcatactcactgtcgtgaagtcccctgtatgtacagttagatcctgtttggcacggcttcagtttcacaaaattcgatgaatttgatgaatcaagtaattagaagattcaaaaaattgtagaactgaagtggtaaactcttagaagacatgtggataagtaattttattttttatttagattaaaaacatatattttaaacgatttaaatttatataatacaaccacaacttcgatatttttttaatacgcaaaaaatagataatacgctattaagttatatgatacatcttgttaatacgcaaaaaaaatagataatatttttatgtggggtttcgtgtgcatgtcgtgatgcttaagcgagatgttgaggagaaaaatatcatttgtactagtttggttatacggc

SEQ ID NO: 4272 - DNA, 1174 bp, Zea mays
  misc_feature (1)..(100): optimal_loci_235294_G1, chr6:158644175..158645348, Cluster 26
ctataaaaaaaacctatattatacattcttatacatataatcaaacatatcagaagactcgtaggcttctctcgtgcagtggctttcttttgtatctctcaagtcgaattaacgtagtcaaaccaaccaaacaaattaaactccgataatcagatgcatacgtacacaaacacccctcacgtacgtatatagctcggccaacctgtattgaattcaagctaccaatcacgcgcctggtaacgtactggcaccacaccgctcaaagttggacacgacatacctcatggttcactcggaattaagttgacatggtgctagggccacatccaattgatgagcacttgaagtcgttcttgtacgacttttgctttccagataccacgctcaaactaccaatctacataggagcaaatataataacagattgtaattagagtgaatgttgagatgaaggagaggcggaggataaacaagttatgcatgatggcgtcattaatccaaaatccaatactgtcacataggatacacaatattaaactctctgtatgaaacaccattttcagtgcgtagtatcatgctctagtatttaagaaaccatgagtataataaattgatgcatgttgtgttatgatcaaatgtaccatgagtatttaagacattggatacgaaggtagagcggtatctttatgatgatactatactatcttctctcacctcttttaactcacatgttacatcaacaacttgtcctgcatggcatatattaaattactataataccacacaccgggaatagcctaaacttataaccagcttagacacataaaccaagaaaattataaaatagataggtaggacatgcattaatagcgaagatctaactacgatatagatagactaagaggtagactgcaaagatctttatacctagcaattagctcgcagaagagaaaagtcaggtaagctaacataaaaccaacatgtatagtaggctaactgttaaattgactcttgccttttttgtgcttaagatggcaatatttaatgctttcatgtgaatgtcatccagtgtggtcccatctttgtgaccgttttatcaaacaacgtaacaccacacacatacacatgctcctattgacataggactccaaaatttgatgaacttcgaagcaaa

SEQ ID NO: 4273 - DNA, 1228 bp, Zea mays
  misc_feature (1)..(100): optimal_loci_236506_G1, chr6:165138462..165139689, Cluster 26
ctacaactacaatcctgattgaacctgttggtgcagtgacttctctcgcaattggtcgcacactactgcataacctcacattgtctaaggatcatccaaatcccaagatccagtaagtttattactgtatgtaccatagagataaaatacaggtgcatataacgttatcttgcctccccgcggagagcgttgacgtcttcaaaacaccaattccgagaacgtagaataatattgctacatcaataaaatccctaacatgacacaccttgtttttgcaaatgaaactgtgacaaaactcgtaccgagactactagactagaaacaatcatgagacacatgtcatatttatgtccagtccagatatatttccattaagaataccgcaataatagctaatcatctgtacagccacgtgtcctatatattttatcttctatgttaaacaaataactaatcattagttgacaatgtacagtgacgtggcttattatatttatcttctgtgttaaacaaatcactaatcagtgataccaattttttttgaactgaacagaaactaacagtcagccgaattatttatctaataaacaaccatgttcactcagcatgacaatttaaagaactagcaatggagactaacaaatgatccccattaaacatgtgtataactcaaaaaaaatatgtaagaataaaattaactttgaataaaattaactttcaataaaattatacctttcaaatagctattagttgttagctatctcaatctagttaataacttattagcagactaataaatagctctaaagatttggaacggggtcttaattctagctaataatacagattctattatcttattatcttcttaactccagctaatgacatctagttaaagtttaaatagagtggaaccaagcaaggtctagatatgtcgtcccatgtacaccaggtcaccagctatatatatgtaaatgtaaatataaatatagccggccggcatagtctcgtctcgcccatacatacatacacagtacactctggtgtcgtgtgatcattggaatcgaataataaccccaatcttgtccatgcagcatccggataattgaacctctcgatctcgtcacgctacatgttgttactgcatatgcatggctggccacagtaggttaccaataaaagttgcacagaagctacgcctacaagaggatataatttttatcgattc

SEQ ID NO: 4274 - DNA, 1100 bp, Zea mays
  misc_feature (1)..(100): optimal_loci_236517_G1, chr6:165160058..165161157, Cluster 26
aactgatctcgttagtgtaaataaatgcatctaatgtccactaactgccatcttgatcctacagtcgttttagctagatccaacactagccaccatatacgtggctgcgggttggtcggtatcatctagctttaacgtcgattagttcggatagttgattagtcggtctactgatcgatggttcgatcagtatcgaccgtgttgtaggtagatcgatcggtactgactggtgtgttggacggttcaatctgtacggacctgaaccggtcgttacaaatacgcctttagcatcgtgacgcgttcaaattgatctacctgtgtgccatttcagcttcgcgtttttttactattcaaagtttaaaaaatctcaaaattttgggaaaaaaggtcaaacgatcttttaacaaattaaatatttaccttcaagttctgtaatttttatttatgttttatagattacgcaaattttatttatattttatgaattatgtagtttatatttatgtttcataaattacatgttttttatttaattaattatatatttgggtgtattaaaattttaataaaaatgacgtattttatatcagctaaaagttggtaaaaacaaaattgatattggcgctaagataactgtagccacacggtgttagagtactgtgatgtgaacagttgaaccggaaagccagctagctcatccactcggcccatctggcgatattggtcttcccctttcattttgcattcatggcttgggctctccattaccaaaactagccccgcgccctggcccaagcgttaggatccttggcaagtgcagacgggctggccttgctaaaccggcaagagaaacttgaggcgctagggccctccctgccaacatgacgatttccccttccttttccccaaaatctcgaagttactagtttactactgtatctatatacctatatgtaaaataataaataaactaaatcgaaggtagtacttaattaacatgcaagcttgcacatttggcaagacaagatgacggagtcagaggaggcctagcccagcagccagcacaagaacatggtgagcagacacagcagcatcgatgc

SEQ ID NO: 4275 - DNA, 1041 bp, Zea mays
  misc_feature (1)..(100): optimal_loci_236680_G1, chr6:166075014..166076054, Cluster 26
agtcgaatgtcacacgaatgatgtcatggtgatcctttatccagtaaatgaagaagtaaatttttcagtttttagatctcggacttagctctgactatttgtctcaaacgtatcattattatgtttatgatgtcggagatattcttgatatcgttggtggtcctcccatcgggtagtgttaacaaagcctctaataatgtttataaacataaccgaactaccataacaactttacttttacaccaaaatcaaaattgatttagtccatatcttcgtacaaaactagccttacaaaatacacctaacttggcgtataaactataaaacggaggatgtcttggtattgaatgtctaaggatcaaatttgagattgaaaagttgaatcaatgcattagataaagtaaaatggactggtgagagggataaaagcctgatcttggagaagcctgatccaggataacgaaccctgatgccattgatcttgacgccatcggccatgcttagaatcgagatttatgccactgagctcgacagcgtgacaatatatccacagtaacgtctcgtgtgatgcttaatttatgacgttttgctttataatcttggcttcatatatcatcacactaattccttctactcaaaaatagatttagttatctaggtgttgaaacttattattttcttttaaaaagccaaactacgataaaattcggccaaggcggagggatgacgtgtacgcccggggcccggttgctttgtgtctttcaagtgttggtaacccaactatagaggtgtgtgcgcttcttgtggtgtacagtgcttgctcggtgcagcacgtacgttcaagctctaggatccttgcgcgtatcacatgctctctccacatcgctcataactgcgtccacaccactgttttgccgtgttgcatgtttgtgtttggtcgcgggcgtgcgttaactattccactccagagtccagagtagactacctgcttaactacttcaaaagtctaatttcttttgaagcgtaactatttatatgatt

SEQ ID NO: 4276 - DNA, 1226 bp, Zea mays
  misc_feature (1)..(100): optimal_loci_237727_G1, chr7:3168426..3169651, Cluster 26
cctatcatcactccaaagttcaatattccctcttcttttgatgtccagttaggtagggtaagttctgtggggaaaaaggattttgttttggtgcatgctctccacgcagtgcagtgtgcagggcagggacccatctggcggtggtcttttttgcagcaggtgtgtgtgtgtgtggttttggtggagagagcaatagcaattagcaaatctgcaaacgtgcctgccttcgctttctttctggagaatgcaatagcgcagcgcttagcttagcttagcttaggcaatgaggaaggagtgagtgctactatgttgtaaagcctttcgtgcacttttgagaatgcaagaaattaaagcggcgctagctgactgtgttttagtagcatcatacgtaccccgaatcttaacagagatcagcgtgcattatcagccgacgaaacaaccaacaaggttgcaggatatgtatgagaaatcagaggtttagtaatccatcatcaggttgataaaaaatattcggacttggattcgaatcccatgcacggtcaaactaaagaaccttgtcaacgagtccccaagcagcagcagatgatggtcctaaaagatttcaacgggtatctgcaccggcctgtcagagcacaaatcgaagcctagccgccactctcacgccagcgcagctttatattagctaacaaatttccgtcgccaaattctgctttttttttatcttcttcttctggaaaagctcttattacagatgctaaagaaaccggcaatacggtcagtgcatgcatccccctggagcatggtaattgatggaaatcatgagatatatagggccacactccacattctctttagcgaactttacctttttttttttttgcagaaattgttgatcgagttgttgttgttatttattaaaaaaaaactttatcaagtaggaataagattaagatactgtgcatgcaaagcacatattgtcagccaaatattatgacatgcatggcatgttttacactgcttcagataaggactgatcatatatagtaggcacagtccaggttggtgttggttgcagacgaccgggcctctgctggtccggttgcagattatggtatgcgataataaactagtagcagatacatatattatatatgggattatatatatgtaataggatggccatcgatcgaatgaaatatcatgtgtgagtgtccatgcatatatct

SEQ ID NO: 4277 - DNA, 1099 bp, Zea mays
  misc_feature (1)..(100): optimal_loci_238755_G1, chr7:8925671..8926769, Cluster 26
cgaaaacgaagttgatctcttactaacgatctcctccaaacaaatggttcaagggaatctttgtccatcaaagacatgccaaacctaagtgacttgaattcattatccaccaactccaactcaaaagccttagcatctaccaaatcttcctcggatctagtcgaagccacaaaaggaagctcctctgtaccagacaccttcacacaagcgacgcttgggcacattacacaaacttagaaagaaatcaaacttcacccaaagcttcatttcacgaaccaacaacaagacatctcgtttaagggaaccgatagcaaataacgacccataggtgtggtatatatagatgacttcgatcaaaagtaactcttcaccttcattttatacttgacttcggtcaaacttgaccgttaaaaactttgaaattcacttttcacactacaagaaccaacttcgacgctcgggaatgataatttcgcaagaagaccttcgaagcattgcccacgagaggctactgttggggatttaacatcgtacaaacgcaatccccgatgttttggagtcatcaatcgcttcctcctattggatgcttgttttcagaattggcttcatactgagaaaagaccaaggatgagacatgaagccatatcattcccatgcaccaaaggatagacgaagcctcaagaccaatgaagtctctctgacgaagactctctccctcaaagatcaaacgaagtcattgagtgaacttcgttgagaagccaagttagaaaggaaataggagaaatttgctattcacaggacacgaagctctgtctatgaagactgtgtggtggcagaaccatataaagcaaatgactgaactgtgcttgcacggacaaacaactttaaccaaactagtcaagggtattttagattttgtatacacaattagtcaattacaaacgcaagaacatatataaatacccctaaaatatattgttcacaggcataaaatcaatatccaatagagcttattcttgcgattttggtgtttgagcaaattcgtttgcccagactatttaaagtttccaccaactaaaaacaggaggacaaagttacc

SEQ ID NO: 4278 - DNA, 1027 bp, Zea mays
  misc_feature (1)..(100): optimal_loci_239188_G1, chr7:11673369..11674395, Cluster 26
tattaatatgttctaaggtttgttttcactttctgagtcgtaacacctatggatttatccatacgtgatttcttgtggcatagatctatatgatgacataactgtgatgaatctttgttctttccaaagatgggttaggctttacgccattgctgcatatgttggatgtatcttccatgcaccttcctgcctttgattttatctccatcccctcttccatgctcgcattccatctagatctatcggtatgtgctagctagggttggatagtctatgatttattgtgcatatttgagcattgccagtatggtttatgatgtgtgttctcatactgataaagttcaatgggttttggagtcatgggcactcgaaggtgcatgctatttcctttattgtagctgtgcttatggtagttggagtagcaaactatttccttagtgcatcatttcgcctctaatttgttctatcttatgacatctataatggatccataagaacatcgtcgtcgccttgttcataggggggcaacactagtggttgtggtggcaacctagatgttagttaggtttaggtctcgttgcatggcatgtcatcatatctcttatgcttttatggctgaccgagatgagtttaggcagtgtaacctaatgttcatctacaatttctcctatggctgaccgcaatgatatttaattattataatgttgagctgagaccattcaactctgctactctatttcttctttgatgcatgttttgccatcccactctattgcttatgttgtgggtgtatacaactagggccgttgatggattgaaagggaaccttgtcaatgttgcctaggagggtaaccaagctaggggtacacctaggtgctaatgggatgtcgctaggtctgggttcatgctaggccactttgctgacctagttagtgaaggggtaaatactgacaaaaggttcaaagaggttcatttacgtgatgtggctatggatttagctaaatttgctgaagtgaatgtcactagc

SEQ ID NO: 4279 - DNA, 1074 bp, Zea mays
  misc_feature (1)..(100): optimal_loci_239618_G1, chr7:13982021..13983094, Cluster 26
attatttgcaattgattatctgtgcattagctccagacctcgactccaaagtgtgctacacagtaccaaatcctacaggaacgagaatccaccatgaaaaattcctctaatccattatttgtaattgttaacacatcttaattctctctggaaagaatatggacaaaatactaagaatatttatcaatgtcaaacacttttcctggttattagtgagtttccctgcataacaacagcaagtcaacttgacatacatcgtgcacgtcggacgtccacggaatgaccgccgcaaccgcaagcgagcttctgtgatctcgccggcgcgcgctgatggcgatggagccgtgtgtgtggatggaaccctcaggtataaatataatttaataatatgataacaatgatggtttatttgtatatgcttacttgactaataataaccactctttcagtcaattcgatcgtctacggtcaaattgtactacagacaaaaatatattatgcaatgcaatgaagttttctgtacaccgaccatggtacagtcaaactaacaaaaacaatatatatttttttataaaaaatagataaattttactatttactctctgtcaatatatgttaaatcttaagttctaatcgacttaatattaggataaataaaacaaaaaggaaattctaccattatttactcaactcatatatatgtaggggtggtatatatagaattcgaaagggagctaggggggaggacttgattcaaaagcacgcacaagaaaacgtggtgtgcgtccgtatacatgtgttcaagcgtcaaaaccatgtgcacggaaaaccatgcacacacgtgaacgaattaatataaatgcgttatcttttgttcctcaattaagcgtccgtgtttcacttgcatgcacattattattaaaattcgattacgtacatacatttccacccttcaatgtcctaaaagaatgccaattatgttagacatcacatgttgacatgtagtctattatatatccttgcattattacggtgatccatgtagtacaacttaatcaactttttttttcatct

SEQ ID NO: 4280 - DNA, 1073 bp, Zea mays
  misc_feature (1)..(100): optimal_loci_248922_G1, chr7:75903441..75904513, Cluster 26
atgcatggaggccagagcagagaaagggaactccctccctcaaaataatacctctcgctcgctctcacatgttgttgggcgaaatgtatcatgagaaagagagaaggccaggatcttcatggccccacaagtcggcggaggattgtgtattattgcactcggtacctccatccatcccttaatagctactaggccaggaagaagaaaagcagcatggttatatggatccacgagaaaactatgtgttgcatgcatggtctgctttccattcttctaattcttctacactgtattagaaaatgggtcactttatctctcctaaattttactaaatttatgtaataaagttttcaatatcaaatacatatacctcagttaaattgagtcggtcgtgccgaccatacctttttttttctgccatacaattaactttcaaaagtacgcatatatccctttgattgcccctggattactacagatgttctttttattgctatgggtggattggattagtcctttttgctaaagtagcgtagctgtagagtacgtccttgagcgagagagcagatcattaaagcgcgttcgtcattcgcgcacctcgctccacacgtcaattgttcaagtacgatcgagtaaaatctatatcttttacatgaatatatgaacttttagaggagcgctactctctcataaaaaaacaactttgggaccatgtgtgtatgattgcgaggtgtggacgggtaaggtgctatcagttccatatatcattcatttctaatcaaacattccatattttactcatctttacaactccatgaaaggatctattgttcactttttttactatatggacgattttcttgatctgatattgtgtacaccatagctagctttgggggcgtggtgttacttatcagttcatttaaaaactattgtttttttttgtcttgactctcctttagaaatcaagatttaaggtcatggacttaataaacttgcccctattaatacggctgggttcttatgccctggaaaatagttagtgaactattcctggggttttgttaagtttt

SEQ ID NO: 4281 - DNA, 1008 bp, Zea mays
  misc_feature (1)..(100): optimal_loci_251383_G1, chr7:92395605..92396612, Cluster 26
catcagggcagtatggcgcttacattgaaaaccccatagggagaggtggcgatgcgccgagaggatgggaagcatatgctgcttgatgaacgaatggctttctgtttattatgaccatgatatgttacaatatatgctcatctgtctaacttaagctttccatctaatgtactacttatttatggtataatgacttatttctattatacacatctatttcccacctaggtcgaataccttctcattggagtcctttggctagaaaaaggaaacccaagtccgactaagactatgtgccaacaaacgatcaaaacaaagcggtagattgatctcaaagatctatgcaactagatgatgtgttatctagatgatgtgtgggtgtgagtggttggtggaatctccttgagttggaaaaaatctgttttttctgcccaaaattgtgatttttggacaacaatttatacaggtagctcaaactacatccgcttctacaaattaatttctagggacgactcttgttcccatccgcctctagaggaagttgtagtttgagccacctctataaattattgatgtgtagagacagaagaggagaggtggttggaacaatagcctttatagcggcaccctagttgcctctaaaaatcatatctatggtagtggtggccctacatggaaatcgagtcaaaccattttgtcccaagtgaataagtggtataaacctaggagcattctttttggtatgtataatagccctacaacttataaaaagtggctacccaagacatctatcatttcaacactttgttatttccatagggttagccaggagtttcatgttttatacatattaggctagagagaattgactaactcttatgttaatgtctcatatgaagtgaaaggatgttcgagatgaagttgttttgttgcttagttgagttcattatttaataatcaaagtgtttgctgtattaatagaatataatattgccatttaggtgaatt

SEQ ID NO: 4282 - DNA, 1366 bp, Zea mays
  misc_feature (1)..(100): optimal_loci_253522_G1, chr7:104879697..104881062, Cluster 26
aaaacagttcttttaggtaaactttggatagacttttagatagaccgttgtaaacggccttaatgctagacgttaggaccgtctcgtctctgggtgtcattgctcgtgcagtttgtgcacgtatgctccatatgttgttttcatgtccttccacttgcatatggtccaacaaacagaccgaagatgatggctctttatgaacccaaccaccagcgacgaaaatactactactacacactagttagtactagtattgtacgagtacgctgcgctaaagccgtgacgtatgaacagcgggcgagaagaatgtccccacctattgtaaccgtaccaactctctccagcacaaccgtacgtatacgtttacgtacttgtcgatggcagtctacgtatattaattactaattggaaacactaatcgacagtatctgtggtcagccgggaagtcggtgctggttggagtactgaccaccagaactcctcctcagctcctctcatgcagcttagatccaggcaagatttcaggttcgtacagactatctgacgacgtttggcatgatccccaagtgccaaaagaaagagagagagagagaaaggaggggagaggagccacaattttaggcggctgctttcgatcagtagtggttgttagatatatagggtatcatgagccatgcgctttatctagatggagaataaattcccctaaccccacctatctaaatctgttctctgctttgcgctggacccatattccccatctccaaaggacacacaaaaaacaccgtaggacacttaaaattgtttggtttttttttttgctcaaagacacagaaaaaggttggcttttgctacaggagacgggcacactgttgaaccgtgttttttttcttcttcttcgttgtaggacgcaattagtgtttactttagcaagaacggaaccagcgttctgcttcaaaaggtaaaacccttttatggtgtttgtaaggtaccgcgaggtacttgtgacttatccaaaagcgacaataattgattctagctcatagactccgaccttatttacttcaattgtataaacaataatggtttgttttagcctacagcacgacaatcaaaggtgggtaagttagatataaatcaaagggggtaactttacttcatacttcacaatgggtaatttaaacgcaaatttaagggttactctgtattatattttctataatgatatagttggataatttacatgtaaatttatgggttttttaaattaactttagcaatagtaaagtgagcaatttagatacaaatttagttgttttctttatattatttttataatgaattatgtaggtattgaaggtaccac

SEQ ID NO: 4283 - DNA, 1400 bp, Zea mays
  misc_feature (1)..(100): optimal_loci_253717_G1, chr7:105913910..105915309, Cluster 26
ctaatgaaaccgacattcttaagtatgtcaccgatgttcttaatttagcctacgtttttacaatgttttcctatagtgttagtttagcacaggcataacaggtcgaggtaagcacaagtatagttggacatgtagttagctggatattaacattcacttatagttagcaagataaagagttcattcaatatcttaaacaagagtataccaataataaagcttcattgttgttataccttcaaaagctcttaggtagaaaccattacacgtgcgagattacaaatggccgatccatgtagcagtggtactgtttctctatttatattgtgaggccagtatacatttttgtgcgaagtcgtaactttcctactatatattgagtcttcagaactagaagatgcaattatatcttttcatagcaaagcaaagacgtgtcggtacacatttattttcttctttctaacgtcctcgtttcaatcgcttctctgaagatagcttggcatgctttgaagatgtatttccttcggtgacagctcttgcctttggtctttcagtgacctgcttctgtcttgattcgaagctcttcccatatgcttgaatcttgaaagtttgtttaaacaatgactgatctttggtgagagatctcctcctcgaccaataaagtaacacaaatatgtttgtgtgtgggtgttggggagggaagggggcaggaggttggaagctctgttcctggaaccatcacttttgtgcgtcgtgcagtggtgggtgggggttggggaggggaggggtgcgggacagcgggaggttggccagttcctgcaagtacatccatcatttttgtgtatgcgtgtatgggtgggtgtagactgcagaggagggggcgggaggttggcctccatggcatgaagctccgttcccgcaaccatccggttgcacatgtttctagctttacatcttttcgaacataattttccatgtgcattcgtgctattggacggtcaacatggccattgaatgaatccttactaaacaacatgcacggtgatatatttataaaagttcaaattgcccatataaatcaagataatagttcatactaaggatcattgtaaacaaaacaagtctttttaaatcaaataaaatgaaaggacataacaaaaataatatttcctctataaaaaataaacgctcctaactttaatttgtgtggttgctagatctgtttaaagttgtcaagttatgttacttatttttgtagggtttgccatcaacaagtagactagtaaatgagctggcaagtgcaagttttttgtcaatctacctgtccacaaatggtaaggtatttgacaataatagattatattcttatttgtatgttatttaatgtcccacagtgtgat

SEQ ID NO: 4284 - DNA, 1037 bp, Zea mays
  misc_feature (1)..(100): optimal_loci_254308_G1, chr7:108849140..108850176, Cluster 26
atgtgaagaaagtatcccatatatgactaagccctcctccgaccaaaagcaaaggtgaaatcttttgtgtattgagcattcataccttacgtgatgtggttatggcatatatacatgatacgtgagatgtaaggacattcattgaaaattaaatgttttgaagctcatattctaccacttttttggttacttacttcaagtggtataaaatggcttgtattctaacacttgatgtgtgaagaagcttattgagtttcaaaccaaattagatgcctatgtaaatcaacaagttaaagccaatgagaaggaagctaatgaaattataatgtaagaagatatcaagtgatactcaactttaagtgatcatcttcatcaaaatgtggttacaaaaatcacaagcatattcaatgcacacccttggtagtaattaatgacaatgggggagaagaactacaacatatgcataagaagtggaggtgcagagaaagatttataatttgaaggggtaaaaatttcaagtaaaccacacaagtgaaccacgaggctgtctcatatgcttacttgcattatttcaatggccaaacaggtggcggagtaggctcatgaacactttgttgtttcattttgaaatgtgcatcgcatatgcttacttgcatccatgcattaattgtaacttcaagttgtttttatttgtgtgtgtttgatagtttaaggaattgattggcgaaattcaaatctaggatgtatgggttgtaagtggtagctagatattagtgcttagttttttcaagtggtaactagaaacaaatttcttataatgttgatcatatgggatttctagagtttatgtatgtctagctaacaaaagatggatttcaaatgatatacatgctacaaaagtttattctatacaccttagcatcacatgatgttcctattcccaatataagtctgatttgatattggaaccatttcaattctagcttctccattatcaacatccatacggacctttatagaagatatatcaaacctca

SEQ ID NO: 4285 - DNA, 1092 bp, Zea mays
  misc_feature (1)..(100): optimal_loci_254692_G1, chr7:111413074..111414165, Cluster 26
aaggccaagcgatttgaaagttgcaaggttatcgtctctaagttagtggcaggtaatatcaaagttggttaagtcaccaagttaaggctcataccttcaatttcatgatttttgacttcaacctcaagggtcttggattcaagctcatttatcatcttttgaaccgtttctattaacatgatattgattgccttctcttctgctaagtccttttccatggttttggtggcttgacacttcttttgagacaatatgagaagaagagacttcccatctagctcgtttataatttccaatcaacaaataagttagagataagatgagtgtttcaatcacatggtactaaagggacataccttttaatgcaggtagagatcattgtcatgttgattggccttctctaaccatcgacaatcttcacctatatcaacatgggctagcaagtaatccccacacgctactataatagctcggtaatcttcatcagacactaggccttgcaatcacgaagaacctcttcaatgaggaggtttgggtggcaagcaatagttattgaaccaaaacaatgggagttatgaaatgattaattgaagcaatcatacctcaaagggtgcttacctcttggttccttaggggctggaggagtacttggctttgtggaggtctcgaccggtgcaccaagggactctacaggcgcactagaggactcgaccgatggagttatacaaccaacaatagggtcctcaaccctaggctcattaggtactgtcgttggtgccagggttggggttgaggcgcttggaggagttccctcaaaaactttaggtggctcggtccttatgggctcatccgctagggctcaatcactcaagaacactagtggagggctctgactcggctagggcattaggaggtggacgagtatttggcggaggtgtaccaaccgagtcgtttagagaatcctatgatgtcctgaaatgttaaagatgatgataactatgatactattgtaccttgcatatcttcttatgttattttttaggaaagcagaagagcctccctgaaactcggccttagcaacctaatcatcct

SEQ ID NO: 4286 - DNA, 1174 bp, Zea mays
  misc_feature (1)..(100): optimal_loci_256671_G1, chr7:121579719..121580892, Cluster 26
atcttaattgaccatactagcaagttgcaaacaaatcgttgccgcgaaagcatactcccacatcagcgaaagtcccttttcagctcttgggtcggtcatggtcagtcagccgtttcaaacggggaaaggttggtccgtccacaagtcctatcaccggtagtagtagcaagtagtaggtgtttctctgtgatgttctagcaacacccctcgcaattatacgtaaagttcgcgaagcccacgcggacccgataaataaattcaaatccctgatcacgcgaccgtcatctgacaacagataccgcagcttgccgcttgaattgcatcagactcttccacgaaaagctcagtgagatcaccggactacaatttagtctgtcgttggattacatgcgaaaatacaaatagttaaaaaaaaaactaatacattctattcatcaattgtctctacagttttttgttagaccataattagcccgtgtttagatgttctactatttggcatgcaagacgtggactgaagtttatgttagccaagttcttccgtagatatttttggaccagagcaagtaacctgctccgggtccctttcaacaactgacttgctacagagtcgtcgtcagtgcataatgactgtacttaggacgcaatttctgtgtggaatggcaaatctcaagggtgatggcacttcttccacacttcagcgaaggtgtgctgtcgtttgatgtaaatttcggttgccagacatatgttccattccaaaactaaactcctcgatcgacaaaaatcacacaataaatttgtgggactttacctaagagtcttgttatagtactccggtcaccttataacacgcgagagctttagcaaatcacagcctatgacttgtgttaaaatacacaaagcagttaataagcaattaacatatttttttattaaaataaaaccatgaccaatgactaatcagtaaacaaagatccagcatcacggaccatttgtcacgtactcacggtcgtgatgcaagcgcccacttgcccccttacttattcgtgtgccttcacagccaataggactccaaacgtgaattcacaacaatatatactgtactagctcaagtcctgctggtccggtagttgttagtcaaactgaaaaccaacatatatagggtctattggga

SEQ ID NO: 4287 - DNA, 1080 bp, Zea mays
  misc_feature (1)..(100): optimal_loci_260141_G1, chr7:140683069..140684148, Cluster 26
cccatgtgaagaaaatcccagtttagcatccttgatgaaccacaatactacatatcagatcatgattgcttggggtagaaggttatcaacaataatatataagcatcagctatggtaagcgggtgtgataagaatcaatgtggtataagggcatatgctcaacttgttcttcatacagaaatgccattattggcgcaagggcaacaactcaacattaacaaaaatagagttcaaattattatcataagggtaagaataaaataaaaccaactgaagtttacatcactgacataaggacaacagttcagaactaacacaaatagaacacatatcattgacataagagcaagaattataaaatgaactgaggttcacatcattgccataaagacaacaacacaacattaacagaaatagagttcagattattgtcataaggccaaaaatttaaataaaattaatcgaagttcacatcattgacacaaggacaccaatttagaattaacataaatataatacatattattgtcataagagcaaggattaaataaaatgaactaaagttcacatcattggcataagggaagtaactcagaattaaattaaattaacaataagaaccatcaaattgatagcacaatcaatcatggttcattcataagtttaattaaacaagccataagttccttacagtcacatgacgcaaaatgaaacatgccaacagataatagaattaacagctaatagaagtaccatggagaggcaacaaatataaacgagtagcctcattccataaagtagcaaaagatatgacattactacaacttggcaataggataggtgtcacgatagcacaagtctcatcccacaaaagccagccaaagatatgacaatatcagagtttgccaacaggggagccaccatgagagcacaagtatcatcccacaaaagctagccaaagatatgacaccactatatcttgccaacagggaacacaccacgatagcacaaccttgacccataaaaggagcatatattgctctagatgtcaccaaaagattgatcaacctgccccatgca

SEQ ID NO: 4288 - DNA, 1238 bp, Zea mays
  misc_feature (1)..(100): optimal_loci_260880_G1, chr7:144862586..144863823, Cluster 26
aactagtaagtttttttttttgcagtataggagcagatccctcactagatcctaggatgcatcgagcagatgaaccatcttgttcacgaactaagagcaattccaacccagaaactactagtgatttttatagctcgcacctcactaagaaatcactttagaaactataagtttcaactctagttctttgttgtggataatggttttttggtctttgttacacgtgtagacctgattttttatggaggaaaccattttctcctcttttctattaattttcttgacatgtcacaaattacttatatggtagctaaattaataatatagaaactagatgacgtgattgttgggaccagtctctcagacaagctgctgaatgctcaggctcagaatcacgccgaagcggagagaacgacacgagtcccatctagctgcttagaagtcacgcatggtcgacaaaacgcgagcatgcgtcacctgcttagacgtcacgcactttggtcgcatgcgtacgcgtgagtgcaaattaaaaacacgtgtcaagcaagcaattttagatggcgagttgtcatggttcatgcataattgctttggtagcaatttgaaactatataacattcggttttctatattgtgagcgaatttcagaatgtgggtaagaaattttctcgtctgtctcacgctaaagcacaagtttagatctcgtcacgatcatttctcacatacactacgatgttgttatatatggatgagtcagaggtttatgagttttctcaacctaagtgtgaagatttttttattaatataaatgtccgaggaatatcttacctccgtcagtcgagtcgagtttttacgttaaataaatcgtcgttctcacaaaagatgttagttaaaaaacaacaactccggttagttttaccaacatgttcgaagcatagcttaacagaagtagggaagaagcttaaacatccaattctgattggtgcaagtgtggtgtggtgtgcacttcctgctcagtcgaaatgatgtggcttcgtacagggccggattacgctaagagaggcgagaaccagcaatggccaatggatggtgtgattgactcagaacatttcctatttgttaagcctggttgtcagatgttgcggtaattagtatacatattatggtagacgaatcttaaaaagtatcagcattaaatcttcctcgagccgccatgacagattggttgaaataaaatg

SEQ ID NO: 4289 - DNA, 1343 bp, Zea mays
  misc_feature (1)..(100): optimal_loci_261787_G1, chr7:150034345..150035687, Cluster 26
tcgcatatatacgtgatttttagctccttgcaacttgtcatatctcgctactcgttgaggctaacaggctacggcggcctacactggagctggaggtagcacggtcctagctagactcctagcatcctactgcaagtctgcaacgttgacgtgctagtaggctaccacagcgatgatgtgaggccattggtaccgccgcctggacagagggtttcggataagtattggcaccagttaaatttgaaccagtgttaacacaaatatctcacagaggtaggacaacgtggaaagggcaagggcgatcgatactcggcataaaagccggaggctatagtagtcggtgcagaggtattaacactctaaatgacacttttagaactagtttgttcttaacgtctctacaaaacacacctttatttgtcacaaaatactatacgttcattaatcatcgaaacccaacaagaacttagacgccagcactaggcctcacaggatttatttgtttttatttttctaatatattactcctaaaataggtgatttgtcgaattgaatagatgtaccgtaccgtttcgtcgatcgtgtcacgcgtcaaaatgatgggcaaagagatggtatagacaagaaaagaaaaagagtagcaatcgtgtcgttgctcgcgtgcttggccatgcattaattcccaacatccgtttgcatgcgtatgcctagttgcgtacgtactctcttcttgtgttccgtaggtacgtgggcaatcggacacgcgcgcgcctcaatcacagtcgtcgtcatagggctgctcttgtttgtccatgcttccaccaacttgcctttctgttagtattaaaaaaaccttgtctttctctattgttttagccattcaattggattcaagggcaatcatagacaaaaaaaaaactacaaggtttactttaaaaagaaaaaaatagtggcatgaaattataattaagaaaaagagagatagagaaacaagaaatgatctcttagatgagaaagcatatttgcatgtctacatgaaagccaagatgcgaaagaaaatatactaaatagacatattatacttggttggacaaaatttgctttaaaactattcattgaaaatatgagccttaagtggagtgtctatatggctaaacaattatagaaaatagtttttaggttggactatcctaattaagtttgtcctcatgggacactcccaatggtatgactataataacttccatgttactgtatttaataaaatgacatgcaaaacattttagtggtacaataataacattaaaagcgagagatggaaactacaagaaaataggtctata

SEQ ID NO: 4290 - DNA, 1026 bp, Zea mays
  misc_feature (1)..(100): optimal_loci_262406_G1, chr7:153838176..153839201, Cluster 26
ctccatatacaggagtagcatatatacgctgcctgagcactgaacaacaatctatatacgtgtgagccctggaagtgctgtttgtcaaccaaggcacatgggcaccaatcatgccataaaactgttgagcggcgtgttaattggtcatatatccagcctcagcatcggtcctttgggtagtaggctacatatttggaacttgcgtggccactcgaaatgccgtagctgatacgttgctgccggtgctcatgaaaaagggtcgctctcactctctatgaatatgtacaggtaactatatccagtgttttttttttcatgcttatatatccgaaaattactgcagctgtgtgcggattattggttcctcaaagacaagaagaggagccatgagtcaggttcattgcatatgcatgcattcagtatctgccgctgcggatattttcgttaagaaaataatatactgagcatgcataacgaagatgtgcatgcaatctctgcaggtgcccactcgctgaatcatcatcagctgattaattataggttgctgaattgaatccaccggcgaatgactgaaattatgtgacgctgaataattgaattgaaggggcatgcagacgagtattatatcaggcaagttgcaggcatgcattacacttgcattggtatatacaaacttccccatctatgttgtggcctgcacgttgtcgtatgcatggctttatatatacatccaaaagttgtgtagtctgctgcctgagtactgtccaagcaatctttctcatgggcatctgcgctacctccgctataatccttgatttgtggttcgttctgggcgtaccatcacggtgtcaactggcagtattccacactagctagccatatcctaatgcgaataattacgtgtatatatataacagaatatgacagcaatatataaagacagatgcttccatatatatacgaaccatttccattgtttcaaaaaaaaaagaagctttgaaatatgctttcaacttattaagaaag

SEQ ID NO: 4291 - DNA, 1030 bp, Zea mays
  misc_feature (1)..(100): optimal_loci_263018_G1, chr7:156806819..156807848, Cluster 26
aagagtcttttttggagctaaggctacaatgacaaagaaggtcctaacgagacaattgttgaagtgttgatcttagctcctcgacacctacctaccaggagcagaagctacatcgtcaagcatgtaaaatgggtgtacttgagccgataattcaagtttacataagagggtaccaactagagtccaaaagtagggtggctgccaagcaaaataaagaaaggagagggcaaggggtgctaaaaaggttcaaatgcagatcatgaaagaacatacttttctagcttgcctagatttactagtgagtcgttcaccattgtacttgttttgttagcttgttattgttttaatttacatggctaagtttttgtgtatccatgcataggacatgtttgagaaaataaaggcagaggagcagaaaaaagaaatatgcatgtcccgtgttatctcatattgtggaggccaatgagggtggggagcatgaggacaatactttgctttgtgagttcattgatctagcaaaagcaaacaaccacaaacaaaaggagaaataggaggaacatgctttcttgtcttagtccgctgaaaattcttggcaaactacttcaagcaaaaggtacccgaagctaactaagttgagccaagtcagaggagttttgtcttgctaaatgacgatgagaatgtgtcctacactaagattgttctatcttcttatttgttagatatgtgtggggttgaaccatttttgtatcatctagttgtcattgttggtcttcttgtgtgctcataccctataaagacaaccttacttccatattacatagtacctcttgttttaatccaaatgcataacagtgtaaggcttatgatgatgcatcgtgtagttctaaagaacgagcttcaaatcaaacaatgcattgaatgccatcaccgggctaatgatctcattctgagggtcgcatgatgatttcatacacaactgtaaccaagtgtcacaaatagcattatcaatcatgctaatgtttctataatg

SEQ ID NO: 4292 - DNA, 1081 bp, Zea mays
  misc_feature (1)..(100): optimal_loci_263489_G1, chr7:158992433..158993513, Cluster 26
gtgcatcaaccctatggccacacgtgcgcatgccaatgtaccatgaagtgttatcaagtatagaatgcgatatcgattaccaagtatatcatacccaacaacatgggctctagaggctatagaactgacataacatagatgttcccatagcaggtatggttgccactgaagaaggacatccctaacactatgcaacgaccaaaggcatggccctgcgtatgacttcatgaccaagataggattggatttgttggctcttagctgaccagacccatgatatggctgacatataaactctctcattccttactctataaaaggggacggagtaaggaaggaagggggtcatttcgaaataaagggataatattctcaagcacaacatctaaaggcagacataaaggtgaattaagaatcgatatggctagcacactcactagaaccaactggaaatggagagctaggaggttatggtattcaaatggttcttgagcttgtaatcttcttcaactttatgttcatcaatcaatgagtaccaatagtacatagggtattatgcacaatatgacccaaacctctttaaaccgcttgcttattggtttctgatcatgctcaagttcaacacacaactttcatatgccccgctctctaataactctcttcgttttggtaccttacatactctatgtctatccacaacatttgctattctagattttataggacatgctataaaaaattatataccaatcattggccaatgccaactctattagatgctaggaaccctattcctccatatctcccccaaacacatcaatggaaaatttgtgtcttggcagcagctactgttgctgctccaagtgacagacgacgattgagtggcatcaagggtgacctgaaaatctccctgcatgggattttctaaacacccttgttaatgataagctaagaatttgccctaaccccttaggcacgataagaagaaagcctcctttatctatacgttggataagatgtgtcctatctcaatctcctaatgtaataacatctttaccgaccatcccattgtcccgtctgg

SEQ ID NO: 4293 - DNA, 1144 bp, Zea mays
  misc_feature (1)..(100): optimal_loci_264087_G1, chr7:161955679..161956822, Cluster 26
cctcgtggatctaattttttaaaattttaaaagtgtctattgaaagctaattccgttgcgcggcctgtgtcagactggaacggacatcgcactgttgcggagtcttcctgtgattttttgctgcatgcgtcagtgctgcaaatctctgcctctgcatgcgtcctcttcttcctttgaactggaagtcgatcgccggcaacgctggctgcaatcacatgatgaagattaattacaagcgaggacaatgtacgttgagccattaaaggcaatgagatctgtgagactgactgtgatccagtggcactgtggcagtttatgtgcctttctagtctctacacgtttaggaacaggacatatgcaacacgttgttgagttaaaagaaaaagaaaaggaaatacggtaggtttgcgtttggatccacaatttcgtttgcggtttacttgcatggaatggataccttttagtgttcagattgtttttttaaatgacagagatacttcctgcatataaaaaagaatgtaatcctagcacgtacattctcgtatttttagtatcttaagtttaattaatcataaataaaaaaactattgatatttatggtatcaaataaatatttttgaactaatcacgaaatattttttatagtaaattaatttgaaacaatgaatgtgaaaattttttatacgggcagcctatagttgtaaactttttctagacggagaaaatatacaggtaaatgcgacacatgttgttgaatgcatgccaccaaataattaacctgcagaggcttttgaggaaaggaggacgacaagtccctgattggattggaggcgacttctccctcgtcttctctccgttcaatctcaatgatcaacacccgatccagtccttgatggaggtatccacattccctggcaatgatgttgaggttgcttggtttcgtcgtcagtcgctgtaccacctccctgagcaaggataagaaactgggctggcgtgtttggatggcttgcctagagatctcgaagcatgccatggttttacataggtttattacataaaaactggaagttatattgaccacatatatgcacaaatagtaactagtgtgtgtgtccaaagtcgactcttttgtcagtatatagtt

SEQ ID NO: 4294 - DNA, 1349 bp, Zea mays
  misc_feature (1)..(100): optimal_loci_264842_G1, chr7:166367512..166368860, Cluster 26
tccaggctaaatcaagattaagctctgttaaatagctttttttttacttagaagtaattatgtactactaactaagtaaaatgattatctaaactgaacaaagagctaggagctagaaaaaagagagcgctagcttcttcggtttcaccactgtacatgtaatccatcctggagaatcgctatcgcttctatctaaaaaatcaacttactacggaagatctgtagcaacaggctcttacttttgcctctcggcaagcacacaagaaacaaaaacactaatccaagaagaagaaaaaaaagtctgcgtccggaacggcattccgctgacgttttgggtttccacttcaagtaatccactgaatttcttatccgcgtctgacccacttgtttattggttttatcgacggtttggtgccaggcacgctgttctcgaggcagctttcgccatccgccgatgaggataaaagttccagcaatgcctgtccagaagcttctccttcggaacaggctcagccggaagtttccagtcctggtaattttaatttttaatggaacgctccgtcagaaagtaaagaagcccgccatgctgttggaattcctgcagttccatttcccggtgagcaatgtactgaacatgttattagttaatctattagattccgattcgatccacttcttctaaactttaaagcacttcagtttgttttgagctctaaaacttcaatacgatatttgctaaagtacactgtgtatgttttcaaatttgatgggccaccttgtgtagattttcaggtttgagacctacattatttgaactgaatcagttcgaagttcgaactacctactaaaagctgatttgttctacacttgggcaccatcctggtgtagaatcccaattcccaaccaaccaaccaaccaaccacagaccttaaaatagcagggttgtggcgttggcgccataccacctcagcagagcgaatctttttcctgctcatacgtgagggcgcggttacctccatctttccctttatggctcgggtgatgccatatggacattccaaaattctttatgttcaccggatctggcccgatttggtccacaggctcttcagttttttattccttatttctcgacaaaaaaaaagtttagacagagagaagagtatctttgacaatattttcctgagaagggttgggtgaacatgtcaggaggattcattcatggcctagctcgcaggtttgtggtgagaaaaaatgcgacataaacctatcagacggagacatctacctccgcgcacagcgttttcagtgatcagctcggacaacaactcttttttgtcgcggattag

SEQ ID NO: 4295 - DNA, 1327 bp, Zea mays
  misc_feature (1)..(100): optimal_loci_265274_G1, chr7:168653602..168654928, Cluster 26
gcccttacatgcagccggtgggagataaatcggtgtgttgttatggccgcgtttccacatcccaaaagccacatgacctccatttttttgaaaccttccaagctcgttatattatattaggttcagcaagatcgcgaaccatgaggttagttacaaaatcaggaagcggatccaaccaaagcaacggttgatgagtcatcctgtttacaacaaactgagcaagagcatgagcacaactattacatgatcgataacaatgacaaatatctaatactgtaaaattagagtgcagtagaaaaacgactttcctggaacaaccaacctcccatcggcatatcatagtcgtacgatttgagagccatcactaaattagtagaatctgattctagcacaatgtgagaaatccccaaatggattgccactctcaacgctgcaagatatccctcaacttcagcttgaatcacttcaccaacatgtggtaaattccttgctcccgcagttagtccatgtccttgcttatctcgaatgatgaatccccatgcagcccttttatctttttctataaaggctccatcaaaatttattttcaggtaatcttctagtggaggtatccacctttttatattagattattgttgatgtagtgaaacacaaatatcttcaatggtttgtgttgccccttgtgttttcaacaagatgaccatatgaataatcttggatatagagggaagacgctcaccactattgattttatttctagcattccactaacaccacataacatggattacgtctatgtcgatctcctttgccatccgtagtaatagttgcaccatggtaaagctattttcggcttgcagcagagttagtcgtacttgttccaaattcagttctcgccaacagtgtttcattgtctttcatttcaggaacacatgacctccatcttcatccatccttctacacatgggacacaacgtatctatttccattccatgcctattaaaatttcttttacagtggtaatctattgtggccaatcaccataaaaaatgcagaacttttggttgcaacctctgtttccaaactcttttctagaaaaaactggttaattcattacgcaatgaggattctccttcatgagttcgtttttataattttctgcctcttttaaaacatggtatgatgatttcactaagatttttcctctcatatcttggtgccatgttacttgatcttcccggtctatgcatactggtattgttagcataagtcatgcatcaataacctagaataggtcatgtacaagatgtgtatcccaactcgatca

SEQ ID NO: 4296 - DNA, 1076 bp, Zea mays
  misc_feature (1)..(100): optimal_loci_265541_G1, chr7:170116236..170117311, Cluster 26
caatagtattcaggttagctaaaggctttgcaaaaaaaaaatgtaagtgtgatataagagaactccagattggtttgcgcgtagacatcaatatatgtaacatacttgtcggatatggctgccagcagaagaccccatgtcacgtgcaagacgttgcagaacacggaaaagcaagccaatgaacgggtcaatgaaattcttctgtacttctgcaagtgcattgaggacaaacaatgaaaagctaatgattgagtgagcattgttgagctcaagtgctatctgctgagttgtaacagcagcaagattcttgtgaatgagttcttgaaccctttgatgcaacaactttatatcttgtggcgttgttgctgcttcaagaggaaaagcactgaacaccatcttgagcaaggaacaaagtgactttccagcatccagcattttgttgccaaagcaaggttccagtatctaaccaaaatgacccataaaacaaaagcaaagcatgagaatgtcctgatcagtgaaacattaattgcaacaaagaacatgtcgagagaacaagaacaatctggagtaacttacttgagaaatatgattgatgttatttcggatgaagagacggggttgtttctccaagactttgttcataacatcaagtccttgtgcgagggctgatgcagggtccttggactgaggagtgggtgacagattcccaagtaatttctccagataattgaatttaacattggcatttggccagacttccagagcttgagtcagtagatcaagagcttgcttgtacattgagctagattccttatccttaggctcaatcacaagtgatacctgttcttcaaatgaacaaatttgttaatatatgcaactcctatgcaagaaacaaaaacaattttaatgctaaaactacaactgtgcatatgctgattgtggaacatagtagcttcatgacaccactatgtgaccaatactcagatgagactgatggacaattgaacacaaatgtcttcatccctaatgaaatatgccaaaatgtcccaaccaaaactcgaccttcgggggggggg

SEQ ID NO: 4297 - DNA, 1263 bp, Zea mays
  misc_feature (1)..(100): optimal_loci_265658_G1, chr7:170830081..170831343, Cluster 26
aaccacctaatagctagcctccagcctggcatgcatcgcatatgccaactcaaactaattcactcatcatcctcactacttccaagcaagctaagtagaatccataggagtacaacatagcacaactaagtaaagtgtgcagcgcaaggtatatagacgacgactgcggtagaatgatctcacactccacgccaacttttcatccgccattgctagctagctgccctcactactgccttggcttatatatgtacgtgagttgtctatgcactacaaccgagcagtctgactcatcgacacacaggtaaaataaagggagattcaaactccagtgttcgttgttaagaagcgacaatgtatgttaggcattgtacacagctagctattgacatcatactttcttgcctttatgttctcctcgataagcaagtcatgttaaaagggtgcatgcccttgtgtcgatctgatttgagttttatcatccttagatggaaacaatgagaacatggcttcacttgttttgtgatactaaatttatagtttctttgataaaattgctgctatgatgctagactatacaaggatgataattgatgcatgatttattaactcaaattccacaataacttaacctaatgtgagttttctttgtacgccatgccagacacattacacatcatataacttcttgttgtttttaactttaaagaagtagtagcataattataacagaaaatgtctcttataatcatcatcctctccctagtttgttgtatacatgtcttgcgtgtggctaaacactatgacacaagataaacaaaaataccagttgtccaccataacaaatgacacacaacacactatcttaccatttgttgccttaagatatataccatgatattgttaggcgtacatgttatggtatatttctgcatgacatatactatgcttattttagcaatggtgcgtgccaagaaacatggttgcataaagcactatctttagttcttgttactatgtgaaacatgggtgttgccgtgtacatcttgatctactaatttagcataaatgtcttttcttatatatccaaaggataaaacaagttttctaaaccaaattttagttatctctagctactatttagatatacatgtgagttgtccatgatcgggcattgtatcaaaacacatccataaagccataagcataagtatacgttacgcaaaaaaaaatatacacgctataatttcttagctatgtttg

SEQ ID NO: 4298 - DNA, 1170 bp, Zea mays
  misc_feature (1)..(100): optimal_loci_266057_G1, chr7:172746606..172747775, Cluster 26
aaagttacaagagactaccttcttgacggatgatgtactccgatctctccgttccatatgcccctgatatgatgcacatctctttggcaggaggcaacgatcgggccaacgtacgacgacaactcttgtttgcgcgcgcgatcgaacggaccaaaactggcatgccagcaggctactgcatgcatatgcgtgctctcgacgtcgacgtcaacgggcggatatataccagctacagcactgtgcatgctgctgacctgctgtacgtgtgccctgccgcctgcgcgtgcatgcgtttcttcagggagcaggccggagccagggacgcggcaccggcacgggcatgcaccgcgcgcacggcacggcacagcaccctaggtagctactatgcgctcgtgaacatgcaggccagccactcctatttttctcttgtatgtctgcattacgaatcctatccttactacatattttctttcatgcatgttctttcacctttggattgggctaccaatatgtgcatgtgcatttccaccctattttggatcgattttctcaaaagcagagagattgggagttaaagataaggagtaaattgttggagaacgcttttccagtcttaccaaaaaaagttaagagtgagagtgagttttggaaactcttgcgaagttctaatgtaaccaattatgagaatccacaaggtccaacccaactagtttgttcgttctcatatttccagttccatttgaaataagatctcaatttatcttaagtaaaagtattttaattttaaacgagtttatataaaataatattaatggttacaatattaaataggtaaagtacgaagtataatttgatcaaggacatgttaatactctattattgtcctaaaacaacaatatttttattgtaaactttaacaataagtgtaactattagattcatcgaaactaaggttttacttaataaaatagaactaaaaaattaatctaatgcactaaaatcgtaaaatcacaaagtcataatccaaatttggataacgaccaataagatagcaatgggctggaatggatcgatcgcatgactgccccaagtgtggtgcacaaacagagtttatgcatcagcccatttgctatggggttttaggtctaatcccaatacataattctccac

SEQ ID NO: 4299 - DNA, 1065 bp, Zea mays
  misc_feature (1)..(100): optimal_loci_266674_G1, chr7:175536209..175537273, Cluster 26
tagttgtgcccataaattaatatatgatgaacaaaagacatggggtgttacacattgtagctcgaatctttataaaaattcttgtgtattaggctcgtgctatgctgtcaggactcactttttcttgctcttctagcaattctttctcatatacacattatgtaccctaatatctttgctacgaaaatattatttagaacaaagagagcattaatatctataatttataattattatctacctaatctacttttacaataaacttatctaaagatacgaaaatttataattattttatataaacctaattaaatttaagaaagattaatcgacataagcattgtgtagcggcagtacacaccattagtacaaaaagaaagggagagtacatagaattggtaacaaaaataaaagaaaagaaaaaagaggagagtacatgaagagaggatagaaatggatagttttataaaatctaaaagaatgtaaaaaataactatggacctgaccgaggcggacacaccaggcaaggcatctttctggtgactggccagggtgcgttgtggaccgtgttggaccacatttgccactgtttccatttacctcctccctccccctcccgggcaaaaagatgagtgaggaattcattactgctgctcagctctggtacaccaaacatcaaatatctccgatacactggtgaacaaagtacacaaaaatatctccgatatagtttcacaggaaattagggctttgccgtatacctatccatcactgttcgcttgtgattaaagtcaattatttgaactgttgtacctatactctataaagacaaaaaaaacataacaaccatttcttaaagtgcaatacatataacgtgtattattaatgttattttgtgtgaactatggaatacataaagtgcaagatcacaaccatttcttaacatgaaagcacttaatttacatacatgacccattaactagaaaccacttggttcacatgaccctcatcttatgtggagctatcatcctctggaggcttgtattcttcatctgaactactacc

SEQ ID NO: 4300 - DNA, 1072 bp, Zea mays
  misc_feature (1)..(100): optimal_loci_266908_G1, chr8:396783..397854, Cluster 26
gtccaacaaaataaaaaaaaagacgtgtcttttgtctatctataccaatatataattcatcggtttaaacttttcaaaaagacacccaaccagatcacccccacgccccataacttccattaaatccaccaaacaaattgctccattacttaacacaccatcaaaactatcaatctagatcgttgcataacccacccaaatccaatgattaatattattttgatcacccctccctcgacgcgcgcccctgctctttccaaatcgtagcgttaattaggccggagctacatgatatttatatataataaccttgtgcctttgagcatatagctgtcgttaatgagagaaacatatagtctaaaaatttgaatggtagagagcgtgtgttaatcggtatcaatggcaacgaagaagaaattttgttaacccaaaaaagttgccagtcacgcgtggatcccgcccaccattgcacgcgggtcccatgcttttcctgacccaccactgttctgttccgtcttcgcaagggatgatggtataagataaagaagaaaagcatgcaaatgcgatgatgcgatgcagtcatgcacagttccggtgcacccccactacaccaaatcgaggattcgtatataaaaaccctcgcaagcacgcacgatttcgccgtttggctcctgctccaaaccgaaaagcggtctccttttcttttctgggctgccagttaacgatcgcgtcagctttaactagcgaatgtgtgtccactgatcttggtgtctcaatatatgaagaaactagtatacgtcattgaccggggtaggaagtaggtgattggtttaattggccatcgacttccttatcatcgcacaaccgatatatatgtatatatgacatggacgcgggacggacggataagaaggtcgcagccgagcgtcagcacacggtctgtggaagcaagtttggaattcctcctttcagcggcgggcaagagccaagatggaaacaggctgagttcgagaagatatagtacacgtacatatacggtccactttggccggatctgtgttcatttattttt

SEQ ID NO: 4301 - DNA, 1374 bp, Zea mays
  misc_feature (1)..(100): optimal_loci_268748_G1, chr8:10293782..10295155, Cluster 26
gtcggccaggatcttgttctcgttggtgttgtttgatcattgcaagtatttgatatacttaatgacatcgtaggatagtaagtaataaatctaaagaagtttttaaaataggttagtccttattattcggtgcatatatttatgtatataaattttgttttcaccgaatatcgccaaaagatggtgctaaaatcatgttctttgtaccgatgctcgccggcctttaaactaaaatctgtcgccaaaagtatttattattacatatgtaaagatgttttttttcataacgagtctataaagattaagctgcataaaagggtttacttgctatctacttatcctttcagaatctcacatattcaccattttgtaatctaaaagagccaataggtaaaattgatctctcatcaccccctcaagccagaccataattgagagtatcctgctcttttagaaacttgagtggtagatttataatgtaggtatttccttttaatgaattcttgtcatgttccatcctgatcacttggtagcttaaagagccgttatttccacagaaggcatttgttatgaatctccaaatttaaaatagccagtacccccaaagcatttgggagacaaagctttagtttagaccacttaatctgcctcatatcctttttttccctttaaaaaccaagtactacccttttttttctgtacctgagagaaccaatggtagctcgtcgtcaactcgacaagtagcagccgcacgaattccatttcctgatgacgtaccagcctccgaagtgacagttcattcaggtaggggagtagtagtatactctagcagaacgctgcaaggatgcatgtctgattgggttacacgaaatgaatgctgtgtcgatctagcgtctagtgctgctgcgtcgtactgtactacgtgagccagccaatgcatgtagcggcagcagggattttcaactagagatgtcgggtggctaggctatgcatccatcctttcttcctttcagtagaagagagagagagagctcccatcccaagtccaaacaagaacagcatgtggccggtcgacttgtccatttccacaccaccaactctcccgaaaactggtctgaaacgcgccaaaccgaaacgatctcggagattgcccaaaagctggccgaaaagggagctcaatttgctaaaaaaaaaaatcgctcctcctgcagcttggttagtctttggtaggaactttggttggagacttgggagttgagttggtgaaccccacaaccaattgctaagctgggtctcctgcggctgccatatggaaaccgtgcagaggaagccctggttgcttaggtgcgcgtggtctggttcggttggactatt

SEQ ID NO: 4302 - DNA, 1040 bp, Zea mays
  misc_feature (1)..(100): optimal_loci_269452_G1, chr8:13613785..13614824, Cluster 26
agattactctcttgaaacatttcttcaagatgtagataatgtggtaagacattgatgaagggaaatatatatagggtggatggtggtgagagggaatgccttgacgtagttgtcggcgttgttgtccacatggaccgcctacttggcgtacacgaacgtttgctcttccgaaaatcaacgcaattaatatcttcctccaatttagaggggatttgagtgtcctaattagtttttttttgttagacattgcaccgtttgttcaacgctacatgcctctatactaaactcctcaccaactttaagaaagcacctccattgctagttattcctggatggtgcgttgtaccttgtttagccatgcaccggttagtatgggcgtgcttggttccttcggctagcctcgccttgcagagcgagaatctgaaactggtgtgtttggttggctttgtttgattctttggaacatgtgtttggtagctttgcacgttatttttcctgccaatgtgagtgaggctagctggggccctatttttgccctgtgtctacttgttgtgccatgtgattatgaagatatggcgccacgccgttcacaataatgtacttccgaattttgcccataggtccacattcatatacatagatggacattttagcaagaagccaacgttaaggtgtgcataaacacaaatattctcggattccatgccctagcaattataggttgcacaccgtagcatcctacctcgtcacttaatactacttgtatatgactctatggacattatcctgtttccacccatgagagatttggactaacatatgcttataaaatcattccttgtgtttccttacctcttcttctacccatccgtcatgtgttggaattaaccagtataaagaaactatctggaaaactaaaagtgcccatgtgcatgtatttatttggacttctagggcctgaaagttaattcttgtgttatatgattcttgttatctcaaaatctctgaaagaatctttataaaggtttgcatcaagtaaa

SEQ ID NO: 4303 - DNA, 1187 bp, Zea mays
  misc_feature (1)..(100): optimal_loci_270183_G1, chr8:18354268..18355454, Cluster 26
atattcccttcttcaggcattgacaacctctagctccctttatataaggggttagagttacaagtcgttaaactatatatctaattggtttacaatttaagaacaaatcgcagagatcataaccgattagaactttattctttgttcataagaaatatgttaccttgtacaatatctttttcagaacgtagattggcccccgactagatacattattttttgtatgcttatagtacacttattacatacttcctataaccctcttctaccaccaacaaatagcacacatttctatggtttattatttatgttatatagtatcatgtttttatgtctacttgagtatagaaattgaaaattaccaattgttttatacgaataagaattgtcggatttatgttttatttaacaattttttattgttagaacaaaaaatacagattatatctatagaaaactagaaactacgacgaactaaaaccataattttaatataaatataaagtatatataataaccgttctttgcaagaaaactaaaattcagacatttaaattttcagcaagcctcattttcagcaagccacttatattttgtataaattgacggaggaagttgttattattctcgattcggccccctaaaccctagcgtgcctgcatggctgcatccactccagcgccccgcttcgcccggtcatcgcctcgctgccgccttcctcgacccgcacccgcaaaagctaatggcgtaagaccagtcgtctcgtcttctccgtttcttctcctcgaactatgaacttgatctgtttgtttctacctctgtttaattaactagtgtgatttgcggacaactagtaccccttaagctagtttcagtcttatgtgttgtgcatggttgagttcaagctgcctcttacagcacgtttggaaggtcgaattccagccagagccagctagctaggactaggttgcatgaataattttagatatttgtgtgaacccgctgtgtacgaggaaggagaaagggacaatttatcaatccagagaatgcagcagagcctctcaaaatcatcggttccaaggcacacttgttgtctggagtttttatttaaaccagaggattctggtaaacatgatttaaggtctaactcccctgaaacttgtttggttaggaatgcttgcggttga

SEQ ID NO: 4304 - DNA, 1132 bp, Zea mays
  misc_feature (1)..(100): optimal_loci_27175_G1, chr1:164635482..164636613, Cluster 26
tcttcgcacaaggtaatcttggattgcttctcaaatcttcactcaatactccaaaataccaaaactcacaaacaatattagctcaagccaacaagtgagtggatgttctcgatgatgatcgacgaacataacagagcacttgaagcaaccaaaacctagtgtacgagtgagacttttcaaaatccaaaaagtgagatatctaatccaatgagaatgaagcaaaaacaaaaaaaaatactgcatcaaactagtggttagatgtttaggaaatcttcctaatgtatataagaaccgaaaaaatggatcgcaaaacaagcacccaaaactccgtaagcactcaaaacggtgagctgtctaggactctaggacagcgtggtagtgctatgctcacaattggcatcattgatcattagcactagtgggtgaagcccagtacttctagtctgtgacactgttgtttcacgaggcagtagtgttgtactgccgcttgccaacaactcgaaccaaagctccaaaagaccaaaatgacccaagcaaagttggattgatctgaaattttacacacaatttcacattaaaggtattaaagtatccataaaatttgagctctagaagactaaatcttcaactacaggttgaaaaatacactcttaacttgggggtttcctcaaaaccggtaagagattggattttcatgtttaagttgagcctaccaaaaccacttggtggaatactccttgaaggtatttgcatgtttctatccaactcaaaaatccccaagaactcatattcaacagatcaaagagaggaggttggaaacaaaaaatttgaagcaaaaacttcaagaactaaacagagcacaaaatagattttacctcaccatgaacaaccgtggtaaggccacactttctaggcctcaacttacacagataaatatttggttgataaaatatttgtggatctcactagcagtcttgagggagagatctacaagagagaaagcctgaaaactaaactatttgttagaagctagagagatcttcggttgagagtagacatcctcttatttatagagcttattacatgttcctaacatatccatggatatttttgagctagaccacttagccag

SEQ ID NO: 4305 - DNA, 1346 bp, Zea mays
  misc_feature (1)..(100): optimal_loci_2719_G1, chr1:14162593..14163938, Cluster 26
aatgtaaacagtttcaaaatgtattataaaatctaagaactatttagatttttttgaatattttttatattactgtaggcaaatgtatttttaagtctatagagatattttcacgatatttaaatatttaatttacttttacaatgtaataatatttttatctggattcttagaagcttcgacacattttttatggtttaaaaaacttatttgatacttaccagaactgaaaaaaaggatgaaacagccctcggaaccaccttaaccttaagccaattagaatgattttgagagtatacgggatatgatgtctggtttggaaactcaagtagaaaaaaatagaccacattgatattccatagagctggggttttttcttcttcttctgagttttactgggcttggccctatctaaactgggacagatatgaatgttctccgtctgaccacatagatcacacagaacggcccggatactggctatccctttcttgtttccaaaaaatgtctttcctgcgcaccacatgtatcactacaattttaatatatcatatatggtttctgtgtataacacaaaccaatataagttatagtggttggagaagagtttttattcttagagactatggttcgaatcccaatggacgcaccttgagcgtgcgggaaactctggcgacactcgctacgcatggagagtttgacgacacacgatgaaactctcagttttaaaggtgtagtgaaatgggacatgatttgtccaattccatccccctatctctatcagctttgtgacggcaaatgtgacggtgggttttcccccatccgaaccagatagcttaattagttgcttaaaacggtgacgacaaggaaagtgtgccaccacaacggtacaacttaaccaacatgtatatattttttttttaaaaaagaagaagctgccatcacacactagaaattactaaagaccatcctggtctcaaactatagcaaagatcaccagaatatatcaaatatctcttcttcttcttcttcttttttctcaagggcatgttttgacatccgtatatccacgttaatccattcgtgttggtatggaacttgctctaaaatcatacgtattcaacagcatcaagttgcaataatgcacgaaaggaaacaggctctacatccttaaacatcgaaacaaatgcgcggtcttctcttctccggcttgtgccaagccaagcggcgctcaagttgcaataatgcaggaaagggacacgtcctcctcccgtgtcacggtgtcagttttgcgacggactcgtgttgagctcgcacgaatggtggcccggccgatcgacgtcgcc

SEQ ID NO: 4306 - DNA, 1172 bp, Zea mays
  misc_feature (1)..(100): optimal_loci_271925_G1, chr8:29722852..29724023, Cluster 26
ttcacaacaattagagtagagattagtttaataattgtctcagttatcgaaacaatatataaagttttcatctaacagacccatcagcttgcatgttcttgccctccgtggcctagtgggtactaggccacgggctcgaacttaattagccaaatcaaagttttagttgtttaagtcaggctggccccctggccctggccctagctatgaattatataatattggtgaattattctggcgtccgctcgctcttgtcgcagaccaaagcaccaacgtgtgaccttgctcgccacggcatgccatataatgaaagtgaagtgagcatatgcatgcatgatgggcacccccactacactacacacaaatatatcgagtcgttcctagctttattcgtaaattaaaacattccattcatatatctttatttgatgaataacgagtgcacagcaaaacagcgtaagccagctacttcattcattcaaattcacgtacactgccacttgttggtctcttgatgcatgctgctcgatctctactttacttcagcatatatactctatctctctatagatacaaatatgcacgtgtgtgtaaagcatatgagcgctcatgtgggtccgtcacaattacaaacatgaacaaaaacacaaccgcaaacaaattagagaacacatgaatcacacagtacatattaaaacgtagtaattgccaaacatgcaaattaaaaaaagaaccttgaaactataatgaatataacaaaagcaaaccgtactacaattgtaaaatccagtcatatataaagaactaaagtttgtcactctactttagtcaccctatttacttctttataggctaaaagtgactaaaatttatttagtcaccccaaaccaaacagaccctaagtatcgcaagagaactctccgttctaactcacattaccagatatatatttaatttcatagttgcaactctggtacgtgttgattgcaatattgcaaaattgaacataattaaatagcaacatcatgtttgcatgcatgagttgccacggcaagtcatgttgtgaagacaacatttttacttctttggtccatgtgtcctacttttacatttatacacccgcgtatcacaacagtgaaacgagggattttcgacggctagtggaagccgtc

SEQ ID NO: 4307 - DNA, 1180 bp, Zea mays
  misc_feature (1)..(100): optimal_loci_27955_G1, chr1:170531353..170532532, Cluster 26
tttgttagggaggtctcctctataaatgttgccctctaccaagcctttctcattcgtgagcaataatggatgtgttgagtatgtgccactgagtgacacactcagactgtatactatttaaaagttttgagtgtgttgagtgtcattgcagcactgatacccagacaccatactagagggtctaatcagatttgtaatactcaattttgagtgtatactttatcgttatgcatcatctcactgccggacattcaaaaacattcggcatactcagtcggacgctaaaaacattcgacaaactctttactgaaggtaatactcaatacaaaaatttcggtaaactgagtaatgacttatttatcgggtgtttgacaaaatacactaaacaaagcgttgagcatcggacaaaaagtcggattcccatggtacgcgtggtgtcagtgtcaatgcgcacgatcgcacgtaagcatcacagttaactactgctgctaaccaattgaaaccagtagctagctccttggcagcctacatgatttagagagagggagggatctagcgtgcgtgtgcgtgtgcgtgcgcatgcatggtttggtcgaccgcccaaaccactgagcccacgtacgtacggagtacgtgtcattgtccgcgcgtgcagacagactgcgacgtcactcctgttggaattaattatatggacttttttctgcgttgttcctcctaataattgataaatcttaaaaccacaatcatatattagtgcatgaacaaacgaacatgtatatatgcaatgtctagacaaaattgggatagataatgatgaatagattaacagttgccgcacctacatcagatcatatgggtacagtagctaattgggatgatatatggtcacacttctgtgtaatgctaaaaaggccgatacactgtcatctatcgtctactaattacgaattcagtttttgctactcctatatatatacgtaagtttattaagagcagcagatgcgacactagataacaataatccatgctccggccggctgtgtgggtggttgttagtacaccacaaagcatatctctcgatctccgcccaaattagaacaaaccaccaaaaaacactaaaaacgggagagagagataaagaaaatagtggtcacactgctccctcgctttactatta

SEQ ID NO: 4308 - DNA, 1182 bp, Zea mays
  misc_feature (1)..(100): optimal_loci_280584_G1, chr8:90573737..90574918, Cluster 26
atgagtgtcacgtggccatttgacaaagccgccaggagttcaaacgcttgggacaaataattcatcatctactccttgaccacatgtacgtattgttgcgtgcctgtacagttgtactgttgccttctagctagtagttctgtattatcattagtcctctctcctacacattaacaaacgcaatagtactctttattactaaaaggtgtagggaactaataataattggtttgtcttctactccgtactgctatatgcaacgactattggtttgtcttcatgagggtactgatccaacggttctatgcctttagtgtacatgatgatgtacacataatcctgatcaaccagatacctatacgtaggaagcattatattaatctagaaagattaatttccaaagcaaggatgtagtatcatcatctactacaatcttatgaatcctaacggaacttggttgatgtaagtgtataagatgtaattaattgcatcaacacacaacgaatatcatactctattttaactaaatgatacctcccatgttgctgcaaaaaaaaattgtaatgttatacagattatggaagatttaggtatatcaaattttatagtcgagttattgtgacataaaaggcactacgggtactagagaaaatcacagagaggaggcttaggcctaaaccaccgctggatcaaggcgctaacatgcagattgcacacacacgctcaaacttaagctagtgcattttctatgcgcgctagcttttagtagtgagagagtaaagctagccgactgtagttactcttgaagcccaaactattgctataatgattgcacacacatactctattttataatgactgtagttacgcttgaagcccaaactattgctataatgattgttgtacccgcgtggatcatatagagtttgtggtacacctacaatctttatgaaggatcgaatcaaacaaccaaagtggatgaattagagccaataaaaattatttgcgctcaagaaattttggtttgcttcctaatgctacacccaaaccttcaaaactctaaaaatcactgttagttttgtatagtagagcattagcaattatctattaaaaagtttccaaaaacccagtttaaacaagggcattgtgaagctaggtaagtcctactaggagcaataactt

SEQ ID NO: 4309 - DNA, 1011 bp, Zea mays
  misc_feature (1)..(100): optimal_loci_281475_G1, chr8:96048250..96049260, Cluster 26
caatggttgttggggttatatggtggtcgtgccgtactgatggaaataaactgacaatttttataggataaacgagaaggttaagaattaactagttctaaattttaatgttgttgttgttgtacacttagagtagtgatataaccctttttttctttggtcgtactattaaggggacatgaatatgtagtttgacataggcaactctagtatggagtggtgatgtacacttgtaaaaactagtgctaaataaacccatgagggcccatacaaagattgaaacataaccaaactcaaaaactaattgaaacaagtgagttagcagagttgtggtggcaccaaatgtgtctggtgtgtaccatacatcgagcccaaacataagcatccatcaaggaaatcaccaaatcgaagtataaaagagtactacataccattacaaatgaggggagctgaggagggagtggatggcggcggaggtaggcgagttgccgaaatcataggtgacactaccatctccaaccctactttcctcacactagcggaagctggaagatggagggagagagatagaggaagaaaataggttgggcccatgacatctttatgaccttgtcgtgccggtctgcatggcatgatagctctatcacactcgaatggatggtgtgacaaggtgggccctaccttcgatcgcaggaacatatcaatgtttcacgccactgtggcaccttctatcgtataagtgcatgtggcacgacaaaggtaaattgtcactccaacaccattgtcgcaaccaaaagaatcaaatatgtatactatttcttaggttaggattaaaataatgattataaactattgatattttttttaaaagtccccaccatgaccacacactcccccaacacgactgataagctcaacgagaaggaagaaggtcatacattttttgcattttttattctgtcggcgatgtgtgggctcaagtgttattgagatacagataagtgttggatc

SEQ ID NO: 4310 - DNA, 1306 bp, Zea mays
  misc_feature (1)..(100): optimal_loci_282341_G1, chr8:100955648..100956953, Cluster 26
gaatggcggtttcacctctcttatggagtgatatgactgatagattaatgactgatagattaatgagcacaaagttaagaaagattacaagctcaagaatcaagtgagcgccatgaccttctaactctcccttcccattctagtaaatttctaacctagtgacccctagttcacctttatatatgcatagatgttcactcttttagatcatatggagtgacctggccttttctcagagttcttttggtcctaaaagttcgagcctaacgatccctagttcacctttatactcttttagatcatatggagtgatatgacttcaatcgttactatgccatctttttatggaccaaggggaagagagatttacgtagcagtcagattatgagcccaatcaactaagacccaacaaacccaaatcttatccggatcgtggagtcatacgcaaagccaagaagagagatttacatactagttatatcatggccacggatccagtcaactaagaccaaacaaacccaaatcttattatgatcatgatgtcatacatagagccaacgagagatttacatgccattcagatcatgggtccagtcatctaagacccagcaaactcaactcttatcttgatcatagttgcatgcagagccacaccttcactcctagcacaattttgggattttctgctttagtggcagatcgacaatcatatttactacagggacaagtatgttatgtgtcgtggagtctatacgatggctacaacatagttggtaaccgatgtagaaatctttctagtacattagatagtgtagaaatctttctagtacactagcacacccacacgtggctacataatcgacgcacataccaaattatagccttaagagcctagttaactaagttatgatgatagtgtgtctatcaaaacataatattgcacattacattaaatgttatgtgatatatgagattgttatccaaagtgataacgttatattcgaagcgccaacattatcggtagactttagacatgattcgaagcgccaacattatcagtagacttcatatgtgacatcatgtcttaaggggttgacatgcctttaatggaggctagctacattcctttgacttctagatgccattatactttagccactataaagtcccttcatcgcattaaaggcctcaagagtctcaaagcgagtctcaaagctcaatcattcaagttattcgacacgaggaaccttagggattcgaggggtggtaaagaaccctgagcaactaataatgtatttctactcaa

SEQ ID NO: 4311 - DNA, 1144 bp, Zea mays
  misc_feature (1)..(100): optimal_loci_282388_G1, chr8:101180764..101181907, Cluster 26
ttatattatatatccatatatgttaggtttagtgtgaggttgtattttgttcataggtacatttaattagagttgcatatgttgtttgtatatatgtgatgtggcaatatgatcaagaccatatcggaagtggagccgaagtacaaggagattatcaaggagtatgaggataaggtactaggtacccatcaatggtgtttcttaagatccctctgaattgttagttgactttgtctacaagctaggcaagccttggtgcatgaaccatattttcaagtacatatattacatgggtgcattaagttgtaggagttagttgaaatacgcatgcatataccttttatattatgaaccatactagaataacatattctgcatcgttgttgtgtttaggaacctttgtagcacattggtgatgcgtcgttactaaatatagccttaatatgatttggttaataattggagaccatatgaggagtgttgtatggtgtggcaagttggcaacaaggcaagggggtcttggttgctatttctttgtccctcttatgtctatcaaggattgttcgttagtagcgacgtggcaagtttgaaggtactaaacacataacaggggctgagttatagttgacaaagaagcttaatacttctttactactaggggtcctaaacaatttattagagtgtttctctcaccactagcaaagttttaagagacatggaatgtcattggtaaaacttaggggaaactcgtcccagataggccccctagggtgggttcactatggtggttagatcatttcaaaccttggtagtatatttggaatgcttaccttgtgtcgcctccttcgagaagtacgagcatgtgttttgaattgcttagttagacatgtatttattgtaattgccgccctccttagatatgtataccacttgtctcactactgctatcatagtaatagtcgtaacatgttgtggtgagaaagaatgaaaataactgggttgagatattttgattaattgtccagtgcttgcaagtattataggtgcttatctatactagttaagtaataacttcatgtgactcctaaaactatgactataagaatgcacttctagtagtgctttactgcaaaagttagataga

SEQ ID NO: 4312 - DNA, 1185 bp, Zea mays
  misc_feature (1)..(100): optimal_loci_284058_G1, chr8:109954080..109955264, Cluster 26
tacaatgacgcgaggccatcattgttggttataacccataactgacaatgatgttggtcttcactgcaggatgctagtggcacaaacactagtaaatgttgtgaccattaactctctcataacccttaaagtatggccccaaacttaatattagatttttggcaagcctgtggaccaaaagtatggccctacatagaatcttgtatttttctgacctattttgttattattacatttattttatgttgaaacagagaaagaatgttgaactatcccttcaaaataatataatattccatccacctccaccaaaattggttcactggaccatgtgaccctgtttagaaatttgctaccatttaatttctagtcattttagagtagctctagttcaacatgtagttactttatattgtcaagcagaaatttatttaaataacccataatagcaaactacctccgaaaaacataaaactttgggttccttaacttatgctacgtacaaaatgaagaaaaacttttgcggtctataatacactgaaaatgcatgagaattgtgaaattattggatgtctagttagtgttctctagaatggtgcatccatttgtgagccatgtttgttccagctttatagaaatgggtttagattttttttcctagcatgttcacctgaagtatggccactatatttttattatccatatactcttcatataaatataaatatgtgtaccctaatctagggttaaggtgtccatgaccatttgagacttcatcattatatatgtactatccagtacttcacatgcaggtggatgcattctcttttgggatagttgtgttgtgtggccgatcttgaccgtcgatgaatcataagcaaatagcaaatgtgtgtttaatgaatctattattgcctccttttactgtcatgtcaaatgaaatccggtgaatttattattcttttctatttctggatgctacctggtgccgactttttactgattattgtcagtacgatcaattctagattgatgcttacaatttgtacatgggggagccccaatctacgcgctgctgcactgcacaaaatcgtcatcattgacttatcattgactgccagtaccaaatgagttcataacttcacattatagtcaatagtgttgccaaattgtacaccatggggg

SEQ ID NO: 4313 - DNA, 1302 bp, Zea mays
  misc_feature (1)..(100): optimal_loci_284292_G1, chr8:111200552..111201853, Cluster 26
agggcattcttgtaatttggcacaaagatgtataccgacctgaccctataaataagggaacaatgcttctgctacagggatgggagttttgtgacttggtgcttgtagtagctaagatacaatttatatgaagcatgaatatgattcagtaaaagaagccattgttttaggataaacacaaagagactttgttgttgtttgtaatcagatatgaaatcaatcaatatgatgaagcgtgttctgttcttcactaacacttgtttcattgtttgtgttccatgttgattgtattgaatcaagtgagcatgtttgtttatcttccttctcccactcgacaccttcggaggggagaagggcttaaatccataaccatgttttcctgttgtgttttttcctaaaatctcgataggttcacaacaccagttaattagttaatggatgacactgtagctatcacctataagttttagataaacaagttccaaataaatagataataatgtagacaacatgatatggctgccatctacaagttctaagttctatgcactacttcaacgcaactaaatttgagacacaccccttgaacaccatacaaccactacatcaaattgtatatataggaaaatgaacaacacataaccattgtctcttcatatcttgaaaaatccctccatgtctttgcactacttccacccaacccctaagttgtcaatgatctggttgtatagttgttgaaccttctacctgttcagcgcttcatgcccttgtaattttgctcaaagctgtcattcatgtcattcctcaatagcatgagcctctagtggacattgctcaaaccatcgtcgtcatcctcatcgtcgaaatcctcctcttcaaaatcattagaactattgtgttgaagaaggtacctacatgttggttacctactaaagtcactacgaataactataattgggaaacacaataaaaagatgaacacttatcccctatctctaagggtttgagggtaggggatgaaggggaaaggggcaaagaaagtagaatgttggaaacattgatatgacattttaacagttattgaatgaatttcttcctcctttttattgtgcctttttgtatacaggtgcatgcatggaaaatcacaaaatggccaatacatataccttcgaaggcctcttaggacgctcgaaggggtgaaatatgaccactcttctattgtcacgagaaacctgctaggtgttgcctagtagccgacacatgaggagccaacagctgcgctgctgctatagtcgcccctcc

SEQ ID NO: 4314 - DNA, 1006 bp, Zea mays
  misc_feature (1)..(100): optimal_loci_284403_G1, chr8:111809526..111810531, Cluster 26
ccccgatctaaaaccaaaaaactcgatccaaccccaaaaaacgcaacccaacccgacacgttaaaaagaaatgaacaagtcgatatgacctgacccaacattaggatcaggtatgcgtcgtgctgaataggccatgacccgaccttaacctgaccggaacccaacccgacatttgaacaagtctaggttcacgtagtacaatttaaaataggatgtgtgaaccggcacgtaaagctttctaagtacatgattcatataatatagtttaaacgtacatgattcatataatatagtttaaaatagggggtgtgaggttatctccagcggatctccctctacaaacagtgtcatctattgttgtgcgtcctctattttgcactatttttcaaagacagcctgatggaaggcaggataaaaagtttgttggagcctaatgatttggtttttcgaaaaaatctaaaaaaatacttttttattgtatttgattttgcattgctttgacttttcaaacatttttttgggttttggttaaatatgttgaatctatatctaaatttttgtttatttttttttcttaaacggtttcttttttctaccttggggcccatgttattgctctcttttttcaccccataccttataggacaagtggctccaactttacaaatttatgcccacacactacaacttcatctgaagcaatctttatatagagttagagctatttgggagatgtgtttggctagtaaggtatcttcagcaagtatttgtttatttgcccttatcaaacgtgggtttcggcagaatgccctcatacatacggatttggttcatatgcccttctcaaacggtgtctaccagttaaaataccctttcatctattcatcagtctaacaacgtctaaagttccaaatctaccctcaccatatccccgcgcttcttcttcttctccatgtcgacgtctccgtgcacacctagaggtatatggaagggagccaaccaggaa

SEQ ID NO: 4315 - DNA, 1302 bp, Zea mays
  misc_feature (1)..(100): optimal_loci_287165_G1, chr8:127109883..127111184, Cluster 26
agacccatacaaatttctttcattttagaagcccacgctggtagaagtggatcagcatcttagattgttcttatatcttgtgtttagtttaaaatttaaagacaaagtatgataggattgttccatactttttaaggatgatagtgtctttactagcatttggttaagagggttgaattcattctagtttttggtttgtttggttggatagagtgcagcggaacaaatggattgttaacaccatcatctatagttatgttagtctcacatgtcaatgatgagccctatcgattgatcttatcttcttcattcaattccctgcatcaccaccatctcatgccccaccgatagcttataaactatgcaccacgccacttctacaaacccacatcccaccttcgcacaagggcaccacgacgccaactctccgtgataccctccccataccatgagcacttgcatgtagatacaacatcactgtctggtgaccacaactcaatcagttggagctctaatagtaggaatggaggaaggacatagtcgtgagttctcattgttgaagaaagacattgtgttatcaaaggacatgtgttcttccttgtatcatccaatctagtcatgtattttttctattcctatttgaacaacttacatcctaaaataaataggtttataaaaagatatctccaagaattggtaattattgttttcatgcatccttgattagcttccacattatgatatttttataattattatgtttataggataaattttaaatcttatagaagttctttctaggccttgccaaccatgaacttgtgtagttgaaggagaggcacaaccgaaagtttggtcattgccattggaacctaagacacactgtccatgcgtggggacagaaggtacatagatggacaaggacaccattcaagctcacccgtggatttcaagggactaggcaacccatattggatgtgaatattcctcctggggatgatcccgtccctgctagtcctagaatcaaacaccctcggaaatgggctcggcccataccatctcgggtagtctctaaaccaaacatacacatatgtatcttgtatttttcttaaactagactataaaattgtataagggataaataaagacaaatacaaacataagaaatggtttggataaatgatacgaaacaaaatttatgtttaaaaaacatcatgaaaatccatatttttctattttagattcccacgtcggtagaatccaacatattttggtaggtcgctaactcaatcctgtgtgtgg

SEQ ID NO: 4316 - DNA, 1242 bp, Zea mays
  misc_feature (1)..(100): optimal_loci_289203_G1, chr8:138653549..138654790, Cluster 26
gtccaccttcctctcatgacttgcgcagcccctcagcctgcagcgcactcatgatctatcgtcgttaacacgctaacgcccaccactagggccaccaaagccgggccatgccgcctacgcgcccgaggggtcgccacgtgcgttggccgatccatgtcggtcgcaccgtgccgctatagcgtgtccttccatggccgcacgactagaggaagaagccgacatttgttttttcctttattttctttttcttttttattaaagaaataataataataataatatagacattaatcaaatgaattataaaaatattactactattttaacataataaaatgtactttttaaaagaaaacgaattaacatttattataaattaatttttaaaataggttttcaaacaaacagaaccaatacactaaaataaatgcatcaaacattttattaatttttaagaactattccaaaagctatttaatttattttgtgtcaaaaaattattgattagaaataaatctttttcaacaagaatacaagtagtttcgttgctacgttgattttttatgtgatggactttttgggtgttacaagtgtcaactaccacaatcgatcttcccgcttcttgtgtccctcagtccatcaatcaacactcttagtttatcagtacgaacccattgacattcaccttcgtcattgaccgtcttcaagctccccacttgtgcaccataagacatgagatatattgtacaacacaccctaaattagttcacaaatttaaccaaagttgatcatgtattaaacaatttacccatcacatttaaatatcatgtgcacttctcgaccatattttctcatcggcaactcaccgtagcctgtccttaaacaatgatccacgtcattgaacccaagctattctgaggttgaaattcatgggaaagccgtttccacgatgtataaaatattagaaacaacaaacatgtccgtgtctcatgatggacacgtacgtacataatccaagtatcccctcgtgtttgaaaaacatcccggaacaaaacaaccaggggctcaaatcaagtgcaccggaacagagtagtccaagcgcgcgcggtgccccaaccgcaagaacgcgacggacgtgaaagtggcttgtttgcactcaatcatggagctgggaggccccatgcacgtagtagctagattgaggggttcgtctaggaaaccattatattagcactaataatc

SEQ ID NO: 4317 - DNA, 1220 bp, Zea mays
  misc_feature (1)..(100): optimal_loci_293496_G1, chr8:160403177..160404396, Cluster 26
cccctagtatgaccacgcaggtcggccagtcaatttattagtcacacacgtgatcgtcctcaagaatcaagatcgcaacggccgggcggccgcttgctttgcttgaccccgaaagcaaacgcaccgttgatctgtgtttgtgacggacgagcgcggcgcaaacaccatgcgcacaaaagcagaaggagagggccgcagagcatcaacgaccggaccatgactcagagtgtgtagatatcaagcaagcaagcagaagcagccaagcacggtggagggcgaccaaaccaatgcacgttcggcaggcgacgcagaccactccgctggtttcaatttcaaccaactgtccttgtcctgccgacgtggggtgcaccgtgcatggcgaccgggggtggagcccgagccacccatctgcatgctggagactcctcgtatgtgccgacggtggcatggcacccggtcaatcacgcatggcaggactacttagatacatttaagaagttattaagtaatatatctttttcttataaagatagaatatcttctattccatgggtctttttttccttcttcagacgatgtgctaaattaaaaattatatattttagaaacataacagatacattatatatagatcttttagtttaatctcagacaaagataattataaaacatctcattatacgattatatgaatatcgcatgtatactacataaacatcataaaatatatcatagaacaccatatgtttactgttggatatcataaagaaacattatagaacaacacgtgtacactacgtgaacataaaacacaatgtagaacatcatcaatgcatataaactacatgaacattatccgtgtactgcgtaattatgtaattaacagaaaaatatagcgaccacatttatactacacgaagaccatatttatctcattaaaatatagaaaataaaaggagtaaaaatacgtaatataaaaaataatcaagaaaaagaagaagtcaaagtaaaaaaaatcatgtaacagtgaagaataaaatatcccaccacaatagcgtaagcacacacatgcttgcacaaacccatcatctaccctcctatctttactatttttaggcttgcgtctaggagtccattcgaacattattaaatattttaagagttataatattgtattttatggttgtgagggtcatacagtcaatccttaatatgttacg

SEQ ID NO: 4318 - DNA, 1249 bp, Zea mays
  misc_feature (1)..(100): optimal_loci_293951_G1, chr8:162552879..162554127, Cluster 26
tgatttgtttgttgtgtgtttaattaaaattaaaaaaatggatcagcctaggagacgaattcgccacgagatgatcgggatccgtggtcgacctgaccactcgtagcaagcggcccacttgcacggtttccttcgttacgtgcagtgcagactgcagaggccagaggggaggaggggtgcccgtggtcgtgggcgctgaacactccagtgtctctactactactagctactacactagagaggctctgcggatctttctgtggacaactagcttgtctacgcaaagcacttaaagcacttcgagtgttaaagtgcatttcatatttgactttgtgtgccgtagcttttttcctgaatatttcttgaaagttgaaacctttgtagtttattattttttgtaaaatttgatcatgtatgtaggtaaaaaaaacataagcatttatgacaacaaatttggatagaatgtattttttatcataaatccattagcacgtatttggcatcgtaaatattaatattattttgcatatgttacttaaattcgagatattttaccttgatgctacgttccaattacattgcattttaacttgccctacactgttaatacataagcattgccctaactagaatggtctctttctaggccacggacaaaatactattcctaaccgacaaaattttaggataggagaattaacagtaggttgtacggtgcccctccacgtcgagtcagtggaaaccaaaaaaaaaaacaacgaagtccggttgcagtgcagcagaagcaagctgcaaagcgtgaattaatgacgactctttttccttgcaggggcgtgagggtgacttgtgcgcaaagcctttatcacttttagaccttccgttaattgttataacgttaaagtttggtcttttccaccaagaacttgctaaaattcaggttattatagagtttctctcagataaccggttattgcgtatgatttatactaaaatcggtggtttagttcgctgcaatttgaatagacatagtctataatttttttatcctaagaacaaagaagatgtgagacaaaatactagattcgatgaaatctaatatgtgttggcataaagacaatttaccatttataagtgttcatatagttacacattgacaaattttttatgtgctataatacaaaaacaaattacatgccagaaaagtaacaatttaatcaaactagttggtttataacaatggttggttaca

SEQ ID NO: 4319 - DNA, 1228 bp, Zea mays
  misc_feature (1)..(100): optimal_loci_295426_G1, chr8:169537160..169538387, Cluster 26
ctccaaactgtgtaacatggcataagtctccaaagatcccatatcttggaagtaagttatgaattcatccttatatattttccccgcgccaaagtctcacttatcttgcacctgatttttaagttcttcatccaatttttcatcagaaggttttccatccaaaactttgatcacagccactagcccaacaatctgatttttgttctccggtatgtctattccgaaaaaaaccttgctctggtatcccaaaaccaaacaaccagagcttcccgtgagaatgacaccctgtccccatatgtccaaactcactacacttgtagcacaacatatcgtttgtgcatttagattggtgatgacctatcctcatacaacggaagcatttgatctgcctcttttgttcatccttcatccaaaattccttctcattatgcaagagtttcctattatcagaattctgaccccccatgatagaagactgcacccctgatctctttctctcttcctcgctagtccgtctcctttgctactagcctcaaaacgctcttcttcacgtcgacttgcaaaaccacccctaccaagagcaaatgacggacgacctccctgcctcctttccaaagaccaccctgccaagatttccagtacccgtgacattttcctgacggcgtcacccttgttcctaaagatccacttctctactctccccttcgcccttctgaagtttggatatcaaatcctgctcccttttaaagtccagatccaagagatcatcgtcttccattcatttcccttaccatttcttccagtgctcgatccttgttccctccgccacgccatcccttctctgactacatgtgcaaagaaacgctcaagactaggaggatgtccaacttgatgaacacaacgagcaagatgacctagacaccatatttcatccaatctggctaggaagaattagttggctatgctagctttcctaggcacccaaaaacaatccaggtaaatgggcatccacgaatgtccaaatatttgggccgaggaaaggccctttcccttgtgttccaagtttcccgctctgtcttgcctgccatcatccaccatggatgaatctccatcactatcttccataagattcctatcaccatcctccaacatattctgatcctggattatgagctccttgctcaaatcgcctaaaacacttattgatcaatcgaacaaacaattatgt

SEQ ID NO: 4320 - DNA, 1310 bp, Zea mays
  misc_feature (1)..(100): optimal_loci_297046_G1, chr9:1584311..1585620, Cluster 26
agagtgtagatcttcaatattggtaagcgtgttgtatcctgcacatcgtagatgtgttcacgtccaaatgtacacttaataaatattaagaatataattcataggtattcttatgaaaataaagaaatgttaaagtattgttatgcctttaacttagagtaaacatagagaaattaaatagttctcaactaggattatattacccgaaaatgtttacttaatttgcttatccactattattttttagttttcaattcaattttaacttatttttcttttacaagaaacattgtcagttttgttctccttctgttgtttgttacatctacatatgcatatcttgatgatgacttgaccaacataatgtaagttatattcaacccaaaggtgacttagatactcgaatataaaacaaaatgaacatggaatgctgataaaaataaagttagtacaaccatgactagatgaaccattgtttgatcaacgaatgttgacaaagtgataataccaacataatacaatataaggatagataaattggtttgccatggtctctagatataaaacatgtggatgaatatggaggacaaccagatattgctttaccttatcgataaaagctaaataattacaatcatggtgttaaagttataagtggattaagaatcattgccacaaccatcatacacatgatactaggataaaacaaggttaccatggtataaatttcatttatcacatgatgcaatatctatcaagtgtaaatacacatgcattttttgtacttatccatatgagctatataccttacattgactgaaaacataacctaaggattataaatgcatgagtattctcctctagcatgtgccacaaaaagagcctactagcacctttaaattgtgtaggtaacattagtcctaacgataactcaagctaccagagcataaaaaagttgaatactagtggaacaaggaccaatgaaactaccatttactatcaaaattttgcacattgatgataccaagagcataataaactataaatgctaataaaatattttaccatgataaatatataaaagcatctaacatataaactatcaaaagggaatgaatgagcattgcctcaccatatccatggctagagaatatagtagcattatatctcaagcttgcaatcattttgtggatattggatcactatttatcggccacaaatgcttactccatttcgtggatattggattactattttttgatagggcgcccaatggaaagagcttacagattggtctctaactcaaagca

SEQ ID NO: 4321 - DNA, 1222 bp, Zea mays
  misc_feature (1)..(100): optimal_loci_29860_G1, chr1:182792883..182794104, Cluster 26
gccactaggtccacaactctatgcatagcccaaaaatattttataccctattaaattctctatatttcttagtcaaaaaatattttataagtctattaattctctgttttcctatgaattagtccgaggtgtgatccaccactccaccattgcagcacaaatcgcgtagaccacatccacaaattcttttatatgctcatcaattttatatggtcccaataaaatttccgtccaccgcgtagcgaaaattcaccacactctagcgacagcgtgattgctggaccttctgtactggcagcccaataagcatcccgccgtaaggggcgcttgggggccagcatgtcaatgtcagcgtttcgtttcacatttcctcctgtcctcatgtcgaaatcgaattttctctattttaaattgtcaattgaaacgaggctaaactcatgagttacttgtgcggcattttgtaggctacttctagagctgtacaatgggaaggaccaagacattgaaatccattttagtatcctgtatattgtcttccctattaccattttctgttcactaacaaacctgcatttttttatacagtgtcttctaattttaaatgttcaaaccgtatttcaaaatgtcactttatttctaaatcattattttagagagccatgtgttgtgtataaaattcgcttttgtatatatatatctctattgaccgctattggggtttgaacagctgcccccctccccctcccagcaacacgtacgcaccgacgacacggaagtagcgtattggaaacgaaaaatctaaaaataaaaatcgcacgtcgatgagatggcgaagattcagagttgaacggagtgagacagtgagtgagtcatgcagatacacggcaaatttccgtctccaaatgtctcgctcatacaagcatgcatatggtatttgtctacggtgatttggtagcctcagctctcaaagctctgatgcactagctagtagcgttaggtgagcaggcaagtgaagctcagcttcactaacactaaacaacgcagagcccgcctgagcctgacacggatcgaccagcctctgccttatcaaaaagcaggggggggggggggggaggggggaagtgattgataccacaccaggacactaacaactcttgccgttagagctgtgctagaagcttaacaactcaaataatcaccaaactattgcctacaaattcat

SEQ ID NO: 4322 - DNA, 1215 bp, Zea mays
  misc_feature (1)..(100): optimal_loci_299710_G1, chr9:11698851..11700065, Cluster 26
agttattttagcgtagatgatgggaaacaaattagatcgtgtgaatacacttagatgaatgatagacccctcaaggagctttttcctatttttattatagcgtgtgataaaaaaagtcttagtggcagaagtccttcctttggtgtgtatcaaataggtggaataggattgttgaacttggttggattagttaatttggggatgaattgggataagtttatttggggcgcgtagagatgtatatttatatgttcgctttatttatcaattaataatgaataccccaatatgaatcaacttgtttgtctatggaagctaaaaattcctattaaaattcaaagtatcctatgaaatttataaaagggaagtgtctctcacttaatataatatagaaaaaaagtggtgggaaggaagtgtgaggtgcaatttatgtaatcagaatgtgaatatccgacagtttgttattgctatattgctcgagctatttggaggactatttttagctcttaaaatatattgacctactaatattaatcatatagtaggatcttggaaaagtagcaatgagactgcacacaaaaaggcttatgataagagtgacaactatattttgccattttagtaattatcgttttgccaaaacgatgttttttctttaaaataaacagataccctctattgtgcaggccattttcatgggaacctactagttcaaattatggagatggatgtagaaagaagaggctcataaagaaataaacgattcttgtcattctttggaggttgtggctatagagatctttgcaagggtggcggttcaatgctagaattccaatgtcttagtattattttttgtctataggtttcactttctttccatgttacatttagttcattcaagttttgcatggaatattttgtaagaccatatgcaagcaactacaaaaggttggaatcgttttttccattgtctaaaaaattagacacaatctatttatttagccttcgcttatatttggatataaactattctagcttatggctagtgaaattggggtttttggtgtaagttgtccaaggagaccgatgtggaggtgttttccttgttaacgcctattcaagcctttgaaacacaacctactgttccaaaaacaattaacaaaaggggcatccaactacactaatacagggacatctagttatgcatgtaattgg

SEQ ID NO: 4323 - DNA, 1223 bp, Zea mays
  misc_feature (1)..(100): optimal_loci_29988_G1, chr1:183853497..183854719, Cluster 26
aatgaacactggtttttgcatcaattttgggattggattcctaggattttggttggtcttacacatcaaatttgtttatctagtcgctcaactacatgtagtgagtcacaagctcttagaccgattttgacatatttttcattttttgtgagctatagttcatgtcatttatgtgtttttgggtgtcctagaacgacgagccccatacattttaaagccacggttaaagcttacatgatgtacctcgatttatggagcatttttctagcaagttttagctcatgaaacaatgagttctttggatttcttacaaccttgaggcgcttaaatatctagggacatgagttttttttgggttgtgattctaagattttttcttgttctaacacgtgaaccatgtctatcttggcacttggccataatttttttctagggtccaattttcttggtagattttttatttcccatgccatcgggtcgattgtcatatttttagaaattttcaagacctatcgcttatgggtctcagttgatttttggggtcccaaaactatcaagcaccataccttcttaaggaaccattagagatactaggatgcaccttgtccaagacaacactatgtagctatttctgctctcaaatgacaagttatttgttgtttgtatccttgtcgccactagcaatcattaggattttacatcagtttgggataatattctagggaatttggttggtcttgcacatcaaatgtgcctatctagctcaaccacatctagttttagagtcccacgctctcgaaatgattttggcattttaaacatttttcgcgagctatagttcatggtattcatgtgtttttgggtgtcctagaaggtcgggccccacacattgtaaaggcactattaaagcttacaagatgtacctcgactgatagaacatttttctggctagttttagctctagagacaatgactttttttagattttctacaaccatgaggtgctcaaatacctagggtcatcagtttttttgggttgtgacttcatggatttttagttgttctaacacaaaacatgactatcttgacactcaggcacatgttcttttttgatagacccatttttgtgggtagattttttatgtatcatacccttggtccaatttttcatgttttcaacattttttgtgtgctatagctcatatgtttctaatatttttggg

SEQ ID NO: 4324 - DNA, 1341 bp, Zea mays
  misc_feature (1)..(100): optimal_loci_300258_G1, chr9:14830501..14831841, Cluster 26
tataacccatcgtcttaaatccattattgagtcacagtgattcaccattcgaattgagtccatgttagcatcctcaccgacacacaaatcattgagtcccaattaattattctatcattcagagtaagttcgtgctcgtgttatcccaaagcccagcccatattcccaccacacattaggtataagaacggtacaacaacctttccttcatatgtagtagtacataagtaattggcgcagccctcagccaagccaatcatctcgccaacccacatgcaaactaccgtaataggaagctggagttaggtacgtacagatgcccttccgcatcctagacactcctgttaagttctgcctcttggacgtgtgtttcctgactaatctgggggttcaaagttccttgcttcccgtccaagttaaaggagatcctgagagctgatcagccatgccgaacgtttctgtaaccctgcattcacgcaatcccgttcgtcgctcactacatctgcgaaacgtggatcactattcacttgtctctgcggcgccatatgagcgttaaagagagagagagatggaaagcaaacgaaagaaaaaaggcaaatccaccgccggtggagaaaaaagggaaagtcctagtcagcacccacaattattatggctcaactgacggctacggtggactagcaataaagtatccgctcacatactacctggccgtgctgctagatgctaatcccctgcgtgccactctcgtcttcgttgtcctcgtgccgcgccgggttggttaagttcctcctcctcctaatcatgcaacactagataaaaaaaaattctcgtgtcaattcgtacgtctgctggatgaataccattttacagtattttgccccgtttgagatggaactttcacaaacaaacgttaggtgcatgttgtctcttgtcactcattcagttttttcctcgtgagttcgttctccaaaacatctgagtcaccatctgtactctctcttagcttagcgtacaagtttatgttagcatttatgttagtataatgctagcatttaatttctttctttcttttaggacggaaaataaaataagagagagagagagagcatatgatcggtagtattgtccaggcgcatccaccgacgagcggacgcgaggacagaaagggactaaaaacaaagttagcaggacggtgcaagggacaccacagacttaatcgaatctcgtaatacaccgccaataatatatatatcattgacctgcctgaatgaacgcctccgattagtgattgctactgctttattactactgatgcaagcttgacctgcctgaatgaac

SEQ ID NO: 4325 - DNA, 1285 bp, Zea mays
  misc_feature (1)..(100): optimal_loci_300405_G1, chr9:15911091..15912375, Cluster 26
ctctatcaaatctcataccctagggtttggacagtcagcaccgaaatgcgaatttgattatggattcgttctcgtggaaatttggttagggatttgttcttgtggatgagatcagaacatacgattaatttatcgaatgaaattttgtgttgttttttttctgtaagtttccaaccttttaaagttggacattttatagtcatgtatatcaaaccgtttacttagttttagtttattgcatatgagaatttttgtatgcctatccatgtttcaaattctggccgacacttctctgtagggccaaagggaaaaggtgctgatgggcatgggccacaacaggtcgtgcttgctatgctgggctggtgcctacttttccagctccaacctctccaagaaacaacctttagttactaaggttgcacaatacttgtaaggcccataagcccatcacgacgtctgactgccagtttcagcttctggtgcatcaccgttttatgcaaactgaattttcgtttagtttgcaaaagtttaggcgagtcctaacagtagcagacgcaagtgtttcaacgagaccattcttgttgacacgaacacattacacgtggtgcaaaattccttctctgcctcctttctgccaccttcggctagagccctgcatgggggcatggatttgtccaaaagctgagggaaaaatgcctcttatcaaatttgatgacaatttctaagcagagtggacgtttcccccccaataggaaaaaccatcagtggatcatagaaaatctccttctcacctatatggcacaagtttcccatggtcattgatattattttattacgttacttatagttcatgaaccgaattacctatgagtctcttttctccgttccaaaatgtgatatagactttaacaagttatcctaggtaaaattaccctaaatttagcgaaatttatagaaatgaataatactgcttatatgatatcaaatgagcaccgctagataaattatgaaatgtgtctttaaaatttaccctttgatggtgttaatattcttctctttttaaattaaatttggaacagtttataacttaataattacttcaagtagtacgaagtctcttagatttcatgattattatagcatgattatagcccaatttgcatcttttgtttacattattacacggttaatgtaccaatgtgtcggtcaatctcctggcccgcagcgaagtcactccattcatttacaaccagggcactagagtactagacactagcagcgtgta

SEQ ID NO: 4326 - DNA, 1292 bp, Zea mays
  misc_feature (1)..(100): optimal_loci_301172_G1, chr9:20313836..20315127, Cluster 26
  modified_base (575)..(575): a, c, g, or t
  misc_feature (575)..(674): n is a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
  modified_base (588)..(588): a, c, g, or t
  modified_base (589)..(589): a, c, g, or t
  modified_base (590)..(590): a, c, g, or t
  modified_base (591)..(591): a, c, g, or t
  modified_base (592)..(592): a, c, g, or t
  modified_base (593)..(593): a, c, g, or t
  modified_base (594)..(594): a, c, g, or t
  modified_base (595)..(595): a, c, g, or t
  modified_base (596)..(596): a, c, g, or t
  modified_base (597)..(597): a, c, g, or t
  modified_base (598)..(598): a, c, g, or t
  modified_base (599)..(599): a, c, g, or t
  modified_base (600)..(600): a, c, g, or t
  modified_base (601)..(601): a, c, g, or t
  modified_base (602)..(602): a, c, g, or t
  modified_base (603)..(603): a, c, g, or t
  modified_base (604)..(604): a, c, g, or t
  modified_base (605)..(605): a, c, g, or t
  modified_base (606)..(606): a, c, g, or t
  modified_base (607)..(607): a, c, g, or t
  modified_base (608)..(608): a, c, g, or t
  modified_base (609)..(609): a, c, g, or t
  modified_base (610)..(610): a, c, g, or t
  modified_base (611)..(611): a, c, g, or t
  modified_base (612)..(612): a, c, g, or t
  modified_base (613)..(613): a, c, g, or t
  modified_base (614)..(614): a, c, g, or t
  modified_base (615)..(615): a, c, g, or t
  modified_base (616)..(616): a, c, g, or t
  modified_base (617)..(617): a, c, g, or t
  modified_base (618)..(618): a, c, g, or t
  modified_base (619)..(619): a, c, g, or t
  modified_base (620)..(620): a, c, g, or t
  modified_base (621)..(621): a, c, g, or t
  modified_base (622)..(622): a, c, g, or t
  modified_base (623)..(623): a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
tatatatagctagtggctgcacctgcacttacacgtacaccgccgccgcggccggccgctcaggtaccgcgcgtggcctgggcccagctggccgacgacggcccggccggtccagccgatctcgtccagatcctcctcgatcacgtgtgtttatcacacaaataacatatactatatatagcagcgttactcgtcaccttattatgtcgagatgatcaacaaacaactttggaatgatctagcgaatcttcattgattgttgtcattctagcatgtgtgacgtaccatcacctaattaaggcgaagaaaatcataaatgtatacaaagaataaaaacaatatctacaaaaaaaatgtttaacatatagaaaggatgttgccctaatggccttgtacatgcatatagcttgttcttcctttgtgtccagcaggcctacgcgctcatgacttttttgatgaagtcttgggacgatggccaaggaacgacaccgcctcccaaaatcgacagtttcaacgctggatcgcctctctcgggaatcttccgaataagaagaagaagggtggacctccgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaatttcccttaaaccaagcagtctcaggttccgtactcccctcagggacaattaatggatcctttttttttttggtgaagggccaactaggcgatgattgatgacaagtaaaatgtaattgttttccacggaaggaatagtatatttttgtggaggtagctagcgtgtgcatgggcgtgaggggaaatgaaacacaggtctcttgtgcatgcatttgtacgtgctaggctggccgctggcatacatatgcaagagaaccgtattctctgaacgtaggaaaacgatacaacacccgtcacacttcatgcttaagctcaagcgtcgtcgatcgatcgagagctagctagctagctggcggatgttccctttatctacgacggcgactctctctctctcgcacacacacatgtgcatcactttctttttggcagcatatttgttgttattaattgttgagagagacgatagagatgttgggttgatctcagagactcagacggtctttagtctatcctaacatatcctattctaacatatcctaactgaatacgccttgattgaagacgcaacaacacgtgatggttgcggctccctttaacatcatagagatagaa

SEQ ID NO: 4327 - DNA, 1121 bp, Zea mays
  misc_feature (1)..(100): optimal_loci_301186_G1, chr9:20341475..20342595, Cluster 26
gactaaaatcgatactgatgattttatcagtatcattttagtgcaatccatactaatgttctcggatgaaatcattattctccggtagtgtttgctaaatactcttaaattttgaccacagatacaccctattatgtatatgtgctacttaatcggaaggaattgtattccttttgtttaaacatcctagcatgaaaaatataagaataacttattagccttaatctcaagattaggaaaataatgcaaacgcaagcaaataattagtgcactttctcttgactcatgttaaggtagagcttctgaaccattagttgtggcatgcaagagtacccaaagcgaagccacgataccaacacctacatttgaatgatgataaggcatgcatatcacttgtatcataattcataatcatatatggagtagtgcaacttacatctatatcaatgcatggagtaaaaaagacagttgtaccttccttccaagtcccaaaagtactgcatgcctaaattttctaacaaatcttgagattttttttttaatattggcagcgagaatgaaatctattagcaagaaagagttagcagccacaccatgtaactaaaatgcatgtatttatagtatctgttgtcaaccctaattttggtcgggatgcgatattaggcaacatgaaaccgtcggccagcaatttcaccctcaaatagatagaagcgtgcatatggaacaggagcaccaaaaaatagcaatagcaaatgtgctaatctaagtccatgggatccttttatgaaatttggaccgtcacgtgtgttatcctctttcttgcgatcttgtgatgtccatttaggtataaacgttgccttcctcggtgtagctggggaaaactggaaaaggtagtcgtcgagttacctacaatgtgtcctttggccatgcaatacttcccaaccatgcaatacttacaaactatgtgatgaaatgcatctcacctatatctttgtgatggctctagttatgtgactttcttttagatcatatcactacagtatatatgaaataaacaaatacaatgctcgcgcgttgcgacgacatataatatttgatgaatgactctagcaatctatttg

SEQ ID NO: 4328 - DNA, 1313 bp, Zea mays
  misc_feature (1)..(100): optimal_loci_301189_G1, chr9:20391876..20393188, Cluster 26
catgagggtagtttagagaggtttggctcatattgcctgtaataccctatagcctcttgcgtgtagattaatgaacacaaaggtgaaaaaaattaaaagcttgagtaccaactgagcatcatgaccttctagctccccttttcgttcagttctggtgagagttttaacttaatgtttcctcacctttatgtctgccctagaagattggggatcctaaagtatagaatcctcatgattgtgtatgtcctcgattggaatccttttatacattattctactcttcccttttatagtccaagagaggattatatatttgatggactataggtcttgatcaaatatgacccaagaaccctaagtttatcctagtcgtggagtcgtatgcagtgccatgcctttagttgtcacggtcttaaggatgtcttgttgtaatggcccatgtatctgttataggggcatgtatgtcatgtatgtcatgtcctatcgacggacactagagcccatgatgtcgggtatgatatagttggtaactggtgtagcaatctatactttataatgattcttgatgcattggtgtacccatatatggctataggattgatggcatatcgaatagtggtcttttgagtacgcatgttgtctaaggcatagcaacagtgtgtctatcagactctaatatcgcacatcatatttaatatgatgtatgaaaactttatttgtggtgtcggcaacatgagactatcaataagagactttaaatatggtatcataccttcatttctttgatttgtggattcctttgtacttaacccttataggaacctctttgtccactcgggaggctctaggacctgaggggatctggagacctggccatttgattcatccgagatcgagtcccctggccatctgttaataagagatctagtttgagcgtgtgcatgtgaagtagaactagcacatgtttggaaacggcaaagtttgtcttccatgtattattgcccgaggaaagacgtacgaaagaaactgatctcatcgtcacggttcacgcacgtctaggttcgatttggctcacaagggattttattaaaataaatccataatccttttatccaaatagcatgtattctagtataaattctaacaataaaaagtaacaaattttcttcatttatattagattattaaaatccccttaaaacacaaggcaacaaagttgttgcttactggtctctcaataagactgactctaacggtttctctaaaccgttccgtaccctatatagagagaacttctaaataatagatagttc

SEQ ID NO: 4329 - DNA, 1328 bp, Zea mays
  misc_feature (1)..(100): optimal_loci_301264_G1, chr9:20821140..20822467, Cluster 26
caagttagttttaggttcttcatcaaagagcatatttcgaaggtaatttcttaattaccagtatttgtttgaacaaatttttatattactgcatatcattgactagtctgtgcatgagcatatgtatgctgaccagtcctatagtcatactacattattttgattaagtgaactagaagagattgcaagtatgaataagatcaatattgtgaggccagtactaaaattagccacgttatactctacccatactaatttgtagtctataaaacagaactggtcatagtctgttacattaatttacccctgggaccttcttgcttactacgtcctaaccatttatgaagtttaaacagtacttcatgtgtattaatgtaccctctagtgctgatttcttaagtttgaacaaactctatgcaaatatggatgaactaattaagaaaacctagcataaaggctacaaacttttgctggtagttgttctagtataattaagaagtcatgataaaagcatagaagttttgctggtacttcaaataagaaggcatttcttatttgatgccccatccactggcctaagcatctagagggtgctgtacaagtgccttgtacatggcatttataaaaaatggtaaagaaagtaatgcaacgcgaacaaataattagctaaaagagcatcagtactgtaggacagatatgtaaggactaaggactgtactaatgacatgtttcatagccaaccaaaaagactggtgcaataaaatcgaatcgtcgatgatggatccttatgtaaataacactaagaactcgatgcaattagacagcagtttgaaaattatcattatggttaaccgaagtatttataacatgcatcacttttcaggaaactcaaaggaagtaagactgcaaccaaaatatctgagtgcattccaagcttttgtacagcatatgttatttcaaaaggcaaactatcatttgtgcgctcagctacatctgatattgttgaaacgcctcgatctatatcctcttcaactatttcttcacctagcactagaagtctttcctcctgtgcaccttcaggtaacatacaagcacatatatcaacactaatgtgtaatgtatatggttttaacgtcattttgcacaataattttggttttaacagttattgaactgaatatgatgagttcaatgctagtgtaagacaaaaaaaaacactagcaacttttgttgagatagtcggtgaaaaaaatgctacttttgtttttgcctgcatagttgaggttccgtatgtttggtttctacagcctggtgcatatgctcacgct

SEQ ID NO: 4330 - DNA, 1397 bp, Zea mays
  misc_feature (1)..(100): optimal_loci_313902_G1, chr9:100614450..100615846, Cluster 26
gatgccgggaggcagattcccatttcattgtagttgtggtagacatagaaaaaaaccccatatggcccatcccctcttgtttttagctcctcgactcatctctagggatgaaaacgatcgaaaatgatatcatctataggaaaacgttggttggaaatttatctgattttataattaatctacttattagtgactacaatataatattgatagtcattttgaaattcagattttaaatatggtaatttttggaaacgatattgtctttatggaaacaatacagctgcgaggccttggttatgggattttcagttgtggttttcatccctacccctctccttctctagaatagattaatggcttatgctgtgtctagcggcatccctatcaccttccacacacgaaaatgtgtctctagttgtacacgtctccaacgaaacatggatgcagatgtggaaaaagagataccaccgtagtaccacaaatctgggtactcttctccctctctcatattcaactggaaacaacctttttcgtatccgcattggcgttttgatggaagcatactcctcccattgtgacacgagctatgggccacgctgaggaaattgggaaatttccgcattcacatctagcttctgctgaaaatagccttagtaatcaaccaattagttcacgctaagagcctttttaagtacgggattacagatgtctcttgtttcgtaaccattacttctaatattgtactcctccatagagacaaagaaatagtgtttggttgtgttgcttgacttgcttcagtacatgcccctaatttattctttaacatgagaccattttctatccaagcagttatttagcccattaaacatcatgtaaacactacaaaatggtatgtggttttcatttaatcatccgtttagctcgtttaattggtcatgtagcttgttcaatgatcagtttagctcgaataatggttaaacgatacatgaccgaccagttgtggtttagcatttaggaaaacattgtatgagatggctaaaaattccatgaagagaaataggtggttcctcccgatcactataaaaaaactctaggaaatttcatctgcctaggacttcgactagagtggttcaatactttaatgtcaccattgtcgacctctcatcctctgcttcggtgttcgtgggccaagaggacgaaggtaaactgacaaggatgcatcaatggcctatgaacatgaatccaaattcttatgcaccaaaaatgggttaactagtagttggccctatgtggctcatatcaaatagaggctcgtaacgactacttgtatcactagaaggggagagagaacctaaacttggattccttcctcaactatgtctaccagacgacga

SEQ ID NO: 4331 - DNA, 1037 bp, Zea mays
  misc_feature (1)..(100): optimal_loci_31567_G1, chr1:194220847..194221883, Cluster 26
gattcgatggtagaggcctcaaactcatgcaggtgagaggcgaacatggcactaatttggggatctagcgacaacagagaggtctaggttaagaatgtgctctagaagacaaagcgttagaggtaataagaactagaaaccaagaatgttaacaaagggctcgtagaagtccaatcaacacatggaaagtttttatagcagattacaaaagctaaagcgccaccggattttcctctatgaagtggtagaaaaagcagaaggaacgtagagttgcagaattggaagcatcagtttggtaaagcaacctagtcatgaacaataagccaacactatagactcgagggttgcatgacagagttagggacccggccagaagatagaacgactcaaacacaacaagatcaagatcatcgagaagattcaatgtaagagtctcatatgcctgattcaatgactcggtcaaatgagactcgaaggctaatgtcaataatatatactaggggtatctagatcaagtttaacaagaagacatatatgaatgggctcagtggaaagcccatggactcaacaactatgactagaaggaatgccggctactaggatgattgtagaaggataaacatgcaaatatcttatcgaattaggagatatgatctagatcttgatagacatggcaagatttagatagaaaagtaaaaacacttttaacgataaagttcaacttcatgttagatcatgacagactcgattatgttatctattatctgactaggatacacttcctatgaaccaccacctctccttagtctataaacgagggctagggcgcctcatgagggcataagagatcattggaacataacacaaacaccaacaacaaacaagacatatggtattatctcattctaggagcccgaatctatataaatcttcgtgtctcccatgcctttacctctaccttttgatcatgtgacctatcctataaattcactatcgaacaatcgttgatagttggtttcaattacaccaaaaatgat

SEQ ID NO: 4332 - DNA, 1007 bp, Zea mays
  misc_feature (1)..(100): optimal_loci_320572_G1, chr9:136028088..136029094, Cluster 26
agtgtaggattgttttgtagtctttggtcgtgaagccatcacaataatgctatttctactaggtattttattgctttactagtagacgcgtcttctattttggcatttatcttgttatcttaaaaagcagtagatccaaatctctatgtattagacatatgttactatatatttcctctattataaattatactttaaattataaaatctttaaacatttctagttatattatttttattttcataaaaaatgtattatatcttatagtgtatatctaaatgtatagaaaatttgtttatatagaaaagctaaaatatcttataatctggaacgaatggagtatagtatatacttacactctccataacaaaccttgttcaaattggaaagagacatggctaccaccatgcgcttcaaatcataggttatttcgatttttttagtatttagttttacttttgctttgttacgtcggtgtaacgacctattataagttggaacggatcaacggagccagtactcttctataggatccattaccgtcgcccgcaaatcctaagagccattaccaattatgtcattatcatttatgagcttcacatcatcgaattcataaatcatacacatagatggtgctacctgtcatagacataagatgacataataacggagaactaaaactgagagcggtaaaatagtaaatttctcaaatccgaatggctatacatacctcccaaatatgttttttttttcttgtgggtactcatggctttgcatacctcgaagggggcgaagaaatacataggttgacctaccaaaatttttattttctagttgttttttgtaaaatattcacatttagattcctgtaagttctattttgttttctagatctctatcatagcaccacgagttaagtagcgaggtaacatgttttgcatcgagatacacagtatggtgatagatgtgtcactaatatgacagatggcgcagcgtccatgtctac

SEQ ID NO: 4333 - DNA, 1050 bp, Zea mays
  misc_feature (1)..(100): optimal_loci_321200_G1, chr9:139189858..139190907, Cluster 26
tatatttaggcccctttggaaggtaggaatcgtccattaatttcacttgaaccagtttaattttcacacgaaaactgttttaaaggtgaccttaaatgaaaagaatctaggtcggtcagttttttttttatatttgtcatttcaattacttataaacgaaaactgcagtatgggaccacaacagaacaggggaaaaacaatttaacttgtggtctgcttgcacagataatgtattaggattttattttggtgcatgtttcatattgtaccatattacgtgagtatagttctgaatgaaagagatcctgttcagtgttcaccaaagaaataagaactctgctgctaaagcattattcttacctaaattatacagtcaaattatctttcccttgcagtcatccaagttctccatcaatgatagctagggagatgtaagaaaatgcttagtagtccctggcttagtaactagtcagtgggctacataacatgtatttaattcaatcgaatcacccaaaacaggtattttcatgatgcaatatctgtgcatccgctagcagatttaagactaagctaggagccactcttttacataaaaagccatgttaattgcaatatctgtgcatcttcgactattaattctttgaaaataggtatgataatcaatacattcagcttttgagaatcaagattaaagagtatgttatatatattttaatgtagatttgcagaatgactaggtcaagaaaccaacaactttggagtggttcagctgagaaagatgacattagagctcatttgcactgtcatgaattttctaaagcacggttggataaatggcaactaaacagctgcggttaaaagtttgtgcacgtcacaattaacatcagtaaatcaagtttgtattggaagcaagtgagcagagtgtatagcagatacgatgtaccctgacaatccattgctttctcagatttctctgcctctgtttgcgatgaatatctgacacccaaatcccttcatccttacaatttcttggtctcacataaatcgagc

SEQ ID NO: 4334 - DNA, 1284 bp, Zea mays
  misc_feature (1)..(100): optimal_loci_321482_G1, chr9:140594600..140595883, Cluster 26
atgtcttgttgcaatggtagataagtcatttcagagctataagtattggagcccacaccatcgggtatgacaaagttggtagtggtgtagctatttgtaccttataagcttgctagcatgcttgcacatttatgcatcattatagggatggtggcatgtactgcaagtgttatttgatacgcatgttgcttgtgttatggtaacaatgcaccttcttgatcgcaaaatgtagcccatcacatttaatgcgatggataggagccttatttagttcactagtatcacacgattttcttgagtagagacaaacgtggcactagggttgtactttttggggttgcgctatctcagggacaaggtcatccatattccttagcctgcatgagctcccatacttagttgagcgaggagctttatttttcacatgaagagtcctaggcccaaggagggacccaaggctcagccactagccaggagggctctgaagccgaaggcatcgaaggtctagtgggccctaaagggtgggagattgaaagaatcctaggagtctaagatttcccaagggccctaggggcgtagtaggctaggagagcctcaaagatttaggggcgatattgggtcctcaacatgaggggacccatccttagatagagctaagctaggtccttttgcggtgtgggcccataagggcacatgggtagcattagacagacctttaccaaaattcttctatcaaggtctttggaagacatattggcaacatccgtgggtatggcctccctcgaacaaagtgggtgatggtttgttattttcttgtgttagtgtcatgtaaagtgctaaagggatggatgtggcaccgtccaaaaacatctacatatttgatgctttaggtcagaaatgttagatgactaaaagaggaatcagataaaagtatcctagtgagggcttatgaacctatcactgactccatcgccaattggacaacgtgatctgatttcttgaaaattattgtttgtccatttttaaatattttcctaatagggtttctatgtaaagtcatatttttaaccgaacattatgtcccaacatatccaacaagttagattttgttagccgaatattctgtcccatcatccaaacaaccttcgttagtagtcttaaagagtgtcataaaagcttgtagaaattgctattattttctatgacaagtaaggttctttttatcatggtctaaagtttagacattaaacttcaaatcgctctagatagacagtctaaagttta

SEQ ID NO: 4335 - DNA, 1279 bp, Zea mays
  misc_feature (1)..(100): optimal_loci_322188_G1, chr9:144603482..144604760, Cluster 26
aataccggaatatggtggaggacatatggagttagctcaacaggtttttcataagtcatggttgtttaaccaaatactagattttaacttttcacaattcacaatcttcaacattttttattgtctatacgacaactttttcccccaaaaatcacggcttaaccaaatagagcctctgaaagaacaactcgtagtgaagtgcactttttttgcttagtgactgtgactcccatgcacatgcaaaaccttgttgtctgcataatgaggtgtgctttgcttagtgacgcagcagcgtggtctgatgatcgcaaagaaaaacacaaggattgcgtcaaaagggtcgactaggtggaattctgaccatgccaacacaccttccatcgcacataaataccaaaagaagtgcatctagcggtttcttggccgtctttaatcctgctcctttcaatccgcctttcctaatcttttttttaccagccgcctttgattattgtgatattttgtgtgcaatagatccctactttatggttattgtaattagatttcaaaatctttggaacatacttatgtatagcaacatatctaacgtaaaaagattaaggtacctacatgctaacatcaaatcttgtctgtcgaattcataatctaagagtgagtgcaatcctacctaggacagcgtgccctattctataaaaatgtggagttagtatgagagaaattgagattgcattcagtcattgatgatgatctaataaacaagatttgatgttagcctattagcatcataatagttgttacactatatatagatacgttgctcttagggtatggtgaaaacggattggataaataatgtttcgtttctacttttaaatgtagcccgctcgaattcatatcgatggtcatcgttacgttttgtatttagttttttattattggcaaaccactcttatactcttatcatcatcttacgaaccctaccatataaattacaatacttatgtgttggtagtgttgccatgccagattgattaggtaaatatatatgtcaagtcatgttttcttgattttttttttgtcaatgtttctgtttgccttgggctattacaatcaccaacatgttttcattcgaagttatcttttttttatcttcattcctattttgagccttcgcaatctcaattttgttttcgtaataaaatttaaaagtagtgaaaccaaagaaggtttatcttggctgatccatccgttttcattcctatatagaagtatatggagc

SEQ ID NO: 4336 - DNA, 1388 bp, Zea mays
  misc_feature (1)..(100): optimal_loci_322198_G1, chr9:144617352..144618739, Cluster 26
gatccagcgagccttttgcttcgcagggatagagctacaatttagatatagggtgcacaatatatatgcgtcaacaaaaaaaataggataacgatattaaacatgaatatcaatctaaaaacattaaacttaatattggcttaaaaatataaattgtctttattattgttattattttttttcattccaaacaagtgctaattatttacgttgaagataaaaggggtatagttcataagggtaaaaaagcagccccaagtgcaattgcaaaattatgtttttttaacaatttaaagaagtaaaacaatcttgtaaaattaatggttcacattatatttattttatctactaacataaattatataataaaaatataacttggaaaaaatataatagaaatatgtattttattggtaacaagcttttgctaccatagttaaaatagtattatgtctaattttttatgattagaagaattaatgagtagcaatacaatgcactagtcaatattatattgaggagcttcatgtgtccacttgtatgcgtgtgtctcttgctctttttctaatcttacagatgtttattaccttcgatatcctgatattgttacgccatgacaaccataaacaatatcctaatgacacacctttgatatatttgatattttaaaagtttatagtaagcatggttaaaattagataagtttcatattaggaactgatagaaattgtgtccgtgccataggtcgtttgcctctttttttattttgagagcctaaaatccgtcttttcgtttgcattttggcatttttttttttcttttcctctattaatcaacctggtcggcataagtacttctaggtggttgctgctgccgttttgcgtggattattgtatgtctgcgtttgtggttctgcagcagtgcagctacagtccgcagcgctataaaagtagcaaatccgagctgtttggcttttaaatcattgccatgaagctgacaagtgatcaacgattaccatggaatgctagccacacacgtggttagtagtacagtcctgttctgcggcactgctcgtggtccggtccggctcgtagatcgcgaggtgcagacgcacatgatgagatgagattcagaagtgacagcccagctcgtgcgcgcttccaccgtaccgccactcgtgtcccgccgctcgtggccctgcaaacgcacgacgcggatctatggacggctggaaaacacgacaaggagtctctgaggccgtagtgttgacgtggaaagtggaaacagtgcaacgaaacgcggaatcgctagcattggatgtttctcattttcttcgctagaaagccgcgccatcgtcttgggagtttggactgtgctgttctggtttc

SEQ ID NO: 4337 - DNA, 1125 bp, Zea mays
  misc_feature (1)..(100): optimal_loci_323245_G1, chr9:149804443..149805567, Cluster 26
cacagtgggaagacttttgtagtctctttctaaaaaagaggggaagttcttctaaaatacaatagagtcggaagccagaaggagcttctaccaacttatctctcatgtttttatctttgtcgcccacatcacacgaagctatataaaaagctgcattttcaactaaatagagtacttttttaaaggctcttcctacaagtaagaagaaaattatttttaactgaagctgacagatgaagagctctaccaagacgaaccatagtgctagattcattgtactacttggtttcagtttaatggagcgaaaatctaagtcaaggactaaagagagccattataagggtgttgaggcttcaattaagataaaaactagttcaaggtctgtctgttgaacttcataaaagtaggttgtagttgtacaagtatcacacaactgggatagtgtgattttataagtcaaagagacgcaaaaatgtaattaaaaaaaagtttatgagaagagtttataacaaaactctaaaaaattatagtttcgatacaaccatgatttaaaacactataaaatttgttatacctagatagcgaatagcttttgagaaccaaataatttaataaaactacagtatttctcttgtgctttaaaagtacttgacatccaaagccttaactcgctagctagtgcttcacgtaagataaaaactactttattcacaaatttcgacttctgatgatgatttgattgcgatggttatcggcatgcacgtactaccgagattacctatcattctatgtcttgattcttgcgaccaacgtacaagttgagatattcaagataacgtggattttgtttggtccaaaggaaaccgaaattgtctaatccgccggctggcctcgccgcgccgacatgccagccggcagagggtagtgggcaagtggccgagcctcgttgctgcaccttattacaagttgcggatcatttgctgcatgcctatcggtatcgcgcgctcaaagtattgctagaggctagctagagccttccggatagaaccggcaagcaagcaccacatggacacatggtcccgttccgtactcttttgagatggtatatgctctattccaaatctc

SEQ ID NO: 4338 - DNA, 1045 bp, Zea mays
  misc_feature (1)..(100): optimal_loci_323680_G1, chr9:151676935..151677979, Cluster 26
tcgtatacttctccgttgagcacatgaacgtaggcaacagtttaatttctggttgaattaggcaattgaattcctctcgaaacgtatgactggacttgctttaatataattataacttatctgaagtccacatcaacggaatattagacttagtataagctcgttggattgagatggcgactattttctattcagatgatgtcgatatcattatatcaagtagctactaggtgtgtcactactttgaatataatggatgaaaagaaagtgtgtcatgtggatgcatgcttcttatttttcacttttgatctccaacaagtctacaaacggaacattcttttactgtgcttgcgatattattatattgctgcttgttgtaatggctgcggtgtatgtgacttgtttttcgtattctgtgtgcgaggttaataattcggttactaaaacgtgggcactcggggaattctcggactactctcgtgtgattattattcacccgtctagaaaaacagcttgaaccatggtatattgttttaggctctatacgacttgttttatctcttcatcgtcaggtcatggctgaagcttaattcaccattgcatcatgcatgagcatgagttggacagcggtggttatcattaaatttatcagcgtgaggagaaaattatacatgatattaggctaacaaagcatcttttaagaatcataatacatatacacatttgcacggctggtcttactgatatttcaatatgttatcagtcgtagtccatatattattattgtacattacgattctaacttttagactctagctagtcggctaatcatattaggttatctctaacaggttctctatctcattcttatttcaaactacactttataaatgatatatcaacatcacacgtccatatacacgttattgttggagttggtcttagctgtcgacaacatgaagcccaaccaaagtgagattatccgctgatcaggtaaccctaaggccttattaggccttattcgtttgtccaactgatcaaaact

SEQ ID NO: 4339 - DNA, 1378 bp, Zea mays
  misc_feature (1)..(100): optimal_loci_323682_G1, chr9:151678997..151680374, Cluster 26
tatagtcttttcatttgtctttaatttataccactttatattatttttatagtatttttatctctataaattagactataaattagagttgcattaatctgaaacgaacagccgtcatctgctttgaacgcggactggcttctgagagaccgcccgaccagccccggcttgctttttctgcggtttggcatggaaaaagtatggcgctgccggcccgacctggcgtcaacatttcaatttcctctccttctcgtttgttcgttgaaacaaaaaaaaaaagcttttggagcggtgtggtgaccgtcggtcatggaggaccaggaccaggactcgttcaacccaacaaaggccccgttagtttcacactttttcatcttctgcccctagaagctgctcgatactatttttcagtctttttttataaaaaaaattagtgaaaacctgttaaaatcatcgtctacacaaaatagaccaagtcgtagctatagtaaaaaaatcatcactttgtacatcataaatctaatctctatgatattcagatccatagctaaattctcaaaaaggctcataaaaaaactaaacaaagcagatccaaaagagagtttctaaatttagctccattggtctcccgccggtgtgtaccagataccaacattatattcaagacttcatgtcgagttgatacatacaccaatcgatcacacttctcacagacgaacgatgaccgtcagcagttaggaattgaagctgtttcccagtcaaaaaggtcctagctagctagcagtgtgacggcggtagctgctctcgcgttctgcactgccttttcctgactcgttctggatgtggtgtggagccggagaggaggaagacgacggaccggagaccttgccgtggagtggactaatccgtgtggggcgacaggaatcacgcaaccgcttcaccccttgtgtcgtgggtggtcagggggaacagactttgcggtcaagcactcaagccaatgcaggacgctctacggccgggtcttgtccacagtccacactctaggtcgaatcgagttcccatccagtcgcggctgattcaggattttaataaagacaatgtgacgtcaaaaaattgtcatgcacatttgtttttacgaagggcccataagaaataggtaaaagagttcgatatatggcttaacaatcaccacaaaaggaaagtcaacaaccatccaaaactattggctagacacagatacaaggaaagaactctattgtcaactaccacaactggagcacacagacatttattaagctcgtcacaactatgagggctacagaaaagcaagcacacacaaccagaactagacgaaatcagcaagaccatagcgaagaac

SEQ ID NO: 4340 - DNA, 1204 bp, Zea mays
  misc_feature (1)..(100): optimal_loci_324826_G1, chr10:1285784..1286987, Cluster 26
tgcatgttgtttagtcctaattacagatcaatatgtaggacattagacgatcaatgcaagaaatgaacaatatcatggaattagatgcgctctcatgtcagaagatggacaagaccagaggagaccgactacctgcaactgcgaggctaccaggcaaggagtatgtcactcaagccttaaggccaggcaaaaagaaaagaaagaagaaaaaaggagctgtgtcatctctgcctgtcaactcgacagctcctcaccaaaccatatatatatgcagagatagggcatgcatgacatttccaagggtgacctatcagcgatgcagattgcaatgagatcaggtgcatggagagcccccccttgagcttacgctacttttctttttcctggccattgaaaaaagagaggaggagagagccagtcccagagcttgaagagaaccaaaccatgctttgctgggctacacgccttctgttctcggagctgcggcccgtttctttcccatctttccacaaaatgaggcccaagaggacgctttcaccatcagaatcagaaaacactgcttccgattcgccaatcagaatacatacagatacagcagcgcttgtcgacgacaaggaccgcttgagttaaggtctgttccacttccacctatttttaacccatcgtcaattaatcattgctcctggtaaagaattagatcaccaaaacactactaagcaaaagctttttcagaggtggcggtagagagagacggttggctcaggaaagctcctgcgtgcaccgccgacgcagcagcgggagtggttgcaaagagagatcattacctgatagatcagtaatagaaaactaaacatagatctatattctatcatgtttgttttggtctggtgctctgctacttattaatgcaaattatctgatctcgtccatctccacacacacccatcacctccaagttccgattcaacaagtattctatcaaccgtgttgagagggtaattacacggaataaatcttaaacaagtattgtaacaccgcctattcaatgattgatttgtttcattgatttaaatatgcagcttgtggtattatctaatctatattgtatttgcagaccagcttttttccaggtctcctcttaaactgttctatgtgtgaagcagcacttgttaattgtgttttttaggttcaaatttctcttact

SEQ ID NO: 4341 - DNA, 1040 bp, Zea mays
  misc_feature (1)..(100): optimal_loci_32613_G1, chr1:199997098..199998137, Cluster 26
caaatcataaatctcataaacagatttgacaggggcatagatctcatgcagtagcaacacatttctcttttgaacaaccaatttctatgtcatatggaccacaacccacaatttttaatccttagtatgatcaatgggcacatgctccaccacattttgggacacattatagagtatgcaactcctagatacttagagaaatcatcatattatgacgactttttttatcaaagtcaatctagagctcaacataagaagaaggtggtaaataggtttactatgtgatgtatgatagtcaaaataataagaattcatatctgattataaatattgagaagtcgattactttgttgaaaaatctatctattaatggaaaagacatgggaaaatcatatattgatattgtagatgccaaatctaaacaagaggagttagaatgccagaattcaaggaagatttgacattgtgcaaaatagaagcgaatacgagaatcgcagttgacttattaaagtggcaaaataagaagttgcaagagtttggtgcaaaaatgctaaaggaagggaacttggcatgggttcctaatgaaaacattcgagcttaggaagatgattctcaatcaagtggtgcaatggaagcaaacaagagaaggagaaccaagaaaagaatgctaaattagaggtttgcgccaaatcataaaaaagtattggtcatagagtcatatgtattatctttctatgcctatatagaattcatccccagggatgtgtggctatcccacaacttcttattttgacctttggtagggttttttatattatggaggtttgccaaactatttttcttatcaataactttctatttcaagagccgaagtgttgtatttttgttatgcatactcttgtcaataaattcatatgttcgatactttgttatcatccttagcattaaaaatatagatgattaatgctagcaaccatcctgctacgacatgacatatgcattttaaaattatctcatggatgtgataaatggttaatcaa

SEQ ID NO: 4342 - DNA, 1390 bp, Zea mays
  misc_feature (1)..(100): optimal_loci_326455_G1, chr10:10293215..10294604, Cluster 26
tagtctatcgatgtttaggtgccaccgctaccttccatgtcttttgctcttatagttcattgcgtgaagctagaaaatataactgtagatctaaagcagatgtatacgactaagtggaggtaactgcttcagtttaataagaattcgattgtaaagtagaaaaacaaggaaaaaggtatcataaaggtcgcatgaaccaatacaggaagaaacatttgaatacaattatattgttcttgtaacctatgatgccattggtaaaaaagtgtttgaggaagtcaaggatcttaagttcccgtatgaggtgtggaagagattgaaagattcatatgagggtgaaaggaacatgcatgtttttggtaattaacacaactagtggactaacctcaactttaaatgttaaaaataagataggttaagtccacataaagattgagcaaggttaagaaccatgacaatgatgcatggtgatagccacaaaggataaccaaatgctcaccatgaaaatagaaaggagaaaagcaaaatgcaaagactcaaaatagtgatatcttttatatgaattaacttttgctatagtaatttataaatttataaagtattttatagggtatttattatagctctagccatgtaaatcttaccaaaagggtggtcgggtgagttgtggcagcctttgcttaccctcatttatgttgacgtcattttggcaattccctattcctataaaactctagggaagatattgagtggtgtctcctctcatttttacaattgctctttggttgcattttgattggtggacaaccaactctgaatcccattgagaaaaagtggggtgaggttgtttctaataaagaaaaaatgtgatacgcacatgaaattgcgctatggttattactgtcagtgacagtgttttagtagacatacataattaatattagaattaaggtatcatgtgtagtaacaacagaaactcaaaaatcatcatggactgaaaacactacgcgataaatcatttttccttttttgtcattgtgatgcacgaatcaaatgcatctttgttaccatgcaatgatcatttaaggtattaacaagtttgttgaagacttgagactaacgccaaatttacatcgctcacatcaccattttatgtgtgtagccaacctaaattcgattttataggggcttgaaactttgcttgggtcaagaaaaaacctaaacacctagaaacgacatgtaaataaggaaaggcaaaaatacgagacccagaggaacctaatatttttatctgattttgtactgcatcttttccctactctataggttgcttttttttatcaaaattcagtggaaagcttaacaatttccattgaaagtcgcatttttt

SEQ ID NO: 4343 - DNA, 1308 bp, Zea mays
  misc_feature (1)..(100): optimal_loci_33562_G1, chr1:205406430..205407737, Cluster 26
tatgaatgctgctaatatctgaatgcagaagtagctgattttattgaatgttgttgctatccaaatgcaaaatgttgtcgttgtttgaaactgttctcctaaactgaatgcagaagtgttcatgctactatccaaatgcataattctatcgttgtctgaatgcaaaagtagttgaatttgtgaaccaaaactgttttcactagtagacaacaacattgtagtttctgaaccaaaattgtttccctaaactgaatggcacttaattttgaaccaaagcatatgacaactaggaatttgcattagacggctaagaatttgtagcagacatttataaattcgcagtagacaactagggtcaaactgtttcaaatcagtgccattcacaatacagtttaacataattggttcacatgagataaacaagcatacatagcagccattgaaacagacaagcatacaagaaatctaacatagacatgaagacatgaagtttgacattgagaacctcacataaagtctcacttacacaaccttacatcaagtttcatatagatagccttacataaagtccatacataacagacttacataatagccatcacatattacgatcccaccattcttgtatatcccagacaatatcatcacaaaacccttcaatgctagaaagttgagggttctctagttaatctagttcctgaaaaatcccattccacaagctcttcgaatcacactcatcgttgccttcgatgtaaccatcttcgatcgaaccatattccgatgtgtcacccaactctgttgagtcacaatccaccgaagaatttctatttttagatcttgttggcaaattaaagatgtttgctcacacattttaaagatatggtcaagatgattcatttcatcttgtgaccttccactttttcagaaatggagcacaacatatacacatcgtgtaatttagatgtttgatgcctcatctattgtatggcataatgcataaaaatcctaatcttgacatgattgaagtaatccatgctatattgcaacaaaatgtgatgaaaaagttgtgagttcccgatgtacttatgagttcccaactgccacccatccttcccaaaactataaaatgagagcacacccttgcatcaaccggatctcaaataattgtattgatcgatttttactagaaaaaaacttaaatccactaagaaaatgtgaggatctgaggactcttaaagcactccactatagtagattgacttcgcctatgtgattggagacaatgattaaggaaatacctcacatggc

SEQ ID NO: 4344 - DNA, 1376 bp, Zea mays
  misc_feature (1)..(100): optimal_loci_336221_G1, chr10:73280249..73281624, Cluster 26
tttcccgagaggtatgtatttttagtatttcttgcttttctgagtcggttgcttgctagattatgatctaggttttttgaatcagaccccaattgtctacctacctcggttcttttccttcttgcttgctcccagtattgttatgctctagatacctacatacttctgcagatttggttgttcaatatttttttaattattttcacactagatttggaaattgtggtagcttgggtactctctatactatagtattacaacaaatccacatgatgattcatatctggttatgctggagctcggtacaccgaactatgcttgcttattattcctaggttaggtcttctgggtccttcctctctcactatcccggatctaatggttgttgcttgatttctacatgatatgttatagaccacatattgtttcagtacttttggttttccaatatggtctttttaactgtattaatgcttatttaggtcatcttggtaacttggttacactatactttagtttctagttacatccacacattgatggttgcttctgtttgctagaggtcagtccacccaactaaagagcccctttgatagtttgttatctcctaggttaggtgttcctagtccttcatgtctcggtttgccgaatctaattgttcattcttgttttccttcttgttatgctctatgtccccctattatgtttgtatttttgcttttcaatatgctcttttgtattgtatgcatgctaagttaaggaatgtagttaggttgaatcttaaggatatgtagggttggttctcactttcctcttgccctttcctttttcccgccttctctgaatgtagttttagcagaattcatgtctattgggttatcgcttttgcacatgattatgtttgaacaattctattcattattatgaacaacatacccttgtgaatgattacatttaattaaaataaaataataatgtaccactggaggagcatctatggatacaacaacctttggtactaataacaaacatgtacctaatagtcacctttctcgtctttcatgatccttcaactctaatcatcaccgcctgtaatatatactagatctatttaatcttctaaaatattaactatttttgaataaccactacatctacatgtaaattactagcttacttatgcaagcccatagatctatatacagattagccacctttgacatttttttttgaaaaataaagtaatactcaaagttgcatctaatcacccacctatatggttataaaagattataaatactatctcctacatttttatttcaaattcacatcgaagggtcacatatgtataatataaaaggatgaaaatacatatc

SEQ ID NO: 4345 - DNA, 1098 bp, Zea mays
  misc_feature (1)..(100): optimal_loci_337132_G1, chr10:78133999..78135096, Cluster 26
ttgatgggcccttggtaccaatgttttaaatgtccggctaacccttggtaccaatgttttaaatgtccggcttaggcttttatcggcaagtttttagatcagctataaatgctatagccggctatagttacaagtcaaaccatagcggttttagaaaaaaaagatgacataccttcatagatagagcatataattatataaactatcatatgttcaatatctaaatttgatagttcaaacactagtttaaatgtttaataacaaattatgcatgcaaattcaacaatacttgtaaagagaccgcctgtagtttattttggtcctaaatgtttcaaaggttcatcccagtaaaagactaacaagtttagtagcgctaaatccagctaatattatgtttttagcagactaaggacctccgcaaaggctataaggcagccgctactagtcggctatttaaaacactgcttggtactgggcagcggccttgctttcttgtcatcaagcctgttggcaattgtccatacgtgacttttttttttctgcatgtgagctgacctttttctttggaatgtgagctgcattgtgagctttttgatcccaacgcaaatggatgaagcacaattggcacagactggcatatcgctgaactatgcgtccttattattgtttaaataaaacgcaaaaagtataacagcaagcattagcaaacccaatttatatttttttgtaaaatttagcagcaaatattttactctctttatgccaaaaatacatgtttttattttgttatcaaattatctcaagtctgacaaaaattatagatataattaccaacttttatgacaccaagaaaatatgttccatgacaaatctaaggcctttttagtagggttagttgtccatcggcttgaaacgtaaatagaccaaaatggcttagaaagccaaaatcgagcaaaaaaaacacgaaatcgaaaccgctttaattgtgtacggggtaatgcccggtgaaggtggtaaggttcttttcactaggttacgagttcaaccccctgatccttatgactcggttctgttacgtttggatttgggtaggtctct

SEQ ID NO: 4346 - DNA, 1397 bp, Zea mays
  misc_feature (1)..(100): optimal_loci_337177_G1, chr10:78317753..78319149, Cluster 26
aaaaagtatttcagttgacaaaagtgtcatgcatggcaacatgatgaccacgtatatactaatatagatgaaaaacaacaaacaaaacaaggccaagcctagaatcttacaattcccccagatgttatccatatattgatctgaactattttgaaatagcgcattctttaaactaggcaaaaagtcaaatcatcatcagtcatgttagtttttaattgcaacatgaatactgctagtggtttaacaaacataataggaaacataaagttatctagtccagttgtatagaaaaataggctcctcccaatataataatggatatgcaggtgcatgcatgtaggcgactaaattaattttagtccatatgagaacataacacaagttaaagtggaagtgaaatatttgtttgagtactttttgtacacaacctaccgccgacagcaaacatgagaatgctccaacattttctgcgctactagcattatacgcccgtgcattacagtgaaaataaattaacatccgactattttagtacggcgctgatatcatgtttcaagggagatagatagcttatatactttgtgctattaaaaatgatcttaaccattcatggttatcgtatcataatttcagtgtgctaaacaaaaatcgcagtatatttttttaggatagtaaacaaggtataatttcgttggcatttccacaaatgttagtttattgtgaattgtttggaacatgtattattgaccattttatcagttcaccacgtattgtttttaatccacttgagtgtcttttgagttcaacagaacggtcatgatattaagcattaacagccacatgaattaagccgataactcaataatttaggtgtttaaccaaaaaaacacattccataatcaaatcttatggtattatttcatccttcacctcatattattgtctgcgtagagcatgactgaaaataagacccttcatggttacattcttctaattaggccaaagccaaaacttaaattttggaccaatatcattatatgactaatttattgaattccagagccatatgagcatttcctcattgttcccctttccttctctcttcccctgtcttaatttaattattgcaagggctacctgaatagcaaccgtcaaagaatgacgaggtaggacacaccagcaacagctctcatcttgtgtgatttattggagatctgtggaggcaacaacagactcacatacctacccaaccccaacagcacagactccaaagagtaacaataatggacttaactacaaccaacaacatgacaggcaaaaacatgcgtatattgcctgaaggttgcaatatatttctcaaaaatattgattgtaattatgttacaatgcccgaatta

SEQ ID NO: 4347 - DNA, 1381 bp, Zea mays
  misc_feature (1)..(100): optimal_loci_33862_G1, chr1:206744763..206746143, Cluster 26
tggttttattatctctgttacgaaaaagatacaatttttatagtatttgcattaggtcgatttttcttaagcatgggtatactacaaaaatatattccataattatttgagttactctttgtagaagtcaaacattgaaaaggtctgttgatggttagtgaaagggtgaataacataataaaaatctataaacttaaaatactaaaaaatgtgttagtaaaagagtcaatcctagtagtctctacttgactagcttagccaatacaaagtaagcttcgtatataagtctagttgtaataataagttaaaaaaacactcaaacaaacaactaaatctatcacctagtaactagtgagcttacaaagagaacaactagactacactactcattagaactaagctagactaccaactaacaacacaaggcacaagatatgaaatataaatataagtgctgagagagtgaaccaacaagggcaagtgatagagattgtttcacctgaggttcagttgctagctagcaacctatgtttctatcaagatggatacttagatcaacacttcacatagaagatgatgttaggttgatcataagcatactagtgtgaaaactgataacacaatatgttgtaaatatgtgaaatgtacgactaagaacaatgactgggtaaggactaactatgggacatttcatatttagctagcatgcaaatgaagaaagcttattgagcaaacattgttctatttcatgactttgtcaaaggcacagacaaacctatgaccaactaccattattgacaaagagaagcccccctagtatgcagcaacaaggttaaatggagaggcaacacgtgtcatctcatgttagtgaaacctagtggaataaagtatcacatgtcactgatcacacaactattgttgtactaggaagagtttcctacattggcctctactatgtttttgtctacttcgagcaggtactggttgtcattggctctaatggctaactcatccaacaaaggtatgaggaacatatttcattcatgttattatggcctatcgagatcttattgatcctacgaatctaacaatggcatgaagagctagtataagctcatgctagaacctcctatgtgttgctcatacatggttcatgtgctcattcatgttgttcttgtgaaataagccacatgagtgctaacctagggtctccaatggttctattagcattgagaaaaaggaggtttgttacaaagagcactgaaatacctcaaatcctcaaaagatccaaaacactacccgtaaaacccctagatttggctaaaagtgaaaccaagggaagggtgatggacatactagagcttgctcctaagctaagacc

SEQ ID NO: 4348 - DNA, 1027 bp, Zea mays
  misc_feature (1)..(100): optimal_loci_344722_G1, chr10:119417784..119418810, Cluster 26
tatgtttgtcactcgtgtaaacaagcatgtgtaggacgtcaactttccataccttcatgcataagaaagctgcgactttgttgggcagcggtagagcatacgatcaatgatcgatgaacaccgctaacgagtatggttggtgtcgatctcggttgcttgctatgtctagaaaaactaaaatatactataatttgaactattaggagtcctaactattagctgaaagatcatattaaaccagattttaacaagctgtaatgtagagttaatagtttcgctaatagcaaagtattagttggattttcctgctctcagctaacaattagttgtatgtaggctgaagctaatatcgatgctataggggtacgtgttgtagcgctggagttagtgtcgcttccctaagtcaattaaagcctaaaattagcaatatggaggctaacaattagtagtatggaggctaagttgtttgctagcaatctacgtctttgctgtcatgaatctaagctacctggttaacacgttaactgacattacacaccaagcccaacactctagcattgtaagaaccacactagagagactccacgattccactagagtttctttttgtgaatcccctgcaaagaataagcacaagtcccttacaatcaatgagtggagccgacaataatcaccaagctgctcaatgatcctagaaagcttcgagccatctaggtggcaacaacaataaagagtaacaagagtataactaactcaagcacttaatgacaatccaaaagatgtgagtgaagtgtgtttttcagcccttaagaggtgcacacaagtgtatgtggtggtcagggccgaccacaaggtatatttatagacattcaaagaaatctaattgttaccctattgatgaagagcatatttgagggacaccagacacgaactagccattactatgtgtcaagtgttcgatgcacacactagacatagcacccgacacgtccagtgtgtgttagagatgatggacccaaattacatg

SEQ ID NO: 4349 - DNA, 1008 bp, Zea mays
  misc_feature (1)..(100): optimal_loci_346615_G1, chr10:130719580..130720587, Cluster 26
agtaaccgtgttagaaatctcatttaagtttataaaggcgagaaggcaccggcaaatgttaagttggttcgcgtgccaacctatacatcttgtgaaagggggtgcgactaatcagttatgacgccttcgacaatgacatgagagatagagtcaatctcgatcctctaaccgagttcatcttgagatcaacccgacaaatttagcttgtatatataatttaacaaactaaaactatatattataatcatcaatttcattagtataagataatattaaaaaggcaccatgttcaccgagagaggactataagttgtgagattaatggtaaattcatttacgatgatctaacctctttatggtaatattataaaaggattcatttatgatgacctaacctctaaattaaataaaagagttcatatcatctacaataataaatagtaaattaagagtaacaaaataaggtaaaatagtaatttgatttccatcactgtttagtaaggggattagcgagctgttgactaggccagctactagaaattttacaagaagaaactgtactacgtccgaagtaattactggagtagttaattagcacgcaatggcatcagtattcattacgtcagcagtatgtcgtatttacgtctgcatgcaccgagtgatgtgttttctgtaccttgatttttcccttgtagatatgggacagattctttatgttctgcagtcatatacaagaaaaattacctttgaaacattcaaacaaaggataaattccatgtcctacactgtacgtactcgtctactcaggtaactcgactagaatgcaatgcgggcggaagtattcacatcttgttttggaagaatgatcagtgtatactacaacatcttgcctcctcctttgttggttccttctttctttcttgaaacttgtactcttgtttttactacaacaacatgtactgtatgttcattcaggttttttttatttctgtatagagcgtatatatg

SEQ ID NO: 4350 - DNA, 1214 bp, Zea mays
  misc_feature (1)..(100): optimal_loci_348776_G1, chr10:142097590..142098803, Cluster 26
agagttcctgatctgaatgtccatcagaaactaggaggaggggacataggtgttagccgagagagatcagatcagtacatatagatgaacaaccaagcagagtgaagtttgaaaaaaaaaaagatgagatagagagtctgttgaatatagcctaacattaagcgagcacgtcgttagtgatcgagctactatagacctgcagttaacgcagacgtgggaaacggtggatcacacgttcttggtaggtaggtagcatagtgttacgagtgctcgtttttaagctgcccgccatctttcgatctgggactccaacgtcgtccagaaatttccacgtttccagccgcagtacatcacaagaatctcgcttgtgacaattgaacactgatgaatgccacacctagcgaaacctacgcgtcagatcagtacagtacagtacagtacagtaggccagtagctcaccgagcgaagcctacgcgtcagaagcatcctccatggcctgcagcgtgcgccaaaggctactatgcttgcctgcagccttcttgttactgttgcgaatcgattgagaggctttcagtcatatcttttttacaatggcgttcagaggatctgagcagaccgtttcttttctacctaaagttaggatgagatgactgctatggaagtcgggagatgccaccctgacctgctccgccatggttttctatagggaaaggggcggcaacggagacggaggtagagctacggcctacggagacggtggcgacagtgtcgagagctgagtctcgctatatccgaagacatcccatcaaaataatacgatataattagattaaaatagatattaaaacataataaaatacacaagtaccaattgcaattcacgaaccatcacgtaatttgtgtaaagttcaacacaatatttcatatacgtctaatttaaatattttttcctagatagtaataaaacatcttcacagcacaatagtacggtctagaaaatgttaaaattagatacatatgaaaaattgaaatactgtgttgaactttacttagattatgtgacataatttagtgaattgtaataaaatataaaaaaaactagatcttttgttgtatagatattttcaattagacgggcttcgttgacaacgggcgtgcgggccaacaagccttttttcagccgaggcgacgacacagaggggcccggccctttg

SEQ ID NO: 4351 - DNA, 1258 bp, Zea mays
  misc_feature (1)..(100): optimal_loci_349552_G1, chr10:145951372..145952629, Cluster 26
gttcagagttctctcttctctctacatgtgcgtccacgcaccacgcatgcgatgcgcccggaaaacacacgagcagactgcgccggtcaccagtgcatcatcgactcgtcatctttctatcgtggattttctaccatggattcatggtactggtgcccatatatagtacacaagccaaaagttgcttttaggaccggacccgtgtccaaagccatgttaagctgtcagtgtacaatgcaacgatcagagagcacaggaggttggtttgccatgtcagtgtcgacggacccgacagtccaggtgccatgcggcccacgccaatcgattggactgccgagccagggagcaggctttcgcagggcgtggcccataaacaagctgggtcctccgttgccctttttgtttatgttgtatatattctcaacggcagtcacgtctactaatgagctctaaccagagttaatttatatatacaacgggggcatgggactgatgtaatagagaagagagattcatttaaggttgatgtcatcgtcatttctctcgttgcactcgtggtggtgctagcacaacgacatcgcggcatgcgccgcaacgcctcattttcacaggtttggataccgttgagacgctacgaccgactttgtgttaatcaatgataaatatgagtgcaagtgaatgtgatgtttgttgctggtacaagaggatatacgactattttcattgtatgtattgtcacgttcttcttccactacgtcgccatctagtgataacgatacacaatcctttactcgttgttatcttggttgagcatggtagatatgcttaatgtatagggtatctattttctatagtggtatcaaagtcattcaaacacattttttgatacatgttggtttgcatatatatgatatatctagtatattgggttttacttttgctttggttgcaacatgcgtcgggacaaaaaatgatatgggtgcactattattattgtacctcacacgattgtcaatatatcactaccggctagaatcaccgtcgagaccatcatttccatacaacacatatatcatttcaacaacacatattattattattctgtcatttgtcattgatataaagtaagaatttcgaagtgtgcagcctccaacgagagagcgaagcgaataaatttccctgccatgcagaatatctaaaacaaaaaaaacaatggaatgtaggagatttaaaccctgatcacttggtttgaagcgct

SEQ ID NO: 4352 - DNA, 1230 bp, Zea mays
  misc_feature (1)..(100): optimal_loci_350036_G1, chr10:148830735..148831964, Cluster 26
aactgtttcattgttgctcttagtctggttgcagctgctggaacaacgactccgtactttttccctgcttaaaaaaacaatgaatggtaaagattgtttcacagataactttagtttgccattggatcgccaggctgcacaggttggcaaggaccaacaaggatcccaaaaggcactcctcccttttgcattggcagataccaatgatttggagtgcaaaaaataatcacgttttgataaaaacttgctggaaaatgaagatgcaatgatacgactacaagacatgtctgatgtgcccaactattccttggctgcatggagagggcagctgcgggctgcggctctcaatgaatctcggatcaaaatgggcttttgttcttttgctgggctgtgggccgccgttcatttaaattccaatacgtgggagtgggagggctgtggatattggcagatcagacatgcctaggcttcggtacaggtaccctgtgaattaacaaaaaaataattaagataacataacacacagttatgaatatgaataaactggaagtttacaacaacttaaatctggtccagtacatactatatagacaatatataatccatacaaatcatcctaagttttacaatagtgttgtatgaagcatttgttcttgatatttaattggacgggaaaagggttttttttaaaaacgttttagacatgtgaagcgtgtctccattgataggataataaggctgcaccaagagaagcgatggcagccaactgccaacatttatctatggttgcatgtgcgatcggcgaatcttctaacttgtctgctctgcagtctgcacccctcccctcccctagcttggagtggagatgcatgatcattatatattcttgattgatggaaatggaaggttcgtccatccatccatgatccatctatgcgagtagcgagagtacacatcgcttctctctatgttcctccctctaaacttttttttccttcctaaaatcgatttctaaagtttgttttaagttaaacaaaattaaacatgaccgattttttaaaagaaaagtctatgacattaaattagtattattcagttcactgtattatagtttccattacgctttaacctaagatcgtggagacaggcaagataggaaagtcctcaggcgtcctctcttatcacttcaattttaagagataacattaggatagtcatgttgtaactcct

SEQ ID NO: 4353 - DNA, 1078 bp, Zea mays
  misc_feature (1)..(100): optimal_loci_35560_G1, chr1:215210246..215211323, Cluster 26
taaaatcgagtagcagttttagaactccccgcaatacaatatattgatcatttgtttgtgtgcttgtataaatggatatagatcgatttgcctactttattttgtctgtaaaagagtacaaaaatgcgaaaggtaataaatattgtttttaatttcaaggaaataaaataagaaatcagattaccctgctatatactactagtatacattcctaataataagaggtcgagtaggcagcgaacttgagcgccacaacaaaggactgtctatttgacaaggccaggtatggaacaacatgcatcatatatcactgctcgtcactgtttcatcgattgcctccaggctctctatacgaatactttctctattctgaattataagatgtcttatgttttctaatatattgcttttatcatatatctagacatgtgtctagatatatatctaaacgcataataaaaactacttcatccattctaaactataatacgtcttgattttgtaatatatcacttttgctatgtacttagatacacaatatgtctagatacgtacgtagtaaaagaaatatatctacaagcgttatcatcttatcttataatttaaaacagagaaaatatgcatctaggaaaccgaaaaacgctcttataatttagaatggagaggtattttttaacataaacaacttgaaaccaagttaaacttcttgtttgcattgtacgcaggggtggaggaaggagggacagagggaggtcaagcacctcctatgctaaatgaatttctcttttattcacatgatattttgctatataattcagcaaaaatattgagttaccccctaataatatatcttttagcacttggcccttcttaacagtaatttctgtctccgcacctgattgtataattacatgccttccatgcttttcttagatagctagtctcgttacatacagtttcaaagtgtcactgcaagtagtttttttaccattaaggactttgtgctagtggtttactacctcctaaaacacaatgaagattatctagtttatcctaaggccaactaccctccagcctg

SEQ ID NO: 4354 - DNA, 1255 bp, Zea mays
  misc_feature (1)..(100): optimal_loci_35669_G1, chr1:215768681..215769935, Cluster 26
ctattgtctttgttagtaatagggacatattaaaatggatcttagacatagaaaaatgattttaaatgcctaagcataaacatgttcactaacttaatcttatggtaatagatcttagtgacttactcggtgccatatgcacgtacatatattaatttttattgctttctttggtgtaacagtttgatgtaggtaaagtagatgttttaatcttcaattgtgagttaggattttctcttgataacacagagtctagttttgaatctctaacgacgtctaattgattagatatatgggtttaggtggtgagttgatcttgaaatcactcttagtatttattattgagtacatatgctagaaaaaattagagcaatgtagacctagagttgttgcaattgagtgttgacatggtagtttgcacatctatgatatagagaggtttgagccgtctgagataatacattacattcttcatatggtggatgtgtagatgttagcgcacatagagcttacatactcagaagatgattcaactagcgagtgaaattgagaacctagagactactggactaacgagtggagctaagaacctaaaggatattggacttaggtgcagtagcaacataaagttgcccttgaatgcaagacatcttccctggtgtttcttattactagttataacctttgtgatgttaacaactcgattttatattgctatacaccttttttataacacaaaggagatagttacatctttacctagatgatgggtcccgtttattaaagatataactacttctatcttattgtatttgtaatatcgtacatggtgcccatctctagtgtgccacagtggtgggtgtgaagtgccacaatcataggtatgagtgcccacaccaccaagtatagtgtagttagtagccactatatagctacatgtactacatagtgctcgcatgtacgtctatagcctacagccttaaacatggctacagtgacacttcctcagcacaacgtccccatgtaataaattgaaaagatgatagccttatctcatctactcgataccacatgctagcctagttagggcacacatggttctaaggctatgtctcctagggccattttgccgggtggcaccttaagagagccatgggctcctacatcaacccctttcctataggcccatagggatgctaggctagcaccaagctagacatattatgggtatattgtctgctgatggagccttaga

SEQ ID NO: 4355 - DNA, 1071 bp, Zea mays
  misc_feature (1)..(100): optimal_loci_37254_G1, chr1:224441243..224442313, Cluster 26
tggaagttgcgacaatgaaggagaaagaaagagagaacaaaattttcattttccaagttggtatattgggttttgtccaacttctagttttggttttttggagcactcatttaggtgctctaaaaattcatggatttgacccttagatgtggatttttatgtgctttcaattttatggaattgagccatttagctagaaaaatagaatctgcaatactttgagatgtcccaaacgtcgatttcttatactgcacaattttcatcatgttatatgacacacaactaataactgagtgtttagaattcaacattcaatttttgtaggaaaaaactgaaagcatatacataatcgtttcaccgtacatatttgcctttttgttggttaaaggaatgtctattctgtcaaactagaaagatcatagttggaaaattctcaagactatggattactaacacttgacaggtagtaaactctaaggcccttctggggcacatgaatttcaagggaactacacaaggaatttctcgcattataaatattttgttatgtgttggggtatgtgctataagcatggtatattgaagcattttgaattcttaatgatgggcctctttacagagaacattcttattgttagagtatatatattaggatatctctagatatggaagcatcatgtaattctgtcttgctttatatcactaagggagggtatttatttcataagcaatgtactcatgtataatcaggccacaaggttcaccaatataatccaccatcacactaaagttgttccttctacacttctcccatttgatatgaaagccattgatgtagaattgcactatctaagctactgctcattatgtaaatcaaaatgttgcttttgatagattctctgacattaacatctagttgattccccctttaacccatctgatgtgtttttgtgagtgcatcaaaaactcatagtttatgtactaatgaggtagaggagggatagagagtatgagtaccatacatttagggctaaggtggatgacggtcatgattgtggtggcagtcagata

SEQ ID NO: 4356 - DNA, 1375 bp, Zea mays
  misc_feature (1)..(100): optimal_loci_37282_G1, chr1:224504401..224505775, Cluster 26
cctaactcccctgctcgatgcccctccctaactcatgactagtgcccttgcctaattcccttagtcggcccctctccaacaaaccacatatgatgctaccccatgtccaacacccaacactgccccctatccaacacctgccctatctgatgccacctctgctccaaccatggaaggaaggtattgattctccttcctcccttttccatgaatggttgatcaatcctcaccgtattgctaatatgaattctcttatgtgcttgtcatatctctgtacatagtagtacataacatacaatatttttgcactccaaaaaatgggtgagaaggcaatatgggatctaggacatgtgaagcttttttgtgaactatgtgcatcagaagttgttattgtgtataggccactagttcatcttaataaagtggacttgaaaaatattgaagataagttcacaaaaaaatcaagatgaaagctagaacatttccaaatgaagaataaataggatgatctaaaaaagaagttggattattttttgtggagttaaaaattctactactagacttagatggaatgagataagataaatagtggattatgatgatagatggtgggaagaacatcttgcggtaagtggcacaacaattgaccattttgtactagtatttatgattgttgagtagtagcttacttgtgtatttcagctaatggaaggaaatgaaagcatgtgcatttcaaaaagtgtggccccgcaaacttggattcactccacatcatgtttggaagtgccaagttatcaaggcatctgcctccattctaggagacttttctagtaattcaactaatgatgatgtacaagagatggagaaaaatcccttggatgcaaagttgtccacgatgcaaaaccaaaatgataagaagcataaggcatcttcttctacttgtatggaagagaatgaagaaaagattccatttctacagttgtacaagtgaacttgtaccaagatagaaggagtgtacaagttaaccacaagtgttgacgattcatcggctcctatgaccagccacattcctaccattgttgaggttatgaagatgttgagagaatgtggtctgcaagagggaattgttcttatgcatacgtccactttactcatcataaaacctagaattagagagttcctcaactcatttgaaacacttgaagggagacttaattgattaaagagggaacaagagatgaagcagttgccattaactttatgttcaatatgtgttcagaatagttttggtttggttatgtatgtgtgtaatgaacaatattggtttggttatgtctgtgtgtaatgaacaatattggtttgattacatacaagt

SEQ ID NO: 4357 - DNA, 1293 bp, Zea mays
  misc_feature (1)..(100): optimal_loci_38740_G1, chr1:231723149..231724441, Cluster 26
ataacaatcatatgacactgaattttgaacggattattgcaaataagtctttgattaagttgcataaaaagggaaggacacaaacatatttcaaatttggtgcaaaggtcaagggaagtacccccaaaagaacattccatgtttctaacaaaatatcaagggaatctatgccccaggtttcctcttcactctggttattcagaaccgacttgacagcttctgacgtcaaagcagaaagcagattaactgtaccatagggcctacaaagtgcaagcatgtccatgttaaacaaaatagaatagcaatctcaggttagctgatattgtaataataaattgcatgaagtgtacaaaatattctgaatatactcacaatatgcattttcactattacaaaaagagccagatacaccaaggaaaatcagagatgtagcaatggtatcttggttacgttaccatcttacaaattggacatagtagtgccatattaaggcccaattgactaatatgtaggaatacaagggacgagttaccaaaaattaacctaaattgtgatgtccaactagataatgtacaacaaactgaccttatagattttaggaggttgtcaaaaagtgagccagtagttaaagatgcgattgaaagcaaggcatggcaaccatctatgaactcactgcaacacaatgaatatctcgctcatcagcatttctcaagttttttctcgggttaaatcaagattgcaaagatggatcctgagagaacctttcacttcccccatttcggattgatgctgtgattacatcaggaggttcaatccatagaacaacagcagataatatcagcataaggtgtttaatctgtgcatccccattatctgacaacagaaagaaaagatgaaagattacataaaagagatcacatgtgaatcattaatatgttttccatgatacgtcgaacttgtaaattctaaaagaaaatattcagctttcgaccttgaacagtctaatttgcaacctcaaactatcagaatcgtccactgtctcccacctaccacacatgcaacccccaaaggtgtttttgtctaacaatagcaccaaactgggcagttgtgggtgccgcttccttcaatcacaaatataggcccatcttagcttgctctaagtcaaacttcttttaaattttgatcctcaatatctaaaaatttatataggttgacaacacactatcgacgtcaatagtttattatagcaactactttttataatatataagtcttttcatttaaaatgataga

SEQ ID NO: 4358 - DNA, 1336 bp, Zea mays
  misc_feature (1)..(100): optimal_loci_39472_G1, chr1:235761550..235762885, Cluster 26
ttaatatacatatttagtataaaaaccatcgagggtccacatgtgttatgctacacttctcctaatttgactacatgctagttttaataatattttggccatgtgcaatataattgatgcctagtagttcttctgagccaacctaagaaccagacaccagcatcagaggctagagctagagtccaaggctacggtcataaggctctaagctacatagagttgtcaacaaaagacatgttatatgcatcaaaaccaaataacaaatttttatgtcaagtaaatcctctctatcatggtaacctaaacaaccgatgaccagaacctaagcaccgtgccagagttcaaggttatatggtcaagggttctgcctaaatagagttgttaataaaagatatcttttgcactcaatgaaaatgacaagtttaaaacttgacacaagcatttcgagtagtttactaaattgtatactacccacttcattttatctatatgacaatatttcaacttggttactctagtaatcttgaatgattgcaatcacctcaaggaaacctgaagcggtgattccttgtcgagttgtgcatagtaaaatattgagtgccaagactcaggggctggactttgcctagataactcagctaccagaagtaatgacagaggagtcagtggatagttctcaatagatagagtccaacttacccaagttgataactctactaagtcagactcggggctacattcacaggatgcaccagaggtacatgcttatgtttttgaagatttatgatgacaaagatctctatgacaacaactctattcagcacgaaaaatatcaacagagtccatgttacctgagtcgacaactctactacatcagacgtgatagtttgcatgatagagtaggagacttggttagaagaaaaaacaagccagacacaaataattcaatacattcaagaagattcaatagaagagtttcatcaacctgattcaatgattttgtcaaataaaacccaagcgctactatcaagaatctataccagggtacctataagaaggacatatatggataggactttgggctcggtctagaggccatggacatgaggagggtctaccatgagaaggattccagaatacaaatatggtagttatcttattggaatagaagagataaggcaaatatcctaaatagacacgacaagactctaacggataaggaagacacccttgtaatcataagagctagattctcatacgactaggttaccagtttgaaattgtcctagactatgtaatctactcatatcctccatgtaatcgtcctattcttgga

SEQ ID NO: 4359 - DNA, 1163 bp, Zea mays
  misc_feature (1)..(100): optimal_loci_41373_G1, chr1:245168493..245169655, Cluster 26
aagatgataatgaatgtatgtttaatttattaataattcattagacagatactataacctctaacctctagtattaatgatagtagtatacgcgtattttttttcttcgcaaaaaggtatatacgtgcactagtattggtatattattattacgtgagagtcagaaaatactcggtagattaaaattaaaacaagactagcattgtttgcccacccaaattttatccaccgaggcatgggctgatgggcgtatgcgtatcccggttcccaggatagaaggctaggctagtaggctgtccagttgctgctgggcataggcctgccttgccgctgaccacggttccaagcacgcactcccatgtgcagcaaaaccacgcgagcaagcaaaagatttctcctgccgctccgcgctgggccgctgcagcggcctctgacatgaccggtagcaaacaccacgccgccacgtcctcggcactatacccatacggccatacaatcccatgtttctactgctcctcgcaaaagaaaaaaacttagttttatatcaaacaatttcaaatataatcagtttcataaaaacaagaatcattaatcatatttttctagtataataaatctatttaaagtttagaacgttaatacattttttcttcaaaactaattagactcagatttatctaaatttattttatttagagcaggatttagtgcagtttcaatcgaccatcgatgttgtgtttagcatctgctttccctcttaggtgtgagagtgtatttgatacaattacacacaactttattttagaaaacatatatttttttttcaagcaaaagccttatttgtgcgaattttaacatcttcaagagtgccatgataaaatctcatgcatctatgaagctaacgaaaattatctaccataccactgtttaataaaaaaaatgaaaggatcttttcccgacttcctataatccactccaatggttttcccccgaatttggaggaactatttgtccccaagtgtgctccaacggttcccctccaccccccccccccccgaatcgcgtgagtcggcatatccccatctattcttgatgaatgggggatccccctcacaagccgttgggtgccaatcccgcggccgtagagcacccgaagtggcaac

SEQ ID NO: 4360 - DNA, 1102 bp, Zea mays
  misc_feature (1)..(100): optimal_loci_46400_G1, chr1:271772732..271773833, Cluster 26
gtgcaccgcctcaccatagagagcaaaggccctagtaaccactttctcaaaaaagtgcgacaataaaagctcaaattcagagtaacgagaaaatagcatgtgcagtctttgtagcatcacgtaagctgggccactatttttagcatcaattttgttttgttagatccactgccactgcaaataatgtttaggtctaattatggtcctatttgtttatgcttttctaggtgtgattcttgcggtagccgcttcctcgtatcgccagatttttgtcaattcttcgattctcaattactagtttaattctttttattatggacaatggtgggataaagataaacgagtttattgtagtgtgtttatcaggattatatgatcctcacgaccaccgtcgccaaataagctgaaaccggtgttttaaatagcggaatctaaaatttatctccacccttctcaaacatgcaaatatcgggacaaatcacgatagatatagcagaatatattgggctaaacagcataaatttccacttgtaaaaaaatataccgtctttgattatctaaaaccttggctgaaacagacagggtctcacctaaaaaataatttttaaactttaagtcatttagaagttataaaaataagaaaaaagtatgttatagtagtctagaatactgactacacactatcacaagatatgattttcaacttattttgcacaagtgtagccgcagcaaccgcaagtctccatatctagcctcgtgcgtgtcacctcttactgccacatcacatagtcatatgtgaattttaaaaaaatataaatctgtgaacttaatttatatatctagaatccaaaatgatctcgaacaaaaacattatcaattgcaagttttaaactcatcgagctctacaaatttaacgtaaactaagtcttgatttgaatttatttgaaaaggatacaattttttttgtgtcgtagttatttagtcaaccgccttagggacggtggagttaaccaaatcgtccttagaaaccacccaattttaagatacggttgatataagtggttagccttaaaaaatttagttttagtgtaagacttcatca

SEQ ID NO: 4361 - DNA, 1365 bp, Zea mays
  misc_feature (1)..(100): optimal_loci_46941_G1, chr1:274730495..274731859, Cluster 26
acacattagtcgtgggtccaagtgtgttgaatccaaggtctattctctacttatgcattaaatttaaaacaaccagcttaattaatttacatatcccattattaaccgacgttaaataatggctgcttatttattccattactcatgcatcactttcacagacgtgggtgatttgcaaattccatgcatatgcgaatgaataggaaggatcaagccaccattcatggaagttgatcccgtgaatggaatgtttaaagggtcataatagataggtctaatatgatttaaaaatttcacaaaagccgccacacatgtaagtttagaaaaatatgtggaagggttgatcttatattataccaactgttgaatttgaaatccatgaagccagttgacatacatccaactggaccttgttttgatcacatctgcaccgttccattgtgtatgcatcactttcacgcagcatgtggttggtttgcaaattgcatgctgtggtaaataagagatatgaaaccatccgtacgttttgctgatctaggagtatttttttacataactggaaaaaaggtaaatgtatttttagaagatgtttgtggttgcaacaaaccttcttgtttaatttaacaccggccatagtacccccatacattgacacatgcatgcatgtaacccaaagatacaactgactagtagcactgaatattcaaaagagtgacataggaaaagaaggctaattaaagctagcttaagctccaatcgtgttgctaaacctcaaacaaaaaatattaaaaaaaatctccctaacggtgattttattgaattaatcaaagataaatagaccgagcccaattaaataaatctaacaacgcttctctttttccaagaatggatgagctgctcggaccttcaatttccgtcaaattatgatgctatcatgtatagctagggggagggggcacaccaaatccctggaaataattaaacatttaaactagtcgacacacatgtacatgccgtttgttaatagtccgtgttaaacaacacggctgcatgatttgttccatgaacatgtgcgcttgcattgcatgcatcactttcagacatgtgggtggtctgcaaattccaggcgtacgcagatgagccagagaaaaccacaccaatcacctcgcacttgaattggaattttcggaaccaccaccaacgaccgcatgactatgctgcatggaacttggacgatggacactatacttaatataaactgcacgatcaccctccctccacatatgccacaacagagttaacaaactaaattaactcattaatcagacgaaactcttttttttaaaaaaaagactagcatattag

SEQ ID NO: 4362 - DNA, 1278 bp, Zea mays
  misc_feature (1)..(100): optimal_loci_47175_G1, chr1:276068687..276069964, Cluster 26
gtcgaacagtggcgtgaccggaaaaagggcacgatcgggaaagaatgggtgtggggggagggggggcggagccatgaccagtcgatcaagaagggcgtcgtcggaaaaatgagacgatggaatcggtacatgtgtaattagtggtacttatggatatctttttcttctaaatttagtaaacttgagttgttctcaaattcaatagacagtattatatgaatcatctatctgatccctgccttcccagcctcctcttcccctcgtctcctggtgtcgatcatttctttccagatcataacgttagcacatactatatgctagtctatatttagtagaccaagactttgttaattttttgaaatatgaatttgaaattggtgaagctgttttaaaccgatcttatatggggcagtggttttgtcagcttatcgccaccactactccactagtcggtcaccgcgttgcctgaaacagcttacagctgtgactacacgctggtgtgaaccgttaaggatacttctttctggtgtcagcttattggtgttttcgatggggggcaaaaacgtacgctcaggaatgcaaactcttcgcttggctcctggctttacaagtgggcttcgaaacagccgcttagctgtgctccagatgccacacgacgagagaggacaagcaagggcatcgagagagatctttcgtcaagcaacgaaaccgcttccagataagaacaagctcggtgctttgtggagaaagctctgcaatcaacaaggaccacagctacagcctacacagaatgggcctgattgggtcgtgggctggcggctggcccaacgcagcctagggttttctgtcttcctgatgatgtagtatagtttaaacagatattaatgcggaagccacacggacacggtcacacaaccacacggcaaaaacgatatgcagtatatatttttttgaatcacatattacctctgtaataacgtccatgaatatgggtcggtagagttctcggcacataaaaaacatgattatactttttagttttttgtaattccaagtaaataatctttatgtatgaccataataaccatgtaaacacatgttactttggaaattaagaagcaatcaaacaagacaaaacacaaaacgaccttgctcaggaagctcactagtttatactgtcatatagttttgagatggacgaagaaatcatggcgattcacctcagtagtggtgggttattggtctctatgtggaaaaacatgtttgactttaattcgc

SEQ ID NO: 4363 - DNA, 1270 bp, Zea mays
  misc_feature (1)..(100): optimal_loci_47727_G1, chr1:279409592..279410861, Cluster 26
tgtgggagtcaatgcagggtgcgcgcgcggaggggagggaggacttacgaagaaactcacgctttaaaggtgtagtgatatatggccatgtcacgtgcaacaactataagaacctcaaattctcgatgtcacggtaattgaggagattagcgaatcagatggtatacttaccaagaatattatgtacaaagaaatgctcactttataggcgtttgccatcaaatgaacatttatgtttatgcttaccaaactatatttgttgctacaatgatatgtaatttgttaaatatttggtatcaagatttatgagttccattatcctttgcattttcttaattaatatctgaattgtgaagcataattattattcaactggttgcaaaagtatgttgagtttatccactcttgatattatcagaaatagtttaaaacatgtttcaataataatgtatctaaacagacacaaactgtaacaacgtgcactctactagttccatgtcaaagacagtggtatggtttcaatgaacattctggaaagtaagtttcacaagtgttttactgactaaaattgacttgtttggttgacatgcacaagatccagaatacttgttagctcgatcttcaatctggaattgcaggagattgcatccagtaatgtatcttgctgctctggcttacatatcttgaagatgctggaagaagacaatggaatgcgactactttcctgcaattacccttatctcatatttgtcagatgtttaaaaaagttgttaatgggaagaagacatggattttactttggatcaataagaaacacctgctacatataggaaacgttgttgccgttttcaggttgtgtgcagttcaagttcagactacttttcatgttatctggtagttgtttgaagggtggttgttatccctttacacgaatgacttaggctttgtctattttttaaagtaagtcattctgtacctgcagctctgtctcgtctcagaaaggtctagtttggaactatcctgaagacagatcgattattgatatgcaagtgccttttttatgagttgcgtatctatgcttgtttgtggtgactgtgtctatgaatatgtttccgtctatgtaaaccttgcacttttaatcttaactacatgcatttcttggctgcaagtctgcaactacatgtcggtttgatctgttaccacttgaagctgcgctatacctccaacaatgtgtttgctatggctttgggaaacaagaacaaattagcct

SEQ ID NO: 4364 - DNA, 1019 bp, Zea mays
  misc_feature (1)..(100): optimal_loci_48077_G1, chr1:281172468..281173486, Cluster 26
tcttcttgaatgtgctctcaaaaaattcagtgacatattgtttgagaacctcagaatttcagacaatgcaccatgatatggactatcttctccaaatctcaaacgaattgcattgccttcaggccttaatcacaaaggaagaaatagattgtcactcaacatgtcccccagagtccatagataagtcacaaggtctagatggatccaccaacgagttaattaaaaaatgttactcatcatttcccaagatttttgcaatctctaaacgcttttaactagagtgatttctgtttgcatagcattagcggatcttatataacattagtaccaaaaatagatagtctagctagtgttttagactccagacctgtttcagttttgaactcttctatcaagatcattataaagttcttagcgaaaaagcttcagagagtaatccaacaactcattcacaaaagctagtatggtttattaagagtagaaatattcaagatttttttctaaacctacagggctaaagtaaattactagaaatccattctagaccaccttgctattattttttttccaattttaaaggatatctcttgttgacttatttgggactccccttaggcctaacaaggccattaattgaaaactttcctttgtttaatcgttataagtgtatgctagttagtacttcaactttcttattgtaggaaggaaaattgtagttaacaaacttagtatctttagcgatgctaacattttcatgtgcaccttccacaaccattgtaccgtaatacaagttgaaaatatataaaatattatttatggtgtagatcataaaaaacaacctagacaatggtttgtgatctaaaggatgaaggagagatttgggagtccccaacattgaaactcataatgatgtaagagtttgtattaaaattttcaacagggagaacattccttgggtcaacttgttatgggagacatactactcaaatgccaaacttctgagtcataccaagcgaaga

SEQ ID NO: 4365 - DNA, 1077 bp, Zea mays
  misc_feature (1)..(100): optimal_loci_4851_G1, chr1:24738743..24739819, Cluster 26
caagagttttttttatgtacattgcagcgggtgcagagcagaagttggcgctccattcttaaatgctgacctctatttccattcttcagtaatttgaccatcagtttgcaattttttttttctgtagacagagtttgctgcatctgaaataaacagctgtgctcttttgcaggaaggaggatcttgaacttgttgattcggttttgtagttggcaaggaatgagtcaaaaagcaaatgtatatcctctcctggtatagccattatcaggccctgtcccttctggtaaggcttgcaatatttcgtggattatgaacccaggtcgctttgatgatatttacttgcaattgttcataatctttatgtgggattattaatttctgattttaatactacctgaagtttcttcttggctaaagggcattgccataatgccatttcccttgtgaaacgatgggacctgttgtatggtggatttattgcttcccactatattctcacagtattgtataagaaaatttctttatataatctctttaaacatgcacaggagtaaatgtcgtattgtagctttataatcacatttgagcaaatttcatgtgttggagaatgtcatattgtagctttataaacatacttgaacaatccctttgttaagtttgtggatctcaatttgtgctaacttcccatcatggattagaaatcaaaactgaagtatgttgataaactgatcaatggattggcacctgttaaatgaactgagcaggaatgcatcgatacattcagaactgtcattttcaggtgcttggagtttacaacgaatgactatgtagaaaacaacaaatgtacatcctcctatcaaaataaaaatgtatacccgcctagtattgtgtcgactgccattctgccatctgctcccagtcattatgagacacctggtctgtcatggtaaggctgccaatctttcaaactaagatctcctctgatgatatccgcttcgaattgttaatactctacaatagtgtttggttcataaatttgtaatgccatttgattacaggggtaacagatattgctag

SEQ ID NO: 4366 - DNA, 1043 bp, Zea mays
  misc_feature (1)..(100): optimal_loci_49383_G1, chr1:286504075..286505117, Cluster 26
gatctggtgcagacagcctaagaggctccacaatgtacgtaatgggaggcaagctcaggaaccaggaagctggatggtacttgtccagtctccttcctctcctatgcctgccttggcctcccccgctcctagctgtttgaacaaataaatgtccatgtgctaactactgcagacttttttgtaggctaacaacttctgttggtaagtttatgatatctcaatatttttgttccgaaaatcgcatctaaaatgaaggaatcttattttattgcacaattcctaatttctctaaattatagatgctatgaagttttagctaatccataagagatacattcggctactcctacatctgatatattgacattgttacaagttctacaagaagggaacagcttggtgattaagcactttcttctagaacttcacacaacatgtgcggatgtgctaatagcttggccgtttgtcataattaagacctcattggtactgtccattgattgattccttatttttagcttaccataaccagatgctaatgcaaatttcactaacacttcgtgttttttcttctaatcttgtatagtgcgaaaatcagattgcttttttttgtgatacttcccatcactacattgttattttgtgcacgtattggaagcaattctaggctatgacccttgagatgtagagtcagatctcatggcttaacaatatataccagatgatcatcacaaccagttcttgaccttagacagaataaggcacaatggtgtgaattctcagtaaggatttcttttattttttctctcgttctatccaaaaaaggtgtccggtgacaatttgagattatcgtctactttgccacaaaatcttaatgctgttgtctttttttacctaggcagctgaagccgtcactgatgtgttgaccttgtcttgtgaatatttttatagtagtaatgtaggtttttcctgagatggactagaatatactattctttggcttgagctgcctgcttaccatgatgtctctttccagagttctt

SEQ ID NO: 4367 - DNA, 1020 bp, Zea mays
  misc_feature (1)..(100): optimal_loci_49835_G1, chr1:289479301..289480320, Cluster 26
gctacagagaaaaagctatcccaaataggccctttgtctgagcaagccgcttttttctccctttttttgcttgagtaaaatctggatggactgcatcaaagatttcctctcggatcttccctctcttcttcttgaccttcttacatcaagtgcgctagagtttgtacctttgtgtttttgacaaacctgaagggcatcatttctgttggaagtctcaaaatctaatatgctactctaggcaacatgatgattagcaagacaacccttttatactttatttgcatcaaattggtctagtttgctaatgacaatcggtcgttcaacttatttgattggaacatttgtagagccattttttatggttacttgtgcatcgatcttttctacaggaatagtgagaacttcattgcccctcgacacatttgcttgctctgctactgccttatccttttcttggacttgattagtggatttatctaaaaccagcttaataggtattgtctatttgtcttgttgggctcagctggccctagcaaaattggctatgagggacaaatcattgctcattgtgagctaaaccaatagatatcctccaatggtgagttctttgatgcaataaaggataaggaattcacaatccatctttacatgtgtgttgtgtttttgtttggagatagctcgatcgatttgagaaattggtcttgttaatttttgcttgtctgggagttttgggcttgttcccgagcttggaagatttgatagtgatattgaggatttcttgattactaatggacttttctagcaccacctcatgatctaagacttcctatcccttcctagattctctatgttcatagattatcaccttttccaatagtgaaatcagcttgtcccaacccaatcaagatgtctggattatttatttctagacttttagccatggaaggtgttttgttgcaaggtaaagtatgtgctctccatcatgcacaacttgcatttctaattttgcctcatttgact

SEQ ID NO: 4368 - DNA, 1099 bp, Zea mays
  misc_feature (1)..(100): optimal_loci_49914_G1, chr1:290204166..290205264, Cluster 26
accagtttttcttcactgataagaacaccacttcagacttatcatttgcatgtgcagtgtttcctaattttcccattttcagttagcgtttccctttcagcttaagattgccaaatatcgtcatcgcctacatacaggaatattcactgaagctgccgagcaagtcgtgggctccgacaatggatgagcaatgttaaaccaatgaagccacgggttaacggtctagtaggtgggcagttatgatctttgagttggttttatatggttatgggataccacagcggaaaacctctcgtatactagcaacctcgtaaaacataatcactgaaactaaactgggggggctagatgttttcacttgccatatgaaattttgttgcaaagctgcctctgccttgctgttgtgctgtccgaatcaatcttaaattattcgctaattttcctctctatctttgccctctttccagtgctggggctgccaagcatttcttattttccctttcaaataaagtgcccaggccaggatgtggttcttgatcgcttcaccctttcaaaatgcaagcggaaccttcctgcagaaatttcatgtaaagcgtcacctacgccttttccgtacagaaagctttgcgtgtcccgtcccgtctaggccagctagtagtgtgttgtgttattagtgcatgcccactcatcgcaccaatccagtatgggcgcaactcgattggtttgcctaaccttttgaagcttatgcgattgtggggtctccggtaagtgcggacaaatgcatggccgcctccggatggcgacctttgagaagaaccccacccactgatggttgttattgtctgctgatcgctaccctgactgtgagttcgtttgttttcctgttgaagtcgtttgactgcaatgcgaactctttagttcaggcaattgttcttggttctctgcacccgctgagttttggccgtatgggcgcctaagtatactacctttaaaatttctttccttcctaattaaaaaaagacagctttttttaaagcaaactacatctaaggccctaagcttgtaaatttgtattggcttgatctctaaactcttaaca

SEQ ID NO: 4369 - DNA, 1241 bp, Zea mays
  misc_feature (1)..(100): optimal_loci_50422_G1, chr1:293038936..293040176, Cluster 26
ttataatcttacatatataagtccaccccaagagagggacaacggaagttagaaatgtgataaaggacgttaagaaaatgcaatggagattgaaacaaattgaacctccatatccatgaatagtgcttcagcaacaaccaacactccaataaggtaaggattagagtatctgagtctttgtaacacgctatttaaattatcacttaaaaagttatttggtaaaaatcattatatatttatttttgtcctctgattgtattttatatcttatgcacgctttaaaaggttaactctattatttatctttgggattcatagctctcatcacgaaacaaaaatctcaaggttgctagcttgacacacacatctatgaacctcatactgctagtaagcacaagggtgttccatctctacatgaaccccatactataaattggagtgaaaacgacaaatctaaaagactcataacatgtaaattgaagatctcatacgaaaacacccaaaaactatgttggtaaaactactaagcccatcacccaatagcaaaattagcccctccgcgagtagcagatgtgagtatactttgttgcctcaactcataaataagcatattggaaaataaggtggcactaagaccacaacattgaggacatacatctaagacatgttgactcaccctagagtctatcaaatcttttaaattctggttacttagggtgtgtggatccttttgatggttgataagccttctcacttttgagtggcatacacaatctatgatgaagttggttatgaatcccataacttacgatcccatgtggtagcaccaatcttcgacgaatcatagctcgtgcacaattagctagttattatatgacctaaccgggaggctagcacctacatggtgactatcctagcacccttcttacacctacatgctctttgatggtataacatggcaaggatgtgatatatagagtgataaaaactagatggatagtgggggagtgattcaccctatatagatttctttccaagccataagatacaagagtgaagttaattagtataagaggcggcacgaacacaaatattttctctagcttgaattcttagttaaccaagtaatttgctatatctctaatttaatttcacttaagcacataaaaatgtcaacaacctagacacactagagagctaataaaaacgactagtaacaaataatggtacacaatgttaca

SEQ ID NO: 4370 - DNA, 1258 bp, Zea mays
  misc_feature (1)..(100): optimal_loci_52090_G1, chr2:2055193..2056450, Cluster 26
tatttctttatctattttaggtgctatatccatttttttgtgtatgaaggtatgattgttcatatcaagtttatcttcatgtgtgaatgctgatcagcatggactccatgtgtatcccacataaaggaatcgatcctttttgcacctgtatttttttttgggaacggagctccttttgtccccaaaatcagttggcatatatatttttataaagaaccaaggatatgtgtctacatatggcccacaacattgaagtatgaacttgcaattctggtcttcaaagctgaccagaccaatttggccttgctgccagcaaattgccaccttgctgagattccacaccagcttttgagacaggaaactaatttgtttagtaccatattttttggaggccatcacctggattagtttacgcacatgcagcatgatgagaacattcttagcatggtatattatttattaaaaactaaaaaaaggaggaaatgttagctgttctgattgtgatgttgagctgattggctgccccgtgtgatgcagtgtacagaaagaaaacttatatggataaccttgctgactcgcacattgtctgctggctttgatttggaaaacgccaagtcctgtcttggacattaagatctttgaaatgctcatcccgtctatatattacaccaaataatcgtatcaacacaaaccatatttttttcagttgtagacagcagacatgagacatgcccttatggtacctttttatgatgcagctatgcataaacagaatcctaatatcgttagacttgcaccacctgttttaagaaaatgataaagtcaaggctgtagcaattttattttctgttcctctgccgaatcatcagcatctattgaattgtatatgcaattgtaatcccatttcccttcacagaatgttagcacacccacttattccattccccccaagtgctacagcatgttgctaaaccaaatggtggaaaccgttgctgccataacccctgtcagcttttgtgtaaacttcatatgtaaacttgtgttacttgttaggttgccctagttcaaagctacacatctcagacttcaggtgcaccctcccccagctccccctcactgtaaagcaatgtttggttggtgggatgatccctccttttggtgctgtttggtctgtctacgtcaaacggggccttgattccaggcttacactctttcttaaagacttgttcgtcctcattatccatgtgcttgtgtgcag

SEQ ID NO: 4371 - DNA, 1334 bp, Zea mays
  misc_feature (1)..(100): optimal_loci_52826_G1, chr2:5576158..5577491, Cluster 26
ttatgcttgcacacaccccatcagtcgaaatcctgttgtttttctttcccccgtggggtagccggctaattctccgctggacagtagtacagtacagtacagtgacagaggaaggcgggcgggcgggcgggcgagacatcaggcatgcatgcatgactgcaccagacatggacgccgctgcctcctgcgtaaaaaggctgcgtaccgtggacggacagataaggttgagggggggccattttggcgtctcgtcgttggacagtttctagtcgactcattgactattgcgtattttatcatagtaatacctggcaaggttataaaggcagcactcattaggctctcgtagcctgagccggagccacagttcacgcttcaaaccgtacccttgtcgacagggagagaagaaaaaaaaatcgcactgtagcactttcaaaggaaaactctaggacagcagtactggtatttaatatactttaataaatattattagattcctcgtcaaagaactttttacaatatatctatttagaatcatatatgtcatagttttttttctaagagtctagtttactagtaaaatccgactcacatttttcgaacttgggatgcaacacttaaatagtacaaaaccttggtatgcagtattttacattgtaagattcaaaatttctaaagcagtatatatatgtttccagaaacttatagatatagaaaaaacagagagacgtatgcgaaaattcgataaaggtgtacattggattcgcaaggctaaatacatatttatcgtggatccatgcagagtttgggtaataaaattagatacttccaatcatgtgccacataatcacgtaacattagtaatttaaatgacattaccatgtccaactgatttaaaacacaaactcttcttgaaccatatagtttgacaaaccaaatatatataactggagctactagttatgaatcaattaaaaattactttgaagattcaacgtagtgccagtttggctctagcacatctaaccagaagggctaaggctggcttcaacaggaacagccaaatccgagatcgagccatttgccatttttgggtagttagtttaactttcatatatcttcccatccttttttgcctagcctaaatggctttgatgttgaagaccatattaatttgcttcagtggcactaggacaaccatattggctttggctgacccgttagagttagcctaatgggtggaaggggagggaaggggaggatcgatggtggcatgagagaggggttgacgatcacgatgatgatgcgagtgaggaggagagggtggcgacgac

SEQ ID NO: 4372 - DNA, 1359 bp, Zea mays
  misc_feature (1)..(100): optimal_loci_54320_G1, chr2:13589934..13591292, Cluster 26
catccggtgcgtccgcgtacgtgtctcggtcgaaaggagatgttgaaagggttctcggctggattagaggtcccaggaatcaggccttgccaggaacctctctcgttgcttaacaaggcagcaaagccggttgaattatttctgggtcctacgaaatttggcttgaatcaattggcaatcatcatcataatagtctctactctcttgtatatattattatcgggggattttttagaacacacgcacacaaaacatatattaacggagtcttttagaacacatgcacacactcacataaataaataaaaaactcagcaaacatgcgcaattcgcattacaacagtagcagacaatggaaagacgttacgttggcttccggtttctgcatttaccatgttcctactttggagaaggcagtggatcttggcccaggtcaccatcaagttccttcattctggaacctgccacagtgcaacaagcaagactccaattcgatgctactattagatagtacagtacatgagcactaggtgaagacaccgaaactgacgtggccagcttggtttggtagagaagaaagcagatgctgctacctgcaagtgctaccctatagctgctactctgctctgctaccggtgcacaaaaatggcgctaatcttttcgacgaagcgcgacaaaaccattcagagatgctgcgttgttcaagagaaggcaaccttttggtgtagggccgaaatttagagcggaagaataaacgtcaccagaagtgggttaactgaactgatctaaaatttcacataacaactagattctactttagcttattttagtctttatttatgcctaacagtgttttctatccttgaataaaaagttttacaatccttgtataaaaagttttacaatcctaaaagttttatttatgcctaacatctttgaactataaaagagggacggtagcgcctattaagagcataaacggacaatagttaatagacaccgtaacacacatgacatatggtattacctcatattgaaaagcataattttgtctaaatctcgcagtcctttgtgcatttaccttcaactcctcatctctcgatccaccctagaaattcactgtcgaatattcctcaataacctagtacaagcacgaggtaatttagagaggttcaaactgtagtatgcataatacgttcccatgtaagcgatggtaacataaacgatagacgaacgatgtgtttaaatgaaattaaacggtctagatgtgtcggtctaaggaaagcgaaggataccaaaacacaaaggttccatagactgtgtcgacggctctaggaaatgtgacctgtttgggtcgtc

SEQ ID NO: 4373 - DNA, 1201 bp, Zea mays
  misc_feature (1)..(100): optimal_loci_54742_G1, chr2:15874928..15876128, Cluster 26
atcatggatggatatatggatggtaatggttcatgatttaattgtttatttaattaattttagtttgataatgaatggagtcttagcttaatataatctcatcattaaattttatagtgtaaaatccacacctagatggatgacgttttttggggtgttaaccagtgaacagcaatggtcatatatgatatcaaatatttaaaacaggaaaaataagaacaatcaggtaaaaacatggcgaaaattgaataacgagtatatctggcaatatgtgggttcttgtttttagctcaaacactccaaccagaaataatcattttattttaagacagcttaattatttaatcaagtgaaatggtgtgggagaccttacttttgttcatttgtttcccaaaaacgtacattacatttttcaacttttaagttacctttcagactaattttcaacatttatttctaaataagtaaataacaaggaatccaactttattctaagtctaactatataagttttaaagaaaaaaattacagaagagtattaacacatcacatcaaaaatgtaaaaatacttttgcattctcaatgacaccaatttgatgtcgcatgtgttatctaccttttctataattttggtaaatgttaacatagtttgacttgcaacagacttgaatctcttgtatattcatcacttaactcgtagataacgtcttaattttaggaacaaaatgtcactaatttttcattttctgatttacaataaattaattatattttagaataaaccgtaattttattagaactagaaacttaaaattaatttaaaaaccagagaaaaaactagaagcattagacattatctagtttcaatattttttatgtagagaaaaggccgatcatcatgttaaagacaacaacactaccttgcaagaggataggtcggatgttggcaacagttctcagttcgcgttaagccaacattgttttataaggttgagggtgaaaccacaatgtgaaaagattattggaaatagtataacattgtgtgttgtcgaggagcggtagtggattatacggttaataatgcaacccatacgaattcatctgtattgagataaataatatagtatccaaataaagtctaatgaggttggttttttggagtattaatctaacagacctaaaaacccctactatgcgttca

SEQ ID NO: 4374 - DNA, 1113 bp, Zea mays
  misc_feature (1)..(100): optimal_loci_55154_G1, chr2:18077044..18078156, Cluster 26
catctatgcattacctcacatgtcacatgcttaaggggctgtaacacttgtaattgtacctttaaacattagaatagctgttgctttccatcgaatgatcgttaaaaatggtgcgatcgcgaacaaccggctcgttcattccattaatgccgctggccgcaccgttttgtccgatgagaaagaggcctgcaccacgtgctgctcctgcttcaacggctactgcctactggttcgcggaaagctggtgcagtggagaggatggtgctgatcctttgtacaagtactagtatttccattagtactcgacgatgaaatgatggattgtgcaccgtgatgggccgatcaccaatcagtgcctcattcatggtcatgtgtatcataatttgttgcttaatatagttcgttggtttgcctggcagcacatatctagccatagtcttaggttgtctaaaaaaggagactctatatggtcttctaacttaaatataaagaagattgtcttacgtataacctttaacaatgtcctctaaagcatcctctataactctaagtatagaaaacactcactttatttttatttatcaattttcatactataaacaacagaaaactaaaacatatataaggcatttaatgatatgacaaacacgaacataacaaaatttgaagcaaaatacatctctggtataagtctttgatatatagaggatgttgttggatagaaatgatacgtagaagacgaaatcttttaaaataatctctaaatgatataatagatgatggatatagagattacgattggataaagcgatgaagaaattaagaggagataaaagatgtgtttcatccccataagtgagaaaataataacattattatgtactgtttggtagagtttcaactaaaacagttttagttatgactttttaaaaacattttttgtttagcttttgtggttagaaaaacgatgtgaaacaaacccttctaattattcgaaaggtgaaatatcctttatttttctttccctcgttttcttcattcattttttgctggctcttgtttgtacttttccttctctatccaccttaccacatctcccacgtggccacactt

SEQ ID NO: 4375 - DNA, 1372 bp, Zea mays
  misc_feature (1)..(100): optimal_loci_55912_G1, chr2:22038003..22039374, Cluster 26
gtctcagggagttccctgattgctggcaccgtggcacgacctgacaggacagcaccaaatggattatggacgaacgtgtgggcgctacgtcgcgggccacttgctagcggctcgcacaggcacagccaagagccaacaaagtggcgataaggcaaatagggttcaatcagtctgccatgaatcgacagattctgaagatttgagaggctttgattatgggtaacgggtagcccggtctcgatgagctttagttttgatactctagtattaagcttaatctatatatgttgaggtaaattggagtgtaatttagtttaatttacatcaaatccatcttattggattgaactcaatattaggtacctaaacaaagcttgaggtgtaccgtgtaccagcagtggaagacgattatctaggtgagacccaattaacagtgaaagactgcatggtccgtggacaaaaaaaaaaccgatggcgcggtgactaaaagaaagcacgggatcaaaaggacaagcggctggcctgcctgccgtcgactcgcgccagggcgccccgtctcatggatcacagagccaaaaggccaagtgcccgtgagggggaaattttctttcaccaggggatttgagatgattatataaaaaaatagtttattttctcttaatctcttccaatatccccgtgatcatcttgtccataaatcaaccctcagggaggaaaagaggcgaggccgtagacgagagccgtgattagtgacacgaatgttacctgattcggtcaggcaattgagtttgagctgtacgccacctcgcgttttgggtgacagtgtaatttatatttttcatttgccctttttatagcggtgttgatggcgatctcgcaaagcgagatcgtacgttaactccttgacacccacatttaaatgggttaaaaacataaaattatgtataatgggattcaagccatggttgttggcttgaaacatacgttcatttccatctagctaacagaacatatgcatctttgtgttttaatattctataatcaagtataaataaaaaccgtaacaaccttgtgtgcactttgcttgtgtttcatttatcccttttccaccttaacattggattgctcgtgaacttactggatttagagtactcgtacacaagatacgttcccttctataatggttagaaattagaattactactaaagttcagtagttaacaagtactagtaaaaggtggagcaagccgtacgcagttttgaggccaaaagagaggcgcagcacggagttccaaaaatacctacctcgccgtcggcgcggtcctcttcattgatggtgtttaccgagacaccacaagtgagtgagctgagg

SEQ ID NO: 4376 - DNA, 1112 bp, Zea mays
  misc_feature (1)..(100): optimal_loci_56114_G1, chr2:23312326..23313437, Cluster 26
ggataacatgagtttgcaaaagaacttattaacatacatccttactttcaatattttggcatcaagtttaatggagctatttagagctaatactaagattgcatctatccggtagcaaacacttgattaacatgaataaagataacaattgtaaccatatcaagattaagatagtcaaataaccatcaagttccattagttaccaattttctcactattcaggagagacattggtttgagctgattgtaaccaactagttagaaatccatatcacacacccgtacttcatccatcgaggacgtgttgggtaaccttttaccctattaagcttccgtgggattgaactagatgcaccacctaagcgacaaccagaaagccaagacgctcagatcatgtctccccatgatcaatccaccccaatgatgtctattcctagtttaagattcaccctgactcgaggttagattcataagttatccaaccattatgtgaaaggcgtgttcaatctcataccaaggttgagaatggtattatccttaactgatacatgcgagatgaaaagacacatgccacacctacctaacaataatagtaacattagatctcatacgatctctagtaattcattaccacacgattcctgataacaattatagccaaccatgttagagtagtataagtagccaccctatatctcacaggctacaaaaatcatctgacttctaccagtctaactagggctaagcaaagaatgacctacaatactagtaagagtgtaggtatgcatattatgggcaaggttaagtgatgcagatatcaatttcaaatcaactcctacaacttaatgtgtagcaaaaaatatacttgagtgcatttttaaaagcgaggtaggatgcttagattgcttgaggcttacctaggtttgaagcacaatgtgagttagttagcttctctctaacttggatagcatctctagtccttgtgtccactctagtcaatccttccatcttgtggatccatccaccaatacaccaccttttggatcaacttcgacatcatgttctccattcctcctcatcatacatgaagcgtacatagttgaggtacaata

SEQ ID NO: 4377 - DNA, 1098 bp, Zea mays
  misc_feature (1)..(100): optimal_loci_57316_G1, chr2:30127610..30128707, Cluster 26
ggtatgacataattggtagacggtgtatccttttgtacctgatgatacttcatggtactcttttgtgcacatgcatggctatagggttgatacacataccaaatagtgtctttaggtaccctacaacctaagacatggcaacatcatgcatggaccgtattaaatatgttgtactcaagaaatatgataagctaatgctatgaactcatcaacatgcctttgttgtgggccctgacctcgaggtcataaaacccttggtgggcctaggcacatccttgtgtcttatgacatgattgtacttagttgtatgaagtcctttgttccaatagggacttcgagacccatatggtttagagccctaccattctcataatgcaaggttagggacccaagggccatgagagggcactaagcatctaaacgttgttaaatgctctgatggatggactaccttgagcatcgattacttcatgagcatcctagggcatgaggggccccagacttagattcatgagcatcctacgacacaaggggtctcaaggataaattattgtagctatgaatgatttggagcattagggctcgaaccttgaagtgccttgagcctagtgggtctcgagtctctagtggcttcttactagatttcatggtgtagttcggggtgctttgatatcaaattagtcgatgtcaagccatctatctggtcggtatcaagggaggtccttagggcattatacctcggaagcagtggccctagtagatgggttttgcgataacttcttatatcgagattcttaaatgtgtcttcgtagtagctatgagtatgacattccccatatgatgatgttatctctttctttacatgttcatgtaattttattgttgtatccaaaagccaatgaaaatttttctacatttagagttcctatagaccacgaattttatgcaagtccaatgctatattttttctaattcatgtattacgagaattctatgtttctaagaggaccttattttctgagcgtacttatgatttatttagcaagggcccatcatttttagaaaatgttgggctatggagtcatttgaaaaaatgct

SEQ ID NO: 4378 - DNA, 1167 bp, Zea mays
  misc_feature (1)..(100): optimal_loci_57327_G1, chr2:30280500..30281666, Cluster 26
taacctatcgaccatgacgctgacctccagactcaaatatggattagttcctccaaaattctaaatatgaaaatatagaaaattgggaaaccccttccccaggacgccgaacttgctcggctatcccctatcttatccactatttaaactatattctacaaactgtgtcaaacactattatttatagtaccgtgtcttccattttacattgatccacattgatccactgaaaccattcttaagaccttattgggttatcccaatttcacgttgattgaaatatattatcatatattaggatgaattttaacttgttgtagatttaaaccaattcaatatcatataattcatatagattaactgtaaaacgaaccagccctaattgagcggtgacgagtagcgctccggccgtgcctcccggaggctgcgagagttagttgaagcgttacggtcgccgtgacccagccgaggcatggacgacgagcccatcatgtaacaggggtgactggggcaacgatgcccggcacacacggttccatacaaagattattagtgcgtacggctccggcccatgtcacagggatatatatctcgttcatgccacagggatttatgatagttctgtctcgctccatggaatctaatgatgcgaattgagaatcatgagcacaggacattatatttaagctaaaaagatgcagcttttctcataaaatattcctagtggctctgaaaacatgtagggagcacccgtcctcgttttcgaagagctcccaaagcatgcatgccctggaatctaatccacgccagtgttttgatttgacctagaaaggagcgcccatctgctagtacgtacgtgaagtgatcaggaggctatcacgtcactggggacgcgaaaccattgattgaacaaacggaacaactgggtccgttgcacagcaaatgtcattgcatcactaatcatttgcatgggaatgatgccccctgctatgcacaaggctagcaccactatcaattcatctcacaaaaatgctgtcggttagctcctgcctcttgtttagtagccaaacgtaaaagaggtgaaggatgcaaaaatgagactcactagcgtcaagactaactaaattagatcttcagctgattagtttgaccttgttcggttacaca

SEQ ID NO: 4379 - DNA, 1396 bp, Zea mays
  misc_feature (1)..(100): optimal_loci_57940_G1, chr2:33843760..33845155, Cluster 26
gggccataatccgcccgagactcttcatgtgtgttaatcaacaacttagctttgcaggtagcctatttgtctgcctctaaaaatattaactagatatcctagtcgcctgcaaaagtaacaactattcatccttgattgctttgtcggtgtaggggttcctaacgtgggtcctcatcgatctctgtactggtcaaagttgtgctacttatgtggtggatcattcgtagagttcatgcgttctatatggtcccatccatgtatagtgttatggtgcatgacacaccaatctttctcaagtacctctttctccgattgaacctgaagttctcatatgaataactcatgtcatggtgcctcacacgctaaccttcatgtgcatctttctcctattgaacctaaaattttcatattaatagctccaattgtccacatgttttattcagttgtaacaaataaggaaatagttatcttacttatgtcatgtctagctcgtggagtagtccattgatgagtttgtttgtaacctttcaaactgcctacacaccctacaaggcaagtgaacctccaccatgtgaaagaatataagtggcacatctacatgccatatgtaaatattatgttcattcatatctttcagactgtaaggttctagctctggtcgtgcccaaggtaccaagtaaccaaccagtggaaacattgttagattttcagtgaaacaaacatgtcaactatgatgttaagcgtaacttggtgttgtgtcaggacattgaggaggtctatgtactgcctgtaacatcattgcggcttgcctctcacattttaccatcttctagaggtacaagcacactgaacatgtcccatcttggtgattctaggaatgcaagtaaaaaacataccaagttaatatatattaaccaaatgatgcaagtgattagaattaattatcattatgaattacttacactcaaaccacaaagattaggccttttgaagggccaatgctcctagcaccacacttgaaccacgtaagaacaaccaactaggttggcattatggttggtgtttgttgtgtctcgatgactgactatgtagagctatgagtaaatccatgctaggatcacgcttacccaactatattgatctatgttctcccactcctaattaaggattcataacactcccctactgatcatatcgctagaagcgtcagcgaacaggaaaacaaccataaagtattagagccacactctagtgtgtctcttgacctcaaccttggtagctccttgcacacaaatagcaaattggtgagaaaaatactactttacaactatagaacatattatatgtacatcttacttacttggatctatcaacgccgacatctttgggtggccta

SEQ ID NO: 4380 - DNA, 1402 bp, Zea mays
  misc_feature (1)..(100): optimal_loci_59288_G1, chr2:41895967..41897368, Cluster 26
cccacagccttacaccatccaaatgccaccgcagcactgggtatagagggggaacaaaaatgcaattgactccctgttcatatatagccccagatgcgggtcaaaccacgatccacaagatctgtggggatgcagacatcacaccagggagggagcattgaccgccaatctgctgaccagcaccacaagatcggctagagaaagttgacctcttcagagagagagagaagctctgacaactaactaaccaaaccactgtccggtggtcaaaccagataaagaattcaagtagcagacatatttctgccgtgcggcgttgaagtcgtcgacgacgcggtggctggctgatggctgcattgcagcaggagtacaaaaacccgcatgtcatgcgttatctcagcacactacgtgtttgcaaataatgcagaaacctgagccgcagaagagaagagaagagaatgaggaacacgacgacagtcaggtgcgaggaaatcccaactacttgagatctgcagcggtcaccgctactgtcacgcgagaaaaaaaaattcctcacgctgttgcgcaaagaaagcagcagctactgataaaaaaaggagcttattagctcaaatcagcatcagtgactgaaagcgaaggtctctgttttaggtcagtctaacacaatcacagaaactaactaactttacgggaactaaagtgttcgtagaaactagaaagccgcgtgttctagagctcataaaattgattgtgattttttcgtctgatcatataatatgttgaacaaatgccaggcgaataatcgtgtcatcgccgagtaatggaggtggtccaactatgaagtaccacccaatatgattttgatgtgggctactatagtagtttcggaatcatcaggctccactccagccaatgtgttaacacaataatgatacgtttgtcggtttgtccatcagaaagcaccatcatcaatacggtaacgctagaaagcaaacacaatactgactctcaaggaagaaactgatatatatacacgcagctggtgcatggctcgcattacattaactcagtagctggcaattttaggattatgatttttttcatgactccaaatacccaccatgccgacatcaactactctgcaaagttcttaataatgtctgcatgcctcgtcatcagaaagtagctggatgaaagaaaacaccgatacccacacagtcccctctgcccccacgatagaattcctttcagtgttatatccatatattcaaacaaatgacgatgaacctaaacacgtgcattaattactgtataaatctaataaaaatactaaaactgatttttttaaaaaaaattggaacagaggggagtatggtattttatttcccgtgtgttggacaaa

SEQ ID NO: 4381 - DNA, 1070 bp, Zea mays
  misc_feature (1)..(100): optimal_loci_60846_G1, chr2:51236505..51237574, Cluster 26
atcaaagattgggaagcatgtgtcgtggttatgcctcaatggctccatgtagttgtcttggttttgatagaggtttcctttatccaaaagacaaatctttaagatgctaagaagttggaaaaaagagaatgaaaggatatgaagagaaaaaaaaaggttataagcctagcccaacattgtccctctatctgggcccagtttaaagaacggaactaccaaactgtcacaagaaaagtgttcgtaaccttatgttcctagcatagaaaaagatgtttattctttctttatgtagagagggaaaaagaccaaaaggagaaaagttgtgtattagggtagtcccaactccaaaacctaagtagctgctatattatcaagattgtcatatattttctattacatctgtctaggattaatcagaataggtttcctaaaaaactatagattctgctagttcaatttagagtcacctcctatcttagattttctaaattctagtcatccttattacaaagctatcatggtctcgcagaatctatagttgagagttgtttaaaccaaatatattttagttttttcacaatcatcaacacgtagtagcttttttcacaacttatagttagaattatatttttagaaaattgaaccaaatagatcctcgattaaatctgactaactttagatatgataaattatgacaagttaggcattcatccaaacgcttcttaaatttcgtcatctcttctatccccggcactttctctcttcctcgatttcttgtctccgtatataatttgcagcgatgctggcaataggtgtggccttgtgatggggcaggcacctgagtctctgggagcagagcgtggagggctggagcccggaggtgcatgacgggccaactgcgggtggcgggtcggatgggctgggcgcgactggccagggcccagggcgcgcgcacgatgacacggtctgacgaagtgacgagggaccaacgaaagatatatggccctgcaaaatgtgttggaagaaatcatatgtgccccccaacgcgaaatgtggactactgacactac

SEQ ID NO: 4382 - DNA, 1195 bp, Zea mays
  misc_feature (1)..(100): optimal_loci_64722_G1, chr2:73292518..73293712, Cluster 26
gtacatgatcatgttgggacgagggcattatcctgatgacagataggatccacatgtagagtatatatgtaagcttaaccactcctttgaattataaaagggaggggtggagcaacatttaagggtattccatttgaacttctaccataccatccaacactagctaaaggtgatcaatttgatctaggcaagtggcaatagttggctgtagtccagtataccataacatactttatatatatctaggaggtcctagcactctctggttagattgcttgtagtctctctatcatgtgtatacaccaatcgataatcaactgaagaagacgtagggtattacacacaatttgagccggacatatacaaaaaaattgatgtgttttaggtataaatttcataactctatagattcgttctctgcttcccttgctatcttttttctcgtgctctggtaccaagtgtctttactatgacacatgaatagaacatagaactcatttaactaaaacatgtttatgttttagagacccaaacaacaacctcaaacggctaaacaaaccatttatataccaaagctgcaagccatatagaggaaaagctatattatttgatgtgagcctgaacatgtttttttaaagcaaatatatatagtttgcgatttacatgtttcataagtcaacgaacgaacaagcagcgactagtgggttacgaaatgtttggtgataactgatacccagatgatgatcctacgcagctagcatgatattgacgcttggttgacgccgacataaatcatcgacctctacttggttccaagtgccaacacattctacatgtctacgctgcgtagaaccaacctgagaatttcccttttcgccgccaagagaagaaatagaggtggacttgctttgtcgtaacacgtcctccctccgtccaaaagaaatgtaattcaaattaagttttcatgaattttccatgtataaatacaataccatcagcaatttttaaaaacaaaaaaatatttcataattaatctagcaatatttattcgacaatataaatattagtatttgctagcttgtatagattttatcagattttttttgttggttacggggggagagggttcccttcctgaaaattctattaggacccgttcgattgacagggaatagaagaccggaattgttccggt

SEQ ID NO: 4383 - DNA, 1228 bp, Zea mays
  misc_feature (1)..(100): optimal_loci_6937_G1, chr1:35883578..35884805, Cluster 26
atggcttgttaccctgcgtcagaaatcttgttgattggtaagcacgaggggtgattgagggctggtcccgtcttcgctccaatactcataaagacaataattcaactcaccaccgggtatcttttagcaaacttttcagaaatgttttaaattttcctgacactcaccaaatgtatctcaccgtttgagatcacgagtagatgcggaccactcaaatcatcacaaagatttcattgaccttattgatatgatcttgacatctagagtggagtgaatagtttgtaaaaaatccttctaagaccacaaaatattggagcacattttgattggtataatgatgacgctaatgcaacttcaccatctttttagggtgtaagttttttgattattcgttaaagcgcttgaataaagttgtgtttgcaattagaatttaattgatatttttgaaaaaaaataaattcaccctcttttttatcacaatgatcctttgatgacatcgatggttggttcacttgaccgaagcagtttcaaggaggtcgtggcaacacaagcacaagtgggtgttctatgtggttttcatttgaatttttttgatgaaagacattgtttgaacatgcaatgtatgttgtcaaacatccctaaaaataaaatatgtctagtgccactgtaaaatcgtgtctatttgctggaacacatcatatcaattattttattatttttcagaatttatgaaagaaatatggaaaacatccaaactacccttgtcctcaaacttaacattggctcttcactgattgtttggcgtcatcccatcccatcacacaccatgatcgctgattcatcgttgtccttctctaataaacaacgtgagcggtggcgcgactctctccaggcttgcacggcagcacgggcgacggtatggccctcttagcttcacacaaggcgacacccttgctcctcaaccatgatgagatctaggataactttgccgcataggagctctgtgaaagagcatgcatgcgtctgtgaagctggcgttgtagggctgaaactcccgtagtgtgtgcactgatatgatagctccggtggactcaaggagctagatagtggtacgacatcaatggtgcttcagcctgccaacgatgctatgcaggactagatagagggttacggtttagggtttagggccatagtatttgactatttgtgtgtcctgagagtacaggct

SEQ ID NO: 4384 - DNA, 1084 bp, Zea mays
  misc_feature (1)..(100): optimal_loci_72781_G1, chr2:128186857..128187940, Cluster 26
ttaactaggctattatgattttcatgccacttttgatagatttcaatcagcttcaaggttaagaataacctagctgttagtgtcatttgtcattgagagactcttagagtagatttggttcttggttttttctttggctagactataacagagagtatgaatgagtaccttgacctccctagttgatgggcatgatgtagacttgtgaaaaaccataacaataggtagctcaaatgaagcccaagaatgaatgaaacccaaagccatactcagagtgtttgaattgtaagagtttggacacattttatgggcaccttaattctaatgtgttagagtaggagaaagcactagagttatccaataatgcaagctagggattgctttgacaaccacattgtgtacttctagtgctcattagattaaacacaccaaactttaaaatagagatggtgcacatgcgttttagaagtgtataaggcaccataattctccgatgcttactatagaaaacatatcgaagaatttaaatagagggtgcaaagtaattttagaggcgttgaacataagaaaattctataatggtcattggagaggtgcaccagagttccaaaatagagagcatgtttttggtcacctttgctcagtactcactggatctctctggtgcatcaagggagaaaatgtatcaaataattcataagacaatgactagttgaagggcataaaaatctctagtgttctaagaaaaacaccaaaggtcactggtgcattaattctgagtgtgtttccaatggttagtttgaacggttggcatatatatctccatccatccatgcatttgagctttattactagccagaaatagctaactatgagagtgatttggcttactaggaatgattggcctataagagtgatatagaaattttaattcaagaccaaggactccattagtacttagagagtagcaagtttgcatccactattcttatttagcttggttagattatttggtgttgttatggatcttagtgatctattggtgacaattatgagaagtcaactttgtctatacagttttgct

SEQ ID NO: 4385 - DNA, 1282 bp, Zea mays
  misc_feature (1)..(100): optimal_loci_7483_G1, chr1:39116077..39117358, Cluster 26
aagcgaacaatgctgtttcacgaggaaaggcgagaagaccttttggtgtgtttatttgcatacatctccatcccgtatgctgctaacaaggactgcaagctttaaacagcgacttgctaactgcaacagatgcctatgctgtcgctgggtcggattctattacggaccgtacctgatgcaaacgcgcggtggatactggatgcagtaccgattggtgattgactgattggtatcattcaattgcttcgccgatagatccgaggcttgcgtcctcttaaccctgcagcatttagtgagccacgtgactaaataaagaacaaagctttataacggcagggcattttaaggccagtcgagatttatcagctggtgacggttcttcatctgtcggtgggagctgtcggctgatgcttgatgctggcgatgtgtgtacacgatggacctgtcaaactgttaactactgtacgctcctatttaggcgattgacacatgatgttctcttccgtcgcttctttttgagtcaagcaactccagttaggatgttctttcttttttatatatataaaaaataggatgctctttcatttcaaggaattactaggtgctagaaaagaaataatagttctccaaaactgtattttactgattgttgcacagtatgcccataacttacatgaacaccatgcaagtaaaaatagatcccaagctggtgcatggcccacttcctttgagaagacggtcgatctcatctgttcgttccactgtttgccacttcgccttcaatctcttcatcaggctacagttagaatgatgtattaatgtgtggatctagaggctgcaccggcagttggctggctcacctatctatcatggtggctgaatgctgatcgctatcaacgagtgggttaagtcgtactgcatccatcattccgtccggagacaataaacatattttcatccgtggaagtgaatatttacaaattttatcaacaactagtcaaattatattggttatacgggtcatagatgcatgatgtttttttaactatttaagaattattaaatcatatacaaatacatttgttctaagtgcctttataagatgatatttttcacgttcacggttgaaaaagtgtgacgtaaagaagtggccaagcatcacatattgtattgtgattgttttggttagcagtggcacaaccggaagtagaacagtctagcctatttattttcttagaatcgtcgctatttattagttcaagatagaattatactaccttcg

SEQ ID NO: 4386 - DNA, 1033 bp, Zea mays
  misc_feature (1)..(100): optimal_loci_75406_G1, chr2:143524092..143525124, Cluster 26
tgaaagggacatgttttctgcttccctctttcctaatcgaaaaaaatgttctatacgtctggtggtttcgtggtgaattgcagaattggtgaccactgaaagaggatcattgtaggataacacttacaggataaattttatctcctccgatcctttttgcacatgtgatgtgtggaatcgcacagcatagtatagagttgttgtatgttttcgttgatgtaagtatacaccagtttattagtgcttttcaaaaagaaagtaatatgacctagggttaacttccatttttctggaacacaggttcagagaagacttttaggaacccactataaagtttctgatttgcacttttgaagaatcacccaattaagacataaacgttgctttcaattgctgtttaattatttatgcgtgtgaagatgttggaccatacacaggttatttaaccaacacatcagtgaatagacttaaaggactcaagattttaataatatgctagctcaagcgatttggatagggatactatcggattcgtgtaggattaggttatgtatgacaagccatggatgttgactcattaacaggggacagtagtgagagaccaaattaagattaggaaccaaaatgctatactggtgttgccgcctgtccagttggtctggtcattacttcagtttcttgctgcacgtataattgggcgattgaaatgagcattctagaatacactgaatctactacactgtcacatcaaacaagaagagctagtttcagcgtgtgggcaagagcaactcagaatagaaacagctactcaagactcaagactgtctgactgcccgtcctccaactctccaaggctccaagctatcggctagccctttgttgccacataactctcaataattccggtttctcttctttggctccacttctcttcctttatttgcatttggattttttggatagcagttcatggccagcagatttgatgatgttcttctgttttggatgaagccaaataggtcgctagctaatt

SEQ ID NO: 4387 - DNA, 1120 bp, Zea mays
  misc_feature (1)..(100): optimal_loci_77617_G1, chr2:157288373..157289492, Cluster 26
agcatagaatcggactttattattatttatttttacaataaattaaataaggaccctaactcaatatgaatcagattttctggaagcaaagtttatctcgcacaacaaagctccaccggaggtacaattttgactggttggttggaaaataaaaaaaaaatacaatgcaaagtcaatctctcccgacaaagaaaattgttgaagatgctacttgtaactgctgtcaggtgaagcttcaaataacggcacataccctctttcgccgtgagtttgcaaggcagttctaggagtggcttgggatagacgtcctcgaggtcggcaaagtgctcctgagcaaaacctcctgtgtcctcaggacatctcagagctacactccaacgcttttgtgttattgtgctgttgggaaatatggaattgaagaaacaaagttgtttttgatggtgttaggctcggcttgagggattttatagccagtatcagggctaaagaaatgttgtggagccaccgctgaaaaacaacataccgctgggtgattgataaatggtgttccaagcttagaatggtagcggatacctatgttcctcccctgtaacatctctcttgtaaaataatctagggcccttttctgggtagcctgaaaaccttcaatatattcgggtcggggactctcttccccattgaccattaaaaaaagaaatatttagatcatgacctattaccaccctactcgggtgggaaagttaaggaggatttgttaagattttccaggttgttgacctagatgggcaagtttgacattgtttgtgcaagcttctaagcaaggagagctagctaagaaacctagcaacccctatgtttaatgacaatttgaatttttatcaatcctgtgttctagcaggatttcatccaaattattttaggaaagtttagagattaggtttaagcactagcccatgctgccctcataaaaagtcatggtaagattattacaacacacaatcatcaaaaccaatcaactaatatgtttttaccttacattatttttaaaaagtcagctgttggttctaatggacccatgcggtgtgtttgttgttagagtattttttacatcgatattttt

SEQ ID NO: 4388 - DNA, 1040 bp, Zea mays
  misc_feature (1)..(100): optimal_loci_79832_G1, chr2:170228185..170229224, Cluster 26
catgtcaatgtgaggcggtattgtacgtcaatgtcaggctatccacgtaaacatagacgatactgtagagaagagatgtgttaggtatatacatagagatatatgtgtacctgccaatagatagggtttagacaaatctatatttctccgtattcaaatttatttcaatctttcatcctctagtcttgtctatgcccactggaaaggaataaattttattcaaactcgatgctttgacttaaactgctaccttctattactattttaccctaaaataaaaatattgctttcacatcttagtaaatttaattgaaacttgctaagaatgattcattataacagtgcgcaactatatgcagattaacaagactttgtctatacatagaacttacattaaatcttagaactaaagccttatattcacacttaaaagtttaagcaaaactaatcaaaattacttaaaaatttgagcaaaactaatcaattttttagatgacttaatatgacaacagactagttcatgcagattataacaggtaggttcaattgtgaaatccacatctacaatttaaaatcttatgttcatattataaaatttccaatttattcacaaaatgatggttataacgtctatttcgtgcagactgtgcacctcagatttaaatgtatgtctctggtcaaaagatggacactaagagcatgtttggcatagctccagagctaaactctaaagaaagctagataaaatcttatcaaacagtttaactctagagttgttaacttcatggagtcttttaagttgtattacaaaaaatttggagtatcgcttttgctattatgaaatccctcaaaaccaattatatggagttgtgaataatttacccaccactaacattggttatgagaatagtgtttccctttacttccttccacaccagaacttttcttccctacaccttagttgtcgataggagtagaaaataaggcgacatcgaggaggtcgtcgactcagacgtggagggcatcgttctccatatcag

SEQ ID NO: 4389 - DNA, 1105 bp, Zea mays
  misc_feature (1)..(100): optimal_loci_81035_G1, chr2:177269865..177270969, Cluster 26
gattgttgctttggttgtagttcagtgcggtttggaagaaccaataacgcgaccgattaaatcatggtaataatctacgatccagtgcatgcatggtgctggattgtagtataataggctgcactaatcattgcttagtttgtcgtcccctcaactcaacctactgtggacgatgcagtgcttacatatatagtgctggattcgccagacaggttgtattggcatgttcaggcggtacgaggtggggaagatcgatgtatgtacctttcattttgtcgatgtctcgtgactttgagtgcatgtctctaaggacaaattaaagagtcccttcaagatgattaactgcagcaagcaagctgtgaatgaactgaaaaaacatttcgagttgtttctactgccctagtatatgaaccacttccagctgtgtctgcaaattcacggtgttgttctcctcttttcctgtatatttctatcacttatcacttatcagtagtatagtagttattagcaggtgtctactgaattaaggaacaatgataatgactgacacttggtcttggtcctattgatgcaaacaattcggtcctacttcctacagtgaccgaccgtggacaatgaagcttcactcccacacccactgtcgtcgtacatacagcaactggacaagtctgcacatggcgtttcgggaaccacgagagggatcacaagaagacaatagcgagtacacgttggatccctaagaaaggaaggcaggccgtagtgttcgggacatgtcagacagcgtacttagctgtcctagctacaaaggtcaattatatgtgatgtaaaagcagatcatctatagtcgcaagaaacgaagacatatataattaattagtgtttgtcaggatctcgatcaccgtatattgccagtacgacgtcttgttattttagctttgttctaagttaaatataaaactcgcctaactttaacaaagtgtatagataacactcaaaatattgtctgaggacgtatctattgaacttaggatattatgcgtatttttctataaacttggtaaaaactataagactacaatgatgtaactctattaaaaattgtctc

SEQ ID NO: 4390 - DNA, 1349 bp, Zea mays
  misc_feature (1)..(100): optimal_loci_83705_G1, chr2:191133087..191134435, Cluster 26
gagatttgtttgaagaagttgaacagttgatgtgtgaacatagtaagagggtgtcattatcatgttaaacgaagacatgtgaatttctatctctcccacaatgatagaagattaaagtaagtttctaacttctcactttgattcaacaaaataacaataaatgattgtgaaatatgattaatgaagaaaaaatagattccatgctattaagaagctagaaatagaagaaagtagatcaaaaactctggacgttgataagatgcatatatattgttaattcctatgataatagagcaaccataaatgttgttggtctaaaaatattatagttcagctagcgcacggagaaggccataactctggacattgataagatgccttctaaacatcataacagaagaaattatcgaggactagctattgctggtctggactttggactcgtgctcctagggtctgtgccccaggcatctaccttagcttaggctaaagggcataccatgtcgggggcgatctggccactgacctataaggttaccacatgctaggccctcatgatgtttccagacttagttctctcgactgtctgtggccactagtaggacatcagatccctgaggccttagccttatataatctcaatggttgttaaagaggacaaatgaattctcgattcaactaagtatggaagcactgatagactaaagaatatgcctagccctgccccaaggacatgatgcccccaaatgtacgatgctactttaaaagtctacacccaacaacgatgtagtattggcactttagattagactcatatattatattaaatgtgatatatgatgttgtagtctgataggcgcactactaccacgacataggtagcagatgtacctaagaccactactcgatatgtggcatcgtctctatagccactcttgggtgctatagatgtagggtactaggaagtattataaagtataggctgctacattagttaccaattattgcaggtatgatttggactctagtacacgatgctatgatgagtcatacatgcctctatgataggttatatccgccattgttgcaagatatccctaacaccatggcatggtcaaagatatgacactatgtgtggctgcatgaccatgacaagatgggagttgttaggtctctgttgagtgaggcctataacactcgtgacatgtaaccctctttgactctttcatcccttggcatataaaagagaggagtagagcaacatataggggaagaataagaaaagggccaatcctattaaggttgaaaatgatcaactactaatgacaggaataaaggtgaactaaaga

SEQ ID NO: 4391 - DNA, 1381 bp, Zea mays
  misc_feature (1)..(100): optimal_loci_83735_G1, chr2:191375867..191377247, Cluster 26
acagttttgctcgcagctaggaagccctactacagctgaacacgtcgatgtcaccgaataggactgatgaagacagatgttaaatgggaaacgggctgactagtttatgcgagtagaggtttgctagtgaatgtatcccacaagcgtgaggaacacggggtatatcaaccagcttgacaaacgacaacaactgcaacagtgaagtaattatgtcatcccacgggtatcttgtttatgtttcagatgctagagttcattttaattttgtcttaggagatcacacttttttctagtttaggctaaatttactatttaaatcgtttcatcattaatttttttcatcaggcctattttgacactgcgttttatttaaataaaattttactgccctttgctatgaagagtgtcattctggctgttttaagtcggctaatttcaaattaaattaaacttataaaaaacctatattataccggcatttatactaccaaataaatgctttctggctgttttaagtcggctaatttcaaattagattaaacttataaaaaacatatattataccggtatttataataccaaataaaatgctattagattcatcgttaaatacgattttgttatattggtagcgttcgatccgcgcgttgcagttgcagggtgtgaaccttcgctggaacaccccagttaacattattgaatatacctcgctaataaaaatatcgaaatgatctaccatagctgaaacattaaattcatagtgttgtctaagaacactatcaaattaagcatccaggtgcatgcacgcatcatcgtttacttcaagaaaaccatctgactgccgttggtcgacattggacttttattgttttttttttcttacagactgccacctaataataaacctccttttttttcttttcttttcttcccttgagtgactgattgaagaaggaaactggccgaataaacaacgagctctcgttaggtcgtgaggagatgcatgcaaaggttagttgcccccgaggagatgcttatgcaagttccagagtactctttgtttgctgcaagttgttggtgttggctttgttttttttcctttttcgtttccgttccgtttgctggtagtattgtgtgcgtgtccgagtcttggaggcatcaaggcaagcccgttcttgcaagaaagggcatcgtcgctgtgtttttttttcccctcccaagtcttggaggcactgtttgttggcttggccagtactactagcgcactcacgttgcgtacgatccctctcgtgaggtgtgcggctttgagccgtcagttttccacggccagccccagccccactcctcgccgccgagacggacggaaactgcaaatcaaatg

SEQ ID NO: 4392 - DNA, 1005 bp, Zea mays
  misc_feature (1)..(100): optimal_loci_84300_G1, chr2:194901373..194902377, Cluster 26
ggcttatgtcccttagttcatgtatagacatcgaggatcacttataggtagctaggtgcataggcttagagcctttagcaacacaagggtcacgaaagtttattttggtctagggcccttagcagcgcaagggccccaaaaggttgttttcagccctcgagcaaagagcgttagaaccattgcagagttattaggccctcgggagtatgaatgtcccaaagaggtgcttccatcttccttagttaataaagtatgtgacacatctagggcccttaatagcgcaagggttccaaaggaatgtccctttggcactcggatcaagggacatatccaatagagcatccaatacccttagcaccataagggcctcgaagggacatcccccagtccctagacatcaagagcctcaaaaacgggggacataacgcttcgtgatatagcatggattcttcctacacataatcttaggaataacggtaaacttccttctcccgagggtcatccttgcttatacttagccatagactttctaaagtacttccagaacctttttaatgcctctagtattaggcaaggaaaccaatgcaggccattggactctggctagatagtagtgtagagtgaagggcagaccaagccaaacttagtggtccgccatggtagagaagatcaatgccatagaactacatttgaaccttttattggactatttagctcaagatcttgtagataaacattgattaagtttgccccaagggcttaccaacttagtttaaaaagaatgtcaaaattataatactctaaagtagggatcaagcccctggaggtgtgtagaataaactaacagtagtctcttgcaaggataaaatacttgacttgtaataaaaaggaaaggagatacttatcctttgcaagaattcagccaacatggaaattttcttagtgaccttaggtttttattcctgtagtttcgtatcacaagatgtaaaattctttccccgaggc

SEQ ID NO: 4393 - DNA, 1082 bp, Zea mays
  misc_feature (1)..(100): optimal_loci_85558_G1, chr2:203248643..203249724, Cluster 26
gacaaccccattaaaagttcgcaacacaacaggttcatggtggacggatcatcggtgcacctgcatcaccgaagttaaaaatctgattcgagcctacaccctagtacaggtgaaaattcgcatttgctcttgaacccactcgagacccataatccagtaggcggcccgagacccaataataatataacaaatcatgtaactatcatccatgatttataactagaaattatcaaaataactagtacatatacgaattaagaaatattgtgagttcacacactattataagaacaaaaaaatccatatcattagccaaaatcaagctacaagccacattatacacctaggttactctagtggctaacggctaaggcactacagtgtggtcgtgagagacacaggagagatagagtgtagtcaatggtgtggtcgtgagtgctggtaatcaccatgtcatagcttattcgtagtcgatctttataggcatagttaattcggataatctattgtagagtatgtaagtagaagaaccaatagtctagctattcatagtaataactttgatatacactcccatagcaatgaaagttttctcggattttcttggccatatgagttattccttttgttaaatgtggtttcctcggactcaatctttgagaagttcctcggcgattacccataagtggaggcatttctaggcctcatgacaactatacttgtggtacaaacaaggtgcatccataatcctctaaaattgtacttattttgattttgatgatcgaaattgagtcctcctttcttattttgttgtaacctcgtggtctgcttttcttttattgtatgtgtcattggggttggtttgtgatccattgcttaacttacttttggaaagttgttgctagattgccttttctcctatagcatgcttaccggtgacttgaaacatcacattgagagtgataggcatatcttagatgagcttctgggtcaaaccgtgatctctgagtcattggcaaaaagttcaaataaatgccatttcggaaatgtcggaaatgttggacttcactctgcgccatctt

SEQ ID NO: 4394 - DNA, 1125 bp, Zea mays
  misc_feature (1)..(100): optimal_loci_86959_G1, chr2:210534485..210535609, Cluster 26
gatggtgttttaggtcagggatgttggcatgacccaaatgaaatccacctctgatcaatgaaccatgaccatattcgttcaaaacacgtgggcaagccaaaaatgcatggacccaaaggtgtcaaaagcaaagtttcagcttcaatggagagagcttttggctgaagacaaggcccaaaagaagctctaggaagagaagatatagggagttttagcgaagagatgacataggtgacatgattgcacagtgaaaacatacacgtgatctctcaaatgcgaagcattactttgtgagaagaagggacaagaatgtaattatacgcaacgttgtataacggttcgatgttataaataggtaaatggtgtaattgtcttagggtcaaccattctttctattaaatccaagcttattattaaatctacatcatgagagagcttccaaaggtataatattgatgctaaagcttatgtttgcatttgacaatgcctttcatgttttcttaaaaccctaagattatgcttacttatggtaagcaattctcctttgtgttattgtctatttatgatgttacattcttgttcaaaaatgattaaacaagtatatttgaaataaaacacaacatttacaaatcatcaaaggacaatgtatgacccttgcaatacctcatcttcttccaaaattgtggatgagaggagaactaatgttgccctattattattttttttcaaaagtatgacaagtaaccaacaacgagtgatgttaggaggaggtggtggcgagtgaggtcccactgtaattatgtcattttgcaattgcatctttgttatattaaaatctatacaaaatctatatacctttaaagcatgaatattgtcgtgtgtcatcctcctagcgaatctcgccccctccaacgaaaaccttgcttagcgaaagtcgcgtgcaaaaatggagcgcaaaaatccaacacactgggttcggttctttgtataacataaatgaacattagccgcactggttagaagactcagttccctgaatataaataaataatatttatttattatatagttgtgctaggtcgacactatggacaaagaagacgacctaggcacgacacagttctc

SEQ ID NO: 4395 - DNA, 1222 bp, Zea mays
  misc_feature (1)..(100): optimal_loci_87332_G1, chr2:212377288..212378509, Cluster 26
gtagtataattattgtaaattgtatggattgattgtttcaggattccgattccatcacacgatcatgttcgtgcatttgagtaagcctattttcctctcaatctcctatgttgtattcatgagttggcaaagctcgttaagttcactagcaaagccatgttatgcatatactcgtatcatagaagtctaagaaacatacctataagtacactgatgacatggaaggcaaagttactttttattgatgaatgattcctggccaaaattgtactatattaaaaaaacagggtgctgcaaatggaatttaagaaaatgtctcaccatgtgcttgttgttaatgatccttcatgatcaaatcaatattcgataatatgttggtttgggaacataaagttaaccagtgatcctaagagttgtaattgtttggctagctctacctgaaggatggctacataagaaattatgaataaaagaagtgaaaaaaaccatttggtattctacaacactccaccaataggtaatatctaggcttattgattggaaaaatatatattggtttttcaagttattaacaatacgatactctgttcagaaggtatctgtatcgcatttgagcttcagtaccacaaatgactctgcctatctgacctcgcaagtcagtgcaatcattaccatcatttggaattgtttaaggtgtgatgattgttaccagtgatggcattatttataactttgaaaaactagaaatgttgtagatgtggcactaaaagagttcacgcaataatctagtggcgtgactactgataattctagagtactatcaatgaaatggacacccactaaatgttgttatttaagttttaggactacgcttttatcaattcttgtttgagatgatataaaatcggtaatacaggtactacatgtaagaattcaaattgatttccaatcaaagtaaggaaatttcttcttataatgcagactatgaatgatttttatgctacgatttattttgcaattcactaatataaattacattttcctgttatagtcaaacaaactagtgtaaatattacttatggaggtaagattatatactatgtataatatatagcatactgaagatcaagcaacattctaagattagtaggcataaaagagaaagagagcaaaggaacaacagaaagttgcggacagaacgaaatcataattagatcgtaag

SEQ ID NO: 4396 - DNA, 1263 bp, Zea mays
  misc_feature (1)..(100): optimal_loci_88802_G1, chr2:220829652..220830914, Cluster 26
gatcgcgatccattaccacccttaattaaacacaacaactacagctaataaccgcttataatccattgttaggattgtccaattatgtattggataatagttagttgctattttttagcttcaactaacaattagccttagatcctatttagatccactagcatctaatagttatttggctaactaattattcattgtttggagccatcaggtaaagaagtagatgcatagataataataattttactattctatttattactgggagagtacgttgcaatctacacctggttgaggtagctaactttagtcatgtctgtttgggtccaccaaagtaatttttttagtagctaattatcaggccacatgcatgagccgatgaaaaagtcgtgtgccagatggtttcttggatgagtgaatggctggctttagccgaccaaatagaccctgctgtgttaaaatgctgctaacctcctcctaaatacattaatcatttgtttaacccacacacaaatttgcatcgctggctgcagacaaataaagcaagcaaattagtgtttccgaggtccctcagcgcgcagcagcgacgtgtctcctgttctaaagaccaggtcatgcgacctgcatgcagttttatactgtatgagcaaacagaagaatctctggccggccggaacatgacgcagatgctattattttcgtcgctgatgaatataaaattttattaaaacattgcgatcctgactatgccgccgccgccgctagtgcaatggttcttggtccttctaggtgtcatgttcttggtccatatatgctagctcatgtgaggccttggcgagagccacatgaacccgtagcaggttaggtgattagatcaggcactcatgcccagctagctgattggagaccagagaggatggatatatagcagtttagctcgatcgattcagcatcatgcatgtgttcgagtttcggtgttcagactcgatagatcgcacgtttgctgtggctgcattggcaggtggtgccgactgccgacgcatgaggaagaccgtggctgcaaaatgcatgcagtggccagccagagacaggggcggccggccggccaggcagcaagaccgtggcagcatgagcgtggttatgacctgtcgacgtccatgcatggaatatctcatatctgaatcctcggcatgcacattggttggaccgccagcgaattcgccagtttgtgacaccgaaatactgtccagatttttctttttc

SEQ ID NO: 4397 - DNA, 1126 bp, Zea mays
  misc_feature (1)..(100): optimal_loci_93189_G1, chr3:5591520..5592645, Cluster 26
gtacttttaatataagcttcctttatcgaaaaaaatgcaaacaatgaaactgtgatgatggcagagaaaggaccaacagtccttgtcagatccagttgatacagtagagcattcctagggccaactaaagcagaagcaaattaacaactaatatagatcaaagcaattatgattacaaactgccagacaccaaatatgtagatggtctgcactaggaatcaattaaagagcctaataaaactaacaaattgggaggcatttggaccctcattatttatggcacacagtgtttcactattaccatgttccggtccctgcaaatttggaacaaggccacgttttcaagtgttcaccatctcagtatgaccacgacatagtttaggagttaggacaccagcttacggctggcacctcttgcttgcatcatactgcccaactatattgaaatagcaatggattgcatgatcattgtgctcttactgtgttgcatttatcactaggtcacatggcacctcaagttaaactcgaccaataggatgtgtaaacaagatgccagtatgtaacagactcggtgcagttttgctaaaatatttgttaagaagtgtagtttttatgaggattcacaggtggtgtggtgaagcaacacgaaaaaattagattcaactaagagctagacaaacatggtcactatcaaagtagcaatccatttgtcctgatgcttctgaaagttacaatgcagacagcatcacagcaatgagtcgatcataaacagtaaaacaagacatgtaacaaaaggacatgtggtacatgtagaggtgttaccatttcaaaagcatcaactggccgtttactcttgagcccagcatatttggaggaatccaagttatctcattaacattactctggactctggactcccatgatatagaagttacaggaaatcatcaatgctctgctgttttcctggatccacactacttttcttgttcaatctgaaaaatgaaaatagtcagaaacacattaattgaatttcaacagagattgccagcaacatttccaatttaacatatcctattgacctgttcctgaatcaatcgtgtcttcaacttctaggattcatgcttta

SEQ ID NO: 4398 - DNA, 1362 bp, Zea mays
  misc_feature (1)..(100): optimal_loci_94570_G1, chr3:12608308..12609669, Cluster 26
gcctcccgtagaatcccaagcaaactctcaaactactaagttgaatagtgaacttcgcttgtactcttacacgagcacaagaacctatattctactttgtaacatttaaaataagcaaccaagacttcaacagcatactaaacacagaggactttcctgtagcagtctaaaatcctctctcaggctcgccggtgccaatccattggaatagtagcctgtgaaactcctctgtaggctacaagtttacttgtcgtaggaacgaaaccacgacattgagcgttattacccttgagacatcaccaccgtatgtaggctgatccaatttacccggttctaataggatgacatggctaaaattcaacggtaacaatggtacttataggaattgtctaaatactaaattatgctgaatacacaaggcttaaattaaatcaactttagagttaaggatgtaatacataaaggcacttgacgaaacgataatatataaatggcatagcatctatgacttataattcaagaactaataagcattgcataataaagggattatgtgacacaaactcaataatctttcataagcccaacagacaggaaagtgtgtgctcataaccgatcgagagagcgcaacaatttaaattggttttaaaactatatacacagatgtataactttttttcacaaagagcataagatcaaacctttggtagctttatccatgagcagcaagggtttattcattcctcctgacattttgatagctttgccaagacacctgatcaggaacggttgaaatatataggcgtactaggcactagctacacctcatccgaaaccacatggaatccatccgttgaacccatcaacacatactaacatacttatggttcccatatatatcaacacatactaagaccaaaacttgatagctttagctaggtccccgtgggagaatttaggcgtatgtaacagacattttatacaaaataaaagtaaataagattagacaaacctagagacacgtgaataggcatgtttaagattaaaatttgatatagtagttactagttagtaacacaggcgcgatactgccgctcttgcgcggcgctgtggcaatttagcatgcaactgcgttacttccgcgtatcgacgaagtaactagaatacacaattcaaaaattgttcaacagaaagtagatcaagtaaattactcctgaatacataagagcctggttcaccacctctctatatatcagaagcttaagcacaagtagatcgggagcaaagtatagaatcacaaccaaacataaacaaaacaagaatacaaagacatggtctttatcctatagttaccctaggatc

SEQ ID NO: 4399 - DNA, 1253 bp, Zea mays
  misc_feature (1)..(100): optimal_loci_97741_G1, chr3:29974995..29976247, Cluster 26
ctctccagttcggtaccaccattacctggaatcagcatcagcaataaagcttgcaagtccagcatccgaaaaggtgtggactaaattccgagtccagcaaaatgtttgatgacttgaaattcttatggatgatgatgcatggaggacgtatttcacgaaggtacctgctaattacatttcaatgggaagttataaggacctacttatttcagaaggaaaatagtatgctaacagcgcaataactattgaagcatgttcttaaatcatgtgtagtacttgacaacatttaaccaacaatacagataacagattccaacagaactaaaaaagagtaaaccatatggagaaacaaaaagtctatgcatgggtatatctcttaatccattattgatttagtattataataactcatgcgatccaaattaacaaaaaaatatcattaatttccacttaccccagcgcacagatagatcaagccgagtacaatattcacacaagaaaaacttcaaactagttttttgaaacaaaaaacttcaaattaagtgccatgctgtactcatgaaatgctgaggagatcatgatgggatacatccctgtcgaaaccatacacaagcaagtgcagtccatgttccatgcatgccaacaagttcattcagatccagatggcgcagttctgaagtaatcaacatcagttcagcaaagtcatcagaagattggagtggtatcgaagtattgtctaatttcatgattgccagaacctatatagggtaagtaaaagtaagtgccttataattgtcactaatgttataaatatatacacgaagtgacatgggggtcattgtggacatgaaattacccattggcggctttgagatatcagcgccagtttcaaagaccatacagagataagagattttttttatataacttcagaaatacaaaggaaatgtgacatgaggatatgtagcatacctttccatcattgaactctattccctgtaaatggtttcaggcattctatctccgggtgtgatttctgactaattgtagcaggtaaagacatgctgtatgtctattgtggtgcactcatgaacgcttcatgtcagcgccatttgtaaggtgcgtgttcccacaatttaaagctcccaaaacatctctcaagtgaatattatgcaaataaaacaccattgaattgtagagttcaaggggacattagctataattgattgttctgcaaatgtaaaacagaacaa

SEQ ID NO: 4400 - DNA, 1032 bp, Zea mays
  misc_feature (1)..(100): optimal_loci_99591_G1, chr3:41739699..41740730, Cluster 26
tctccatgtgcgcgtctccacgccgagagcgacggcagcaccagcgaacacgaagccgcccgaacccgcaactggctgttgcggttcacgctgcacgcggtcgcggaaatgcatcccaacctggcgaaagcgaccgtccccggtccgtgtggcccgccgtgctgcggtgcgaaacgtaagcgctcgttgcctgctttagctctttgacactgacgcctatctgtagtcctgtagcatcatgttagttgtatacgtttgtgatggcgacattccaaactaagagacgccgaaccaatccactgttatcagcaaaaaccaattaggaaatagcttgcacgaacagtactatctagcctagctttcgcgacaaggacgcaacaaaaaaaaacaatatcatctctatgcaatactattaagtgtttttagctctttcagaacattctatttttcaaaaagaaaataaactaaattctctttaaaaattatgtataaatagggattcgaactattcttggttccaaaccgatattcatatccacataaccaacaaattacacatgttttatgttttacattctacacttaagaataaacaaaaactgtagcaaagtatgggcactttgctagtctccactctacgagcccctttaagcaccgagtaacatttggaccttatccttcaaatatctttttcaaatttagctaagtttatacagaaaattcaatatttataaagtcaaatagatccattacgaaaaatatagggtataatgaatcaaatgggaatttatttaataccaaaagtatcgattaccgagcatgcaaccagaccagtaaactgttgacaaagtaaacatttttttctaaaaaaaattaaaactaaaacctaaatcatatcatgacggccttagaatctagcgcatagagatctactaacatagtacatatgtttaaaaaaaaaactcatgacgttttacaattttggatagagatagtggataattcgtgagcgatggctgatccagaagcacg

SEQ ID NO: 4401 - DNA, 1498 bp, Zea mays
  misc_feature (1)..(100): optimal_loci_106202_G1, chr3:85647138..85648635, Cluster 27
ttttatcaattttcatcaaattttcatatttttaacataataattagtcaaacatgtactgcgagcgattgtaagcacaacaattagttggcatatatactcacaacctcgatccctcctctcttgtctcttctaggttgacaacttggtatccacctttgctaagggtagttcctttctttgtagtagtagcttcttttttagtggcctgcagaacctctccatgtggccacctctataactacttgcactatcctccctttctatactaagaacaataacaaaacatccacattcttcacttgattattctccctctaattgattccagttaactttatctctagctctactcctttgtttgcctttcttttccttcttagcatttttctttgtcagaaattcaaacaacaactccttcacattagttggaactttatcacaaatgcaagcaatgtttttttaaacttaactatatggaatttgatctttgtaatgccacctgagtgcagctgctcacaaaaattgtacttgagattatacttcttggtcttatctcaaggaattcaatacgtcaagcagggtctattcttgaatcaacaacttggacgtttttagaaatgaaagtagcttgggcattttaaataatcaaaacagaggtaatgcttgaaacactaccacacacacctgcacaagaaaaaaacattttttgtatcacacaagagccttgcatatgcaccttgttagttcattccatattgaaaattttatagccatgtgcagtgtgttgcacctagtcactagttaaccacttcacctttatcactcactcatttaataagtagtaaatactaacaactaactagtcatgttgtagtaatatgtatagaaattggtgggacaaagtaactaacaaatctggtccatactacaatatgaaatgaagatgaacctaagtatctagcatccatagagaagagatatgattagggagattgggaaatggatgatggggagaagaactttcctgctacctaaggctaagacatgactgagtcattgagagatgagaccctacttcttgctattcctagtggacacgtggaatatggcaccatgaccaccccactggctttcatgatctaaacaacggcgtcaaacataatctaaacaccaccagctacaaactgtcaggaccaagagcaaggccaattaatgtaccatcactcttgtttcttgaagggaacaagagactagagactaacatatgagagcacttgagacttgtatggttttcattaggcctatacgggtcattttttgcttgccaaagttttggccttgctagcaaaaactaaaatagtggcgctatagtggggatgatgttatgcaatgagcgctgctaaatgttgctaaatagtccatctctttcatatagcaccaaaatctggagaagcataacatacattgctttgaaacgttattacagatgttacta

SEQ ID NO: 4402 - DNA, 3104 bp, Zea mays
  misc_feature (1)..(100): optimal_loci_1075_G1, chr1:5522640..5525743, Cluster 27
gaccataagacaggtcagaatcgtgttttatgagagatgtgttattttcggttttatagtaaaaacaaacggattttttgcaatattctggaagacaaaacacgcttttttccaatcttcgagtgctttcagagtaaggggtgtttgttttcacccaactaaagtttggtcattgttatatcgaatgtttgaatgaaatatagtataattataaaactaattttatagataaagactaaaaacgagacaaattttttaaaaatctgattaagcatatatctagtatccataattaatatcggtgtgatataaactaaactttagtcggtgaaccaaacactctctaaaaacttattcagttaggggtgggttaaaatagattggagagaattaaatccttgttaatcgaatttgaattggaatttttttaattcaccttctccgatccaaatacaaccatagagagcctgagtgcctgacaagcggagcgtggccaactgatccaacaagcgagctcgtggcccatgtcccctttggccctttccgcgttcagagcaaaaagccagagcgcagcccaccgacccaacaagcgcgctcgcgtcccacggcaatagttaggaggtatgacgtgtttttttggttttgctttgtttgttcgcttacatttctattttttgttttcagttatattttattttattcatattgtaatctttcttttatattttattataattatttggttatttttatttccctttttattgtttttattgcattctaattcattatgtttatttttaaccattttcggaatttaatttcttatttaatatttcatgagaaacacatgatgttctcttactctatatttgtcgtgctatgatatttttttgttgatttgtactatattaatgagatattccatatcgtaccgtgagatgtgtgtatagtataaataggaattctataatatatcttcgattatttatatagtatccatgagatggttgtttcaccagtatctatgtgatttttttgttacatcttttattaattttcatttattttgctttttctatacgtacgtttcatagcatctgttcttatttttaaaatctttttcttcttcttcttcttttatttttatatatttaattatttgaattatttattatcatttgttatgatttaacttttactttccatattccataaatatgcatttgatatttattatgttctaatagtactacagacttactccgtggcctagccataacgttaactccagtctccagtgccggcccgtgctaacagtgagcctgagccatttctttcttttcggatcactcagtcatgtttccattttgcaagtctgcctgtctccggtgtctcctcatattctcctgatgctcaattcaaggcaccacaaagcgaacaagaagtcgtagcgtacctattggctttgcaatgtactaagattgtatctcgaatctgtaaagagagctagagaaccggataggaacttaaaaagtgatttttattgttgttcattaagttaagaccaaaggctacttaatttgaccttagttgaaattaattattcggtcatgagatacagtaggaaaaagtaaagacaagaaagatgacaatagcttgcacagagttgaagttcatgctaacagatagagtaaggatacaacaaaaggaaaatgattataatcaaagaaacaaataaaactatttattaagaggggtcagggggggggggggtattaaaatactacactaaataaactagcttctacggtaatgtaacatgtagagtatgatactctagcttctacggtaataatgtaacatatttagtatcgattggtggctagagtgaagatatgtctaaattgtggctcttttgtagcataatgtaatatttttttaaaaaaagtacagtttggaatcatcaactagtaccgaacgaatcgtattagtatcgagccacacaaccagagctaaagaatgaggcggttagtgccattagtatagtccacgtagaaatctgatacttactatactgtctatagtagcgtgtatagtccttgtccgatgtgacagaaagtgtgaagacgctatagagctttgtaccacagacacgagcgtcggcgtcgccaatctcggcggcgagtgagctattcctatcgtatcactcgatcggtcaggtttccatctcgcagatctatctgtctctcgatgtctcctctcctcacattctcccgatgctcagctgatgaattcaagccgtcggaaagcgatgcatcaaacgataggccaccaattgcgtttgcaatccagccaaacgtacgtagattgtacacagtggagggggggggggggggggggtgagcgagagaggccgccatctcccattctccttagagcgaccgaccgaccggcactgtaggtttggtctctttccgctctcgcaggtgtcgtcgtcgtcgtagccctctttccgtcgtcgtcatcccttgcagcagataagctgtcagcgggcgttggagtgacagaagctacacggaaaacagagaatggctggtggtttatttcggacacacacgcggattgtttttccccgtccgaaaccgaaaaggttgttagtgaggcgacgagacgcacacggatgaaccacagctgagctagctagctagtagtctagagcatggaggaggagcaggtggtggtgccccagaatgggagttaggttttctgtgcatggcggggccagaatcctctctggtttgcctccactgacatcattcgatctccttctcctcctatccaatccaatcacccttttggcggacgaatcctcgatcgataggcaaggatgcacacaccgcacaggacgcctcatcatcctacttgaagacgctagcacgcaactgcatgcaagacggcaaagaggctttgggccgggctgctgtttccgatgcgtagcgtgtgctgtggtcgcacgcacagcactcgtagcagcagccatcagggcagccgcgcagcattcagtagcttcttgtagaaacagagagaatatataggcagag

SEQ ID NO: 4403 - DNA, 1500 bp, Zea mays
  misc_feature (1)..(100): optimal_loci_113475_G1, chr3:132689686..132691185, Cluster 27
ggagaaggcactaatgcatgccatggtggaggaggcaccaaatatcatttctccacccattgaactagcaatggagaaggcactaatgcatgttatggtgaaggacaacgctgaagcaagaagtttgatgactggttcttcgatattgaggatgaacccatggaagactcctagcttgaggacccaaacaagtttgattgggtgttttagctgcatcgagagcaggagccagaagtgtcagcaaagctgatggatgtaggggtggtgatgtaagactcaaatgatttttggcaccgaatctctgatgaagagaacgactctttagaagggacataccaagaagacaatgatgtcctaaaggactaagatgaacccaacgaggttgacgacctcgacaagccgatagatatcaatgagccctagatatgagggcccattgtgctaggaattccctcacccaaagctcctacaccaaaagctctcactctagaagcacctaaaccggatgatccaaacatgagaaccacccacaagataaccttgcactcgagcatccccttcacctagggtggagggtcatgcacgacaacaacgtttaaccctaatgtttccttgcatgctctgtcacctactcatggtcaactacatcaaggtgcagcaccaacacatccacaagtaatacccggatggatggatggttttgatcaagataaccaggcccaatggatatgaatttcaaatggtggtatcctgacactacgccttggccattggaataactatgagtctaggataaacaacatagtcagactagatacattgttgttttatgaccttaactaaggctacatggacaatattatctatcggtgctatcgatgatgcaagtctgggcaaaacatcaccatgatcaactttggtgtgatggaagacaacatacacatggaagtgttgttggaacacatggaagacaacatactgaacatcacattgtcctagcagagctagatagctcgaggatgtagaacacttagccgtaagctcatttggataatctagggcaccctcagccaatcggaacaacacacgacccatctgagtcaccgagaagccccacgcttctctacaaccatctagaattcaggacatacatatgagatcattagggccatccttaggttgtaatagagaatcgccacacaataaatataagtgttgcaataatagatcatataattgtgaatgaatgctttgatattatgatcatgaatgatttggttctttgtaatgattaatgttgagtcaaggttttctgccttgacctagttttaaaaataatagtgtgttcctctttataatagagctttatcatattttggggaaaagcctttgttcacacttatcttctcttcatccaccttatcactatctaaggtagatcgagtatacaatgacaacttttagagtgtatggactataaaggacatggacatggacatg

SEQ ID NO: 4404 - DNA, 1642 bp, Zea mays
  misc_feature (1)..(100): optimal_loci_119570_G1, chr3:170779329..170780970, Cluster 27
aatattgggcgacctagcttgatgacatgagggcagcgaaagcataaagaaaccgtttgggaaccgtctaggccccctcctaaacaaatgccgctggcattatcatcgtcgctgactgatcgagatcgtacgtacgtggacgtggacgtggtcatggagttaggttagcgagcgctttcgctggcttcctaatcacacgccattatataataataacgtacaggatggacggaagcagctagaggtgaccctttatctgtgatgaaaagctagctaggaagccatagataaattactgtcgctcgctagctgctatatatacttgagtggtgcttcgtgcatacgtaaaaaacatgtagtgctagctactggtttctggataagaacgacgtgggtatgtatggtatgactcatcatgcatgatgcctgccacaccggcctcctgtttcttctttccggcttggctctctcattccgtcatccgagacgatgttttcttttttacttccttttgcgaactcacgcgtacacttttagcgaaagggtgcatcttcttttcttcttgcgttcatcacggccccacgcaccgtgtatatatgcataataataattattatgcgctagatcagatacatgatgatcgagagaacgaatattttgccatgcaaactatatacatatgctcgaaaacatatgatgatgccgtatcgtcgtccgatcgatcggtcgaaaaatacatgctcgaaaattaaacccaccatctgcttttttagatggggtaccggccgggtacggtggctacgagcagtgtgcatcagcagtgatagatatgggtgacgacagtgtaatacataaccacgcacacagccggtacgcagcatccatcgatcggcatcttatctcctagctagtaaagcccccacactttcaaccgcatagctactagcatctagctagctagggatcggaccacgacggagaaggataatgctgaaatgacgatgcgcaccttttgggatttcgactaatcgtacaaaaactctgtttatgcgaggattgttgctttcgtgaaaagatcatttaaccgtacaggtcccttcatcttcattggcacgtaagtcttccgatattcagactatcatacgacacttaaattatccaagaattaaaatttcaaaaaaaaagctcttagtaaaaaaactgtcgttattaaccacgcgaaagccggtatcaaccgtggacaataatacgacttagctgcgtgattggacgacagatccagacaacacgaatgaacagtcttctcagacgccgtgttaagacgttagtctctattgttttcttttcccagtgcgtgaacccccccaaaaaaaactttatccttatgtaacacatctcacttgtattaaatagtttgaccactgaatcatctcaaattgaaaacgcttcggctgtgcgtgaaggtttaggttatgtcgatactacaattttgatatatggcatgcatgactccatctgagattgctaatatttttttttgaaaatattgttttagttttgtatgttaataaattataataccataaaatagatatttgagacgctaacaattttaattaaaaaaacttatcaaatactctga

SEQ ID NO: 4405 - DNA, 1973 bp, Zea mays
  misc_feature (1)..(100): optimal_loci_120997_G1, chr3:179433351..179435323, Cluster 27
tgtttctacaaaatgcagtaaataatacaacataacaacttataagtttatctccaaggagtattaatataatttatggtgaattatggtaagggatttttttgtaaataataaatagcccctatgttttaaagtgtaagttgttctgacttttaagtacacaacttttgttatgaatttaatatatgttgtatctaaatacatagttatatatatatataatttatagtctagaagcagataatattaacataaatatttggtataatacatgcaggtttacttgggcttcatggtggaacctagcatttgtttaattttaatttagctatggtaggagtgtgaaatttgaaaagtatatggcctactttatgattatcgaagtacatttacaataacatagatagataatttagatataattttaaaagaggttaacttatattgagctttataacggcatatgtttataatttaaaagtaactttgtggttaatttgaaatatcatttataatgatgcaactgagtagtttagatgcaaattggattgctttaaattattttataatacagatgtatgcaaacttgtggggttacattatgtgttttcatgacggaaaagattcagtggttataattgatgatgatgattagacctatcaaataaaggtctggtcttggtcgtggtcactctcacatatgctacagtgctgctgtgtttggggtgggtcagaggttcaagaatttcctcgacccgcgtgagaaggttttttcttaatataatgtcatgggaaggtcttatcgagttttttttagtttttcaaaagattaggatttatcctttttccaaacttgtattagtcttgataaccgtttggacctttgtatggggtcttcacaaaaatattattttcacagtcaattttatgggtagttatcaataacagagttaaggtcacactagaatttggcatttaaaattacctctcaaaataaaataaaatatttatggggtactttaaaagattggtcgttcttgtcaaggataatctagctagaagaaattggaatagtagtcaattgtgtttgttttgcagtaagttagttagtatctaacacgttttcttttgagtgtcattatggcaaagccttgtagtgtgctgtacactttgtattaagtatcagaccttcaaaaaaatcatctgttaattcctcgtgtaagcaagaggctaaaaccttagaataggagctgcagtagtttgttaggcaatttggtctagcaggaataattttatatccaataatagtcatacaaaatttttaggtgctcttcatggtacactagcttcgtttctaatctctattacagtggatcggtgaccataaaaactggttgagtttagcatgctaatttttagaaaccagagcactgaagttttctcttatcatggatagcctgtaagatttcatattggacaataatactgaacacttctttctttagtttctacttgagttgttttctgttggattggaccggcgcctctttatcgaagacgtctgaggccagaactcttgtgctataaaaaaatagtaatctgatatcagacgattttaagtagcatttccttttgaccaatcgttttgagcatgtcaataactagagactcgtgtctcagttaattaatttctagagacgtgtgtgcgtctttctttgtcacgcttttctctatctctctaaagaaaagtcgaagtagagatcgacattgtggggtgggttttcttttacacaaacaatcatacttgagtttgtcctaaatcaaccactattaactttgacagattatatcagatctttcataatttgatttagtacaaacctaaaacgtctaattcatgtggatggagggagtaatttgcatctcttgagatttaaaaaagttgttccttccaatggcatggcttcccctgg

SEQ ID NO: 4406 - DNA, 1700 bp, Zea mays
  misc_feature (1)..(100): optimal_loci_121279_G1, chr3:180760622..180762321, Cluster 27
accaaaaaagaaaaaactgcacgagtaattatgcctttttccttcgacagcgatactatcaaataatgctcatttgccagtgcgatatgtgtacctaacaaaagttagaagccatgtttaatttggccagtgtgccagccatcgccgtccacagggagcgaaacatcagtttacatgccttcacatccaggcatgaggcatagatccaccgcgccgcgtaaaatacacagattaatgtacgtacacgacgatcgatcatcgtcgtggtgaatggtgagatgagacaaacaacgtgtgtgctcgatgattcctgaaaactgatcttttttttttcctcggcgttgcgtttgctgtcgtgtattataaagtcctcgttaccttgtgtcgtcgtgtcatgcatgtccctctcgccctttaattctcaaccacttttttgttgttgctgtgtgcttgcttaattttttttgatgattataatctaatgattatcgtagcaccgatcatgataacgtttgattttatcacctagggcgtacgtagaggaaaactataaaagatgatattgatatgacgcgattatttaatttaatctctgctccttccattgcatcggcagcagaacttgcgtggttcatcctgaataagcaaggttagccagctactatacttacgtggttgacttcgttcagcttattctattcaacggcaaaagttgtacgtcgtgccagaggaccgtgtgttattgcttcctatttttgttgtctgtcgtattagctcaacgttgtggataaaagtcgctgtcacgtctcgctcggattcacgtgaaacagctagctcccaccaattcgtgcacccgtagtacgtgcacacggtaagtgcagtgagaacgcatgttccaaattaactcacgtacatgcataatctaactcaccagacctcgattagcatccagcttaattactgctttgttgtatctggggcgggcgggtcaaaaacagcctcgtaccaggaaacctccgggacgagcaaacaaacaaacaaacgtctccatgcaccattcatcatcacctaaccaaacatcatcatacccgcaccactaattggccatctatatatattaataatagtaccggtaaccactgaccatgcatcaagcgattgtacttagcggtaaagcaaccccgtcccggtgtcggatattctagtatatgtttatagctatactactgctactaataaggacgcaccaaacagcgtccaggttcattgcattcgtaacggacacacagcaccaaaaatattctctgttgttccgttccaaactgctgacattgaccatgcccctgcattattacattacatggcgccgcgcctcacgacatacgaggaatgatccaagaaacttcactggtcgttcagcctgataatataatatactagtagcaccgcagatccatttttctcttcatttaatttggcatgcatcagcaagtcagttgcttcaccactccaatgttgttattaagcggttgaatgcatcaatttagaatcgcttgtttcctaaaaacgttgcgagtttaaagtctgtttagggtccgttccataaaattctataatcgtgaacagcttaaaaaagaactactgatttctcaagtactcctaattaggtagccttgtaacgttaccaagttggttcaaac

SEQ ID NO: 4407 - DNA, 2112 bp, Zea mays
  misc_feature (1)..(100): optimal_loci_121875_G1, chr3:183895670..183897781, Cluster 27
acgcggtacgtgacagtcctaattaatcttcataaaaactaagataatatctgtatcacgattcacgagtgctttaaagacggggaacgatcgggtccaggggctgacgtttctatgctgtgttttgtgagcacaatggaatacctgttccgtgcggcgctgcctgctccgtatgtcaaatatactggtgtccgctggctggacggactgctgcttcgtctctttgctggaaaaaaagggaagatctgttagctcggccttctccatctttcttggaaggtggtgcgtgttacccgttcagttcgctaaccagaggcgggcgacgacgctagcaacagtccacgttttctgaattctataatggttcgcctgatgaattcaatagcctgtcccccttcgatgaaagcagcgccagcgcggcacagaatggcagaaagtagtgagcagtgacattctgccgtcacccggagcagtgacattcatctcccaactcgaactactccggcagacatcatcaaccgtgtttgtttggaagaaaaaaaatgacaagggcaacaaatgagggaaatggttgatacgctgctgagtagtagagagatcgagacgagagaggaacaaaggggataacgagcgggtcacatatgctagtgtctattagaatgatcctagttcatcaaggacttctactgaagcgtgcgtgcgtgtgtgtgtataatatcacctcaaaagtaggataattatcaaataaaaagagagtaaggactctgatttgaggagctcttatttagagttaccctttttattaattggcccaataaataatataggtcgaccaaatatttttttctgctatcataagttatgaatactattaacacctccagaaggatgagatgtaagacaaaaaaacagcacaataacttgttaagatagttatgagatgtaagatctcaaagatatcataaccacgtgtcgaagacaattatgcatgcatcaaataagataagttagaagtaaactactatgcttctaattaattttatttactttcttcacgttcgaaaataaaatactcttcggtagtactaccgagaacgaacgtgcttaataagccatcatcaaccgtgtttgtttggagaaaaatgacaaggccaacaaatgagggaaaccgtgtttgtttgtttttttttaaaaaaaaaaaacgggagagagcaactgcaatttgcaacgcaaagacgtaactgctgacagcatacagcgcgcgcggtaaaaggactgtatgaggcgacacgacaggtaggcgcctgccatcacacaccaaagacagccaaggcctacgattggcacggcgtacccgatcgacgtgaacattatgttcaactctgaatgagtagtaaacactagataacgtacgagcgttcgtaattaaacaaaaaacacacacacgcgctatgtatgcacgataatgaatcctactagcagacattggttcttcggtcccgtggaaactaagctaactgaactgaatcccaagacctgcccggctgacaaggcacacagcgacgtgaactcgacatgcggcgcagctcttgctcttctcttgtgaacgcaacgtacgatcttggttgaaaaacaacagcaacaaaaagaacaacagctccatttgctgttcctaagaaaaatagggtgccgatgaatcctctaaactgcaacgccgcgtggagtggagggcaagaaactgcagggaacgaactgctggtttttttttttgacaacggggtataacaccccctgtttctcattagaaaataggtaacaaaggttcattacaggcctactgacaaagacaaccaaggccagccaacaggagaccagaaataaaaagctatgctagacatcctaagcaataacgaccacactcgatagaggaaggaacgacctaacacgcaacagaaacacaacgttctgtccagaaatcacttattatagaacagcactcctgaggaggcagaagtatcacacccagacgaacaacacaaaaaagggatagtctacagaagatcaaactatcggcaatgaaccactatcagcaggcgacaaggggctaactcg

SEQ ID NO: 4408 - DNA, 1588 bp, Zea mays
  misc_feature (1)..(100): optimal_loci_125179_G1, chr3:201638606..201640193, Cluster 27
agttatatgacaaatatgacttgtagggtaacttacccgaggtattgtcgtgtgtatattgtcatagaagggttcacctattttttttggagatacatgatatcaagccctatctgtccgagcatgctggcaaagatgatgttaagtcccacactcccacactaccatcaatgatgaccttagtgagttgaactcctacaagtatcgggtccaagattaggggatatcgcccttgttcagagaaactagtccattgattatcccttcagaattgaattgggaccttgaaacatcacatgtaagttgaagttgcaggctctgttgccatgatctctcgaatagtaagcttggtcggccacttgtacattgatagaactaatcctccaaagataatgttaaggacattgttggtatgatgggactctacttgttatcacttgtcatagtctttttctttgtctagcttccctcttcctttagacttgccctagtctatggtggggattaagccatggttctttagttgttgacacttggtagcgagatgtttattgactgggtggtaaggcatttctacaggagtaggtcgtcaaaagatttgggtctattgcctttctttgtcttgttcgtgaccatgacaaagttttctagccccctcttcttgcctgatggatttccccaatcatgcttcttgttgttactctttctatctcaatgactttgatcatcgtacttgttgtgtatcctcttttctatgtctaaccacatgtagaatatatatatattagaactcattaatatgccatggttgatttcgaatgaagtcttgacatatgtacttgtcttgttgttcattgccaatgacgtctctatcgaatatgtctaccactatgcattgaacgacaacaaagcgattatattggttgtgtatgctttcactatctttttttacaattctagaggtcatggcgattggcttgatgatgccatactcctcttaagttctccacttatttttgggctagtacgaaccatatatcaatagagtttattttgagttgctcgagctaaattagtggatcagcttcaagtaccattaggaagtatgttgcctggacatcgtcatctcctccagctagactgacagcaaacgagtaacatcaaatctagtggtttgggtcttttttattgtcatactttttgatgttattaggcttgaattctctcagctacttgatcaaattttgtcttctagagaattagagaaagtcgatcactagtattccattgatattgtgtctaactatgttagaggattctacatgatcgtggtctcctcatatggagtttagttgttcacccataccatgagctcgcagcaatttgtggaggtcgccctagtgcaggttaggctcacaatgacctaggtctctcctattttgacattgactgccttaagggtggactaagccttcacgattctggtcattattccttaccttttgagttttgttgtccgctctagtgtgtcatagtggatgttgcactggactaaggttgttattctctatgaagcattagagttatt

SEQ ID NO: 4409 - DNA, 1959 bp, Zea mays
  misc_feature (1)..(100): optimal_loci_125429_G1, chr3:202759318..202761276, Cluster 27
agttatttattgacgagttacaacttgccttctgcacattagtcattcatatagttaactagttaacaactacaaaatgatcaactttaatgttaccaaactgacttatacctatttgaatgtcacgttcactgatgttgaagttttctgaacccccaacactccctgagaacattcatcaccttcacgtgtggtagttttgctctgtgcatcacgtcaatcatttcgatcatcttgagttcattgatcttgtgagtcatcatctttttcatgatcctaggtgtttttgttagttcatggttatgctctagaatgattttttttgaaataatacctgtaagatttttaaagctggtctataagccattgtttacagtacataacaaaaataacaactctgtcattatttacctttcaaccacttcaccccctctagcgatgcagaccatggtgctgcagttttttttaaagttttttacgttgcctatctgctcctaggttgtttgttattctaccttggaaaacacactctatttattgcgatctaccaccattcctcttcctgtttctcctaacaccaaaacctgctgcatatgtcctttaaatttcgagggcttccatagctgtactaaagtgcatctccaacgtcaggacatattttttgtccatgcttgggtcatgtttcattttgcaacgaaacaaatgatcattcattttttttggaatgcaacatgttacacagttactggttcacaagcagatatactcgtgtatcatcatatgtttttggttcgaaaggaaaaataactcacatgcattataatacacctggtggagtaattagtgttttcaagagtaatgagtgtttgttctggtacacctagtggaggtgtcaatgctgctatgtgtctcaaatgatctgttatccacgaaggactcataattgtgtctagtgtaggtgttttgggcttagcggttccatgtttgttgcatcagcatcggacataataggtgaggtatgtgcagtaacagtcctgtatacagcaaggggcatgggtgatacaccaattggaacatcgagaaccatatttcgttcttccatttttttctaaaaaacatgattgtggaaacatatttaatcatttatatctaaattattaagaaaattttaacatattgttaactttcagttacttcataagttctgaaaatacagtattccataccattacagaaaaaatcattcagtcattcgtgctatataattaaggtattcattataatacatttaacttactaagtcattgaggaactagaacgtttagtcattcatactaagccattcacaaaaaaacatgtgatagtatggctcatgctaagtcatccattgtaagttattcgagataggatgtagagatccgtgtgatttggtagatctagaactcatgcacgttgtggaggagaagcggtctgtgggcttggatgcggaaggaggttgtgcggagcttgcaataggagccgacgacgattcacggggcgtagatccacgacacgcgcgcgggggggggggggggggggtagatgatgatgcacgatcggtggcgtgtgttccgttacggtggcggtagacctcaatgcaggatgggggcgcggatccatggcgcgggggttagacgacgatatagataggcctatatataatgtgaccaggataatgatggcagagtaccagtcaatccaaaagaagtaatattttcaatgcaagcttaagatattatctcaaatatcatgagaggaaaatatgttaggcataggcatatgtctacctttttttgctggttgatgtttcattattcggcacagtttgtacgatgatgaaattgaggaccaatagcattatgttattattttcttaggtggataatacaaacaatgatcaaagatgaacgtgctctttaa

SEQ ID NO: 4410 - DNA, 1515 bp, Zea mays
  misc_feature (1)..(100): optimal_loci_127306_G1, chr3:211939600..211941114, Cluster 27
atctcctttaggtgcttctcttcacgataaccttcatgactgcaaacaaacttccaaaggtcagctcattgtggcctcaccttactcaacatagcttctcacactaaatccttttctaagaccgtgtttgttatacaactaaaacccttctttattagcaaacatcttcctaacactttcatatactccagcaaagactcaagatccatcattttctcctgcatccatcaataacattaaataaattaaaaattcatagaacaaattaggtaaattgaacaaggtcatgggtactatggagcatatggtatgtgcacattcatttggcatacaaaagcaacttgcatgaaccatactaatataaaccattaaaacgaaagcatggcactataagtatctacatgaacattgattactgtataataagctgcattgaagcaatttaacagaactaaaaatctagaagaaaacttatataaaaagaatctaaaaatgaaatagaaccaaacaattgaatctgaaaatttaaataaaatggctaaaacaaaaaaacattgacaacaacaaggatttgacaacatttaaaaatgtcagatgacctaggtatgataacatttaaaaatatcgcagaaggaaatttgggtaggcatgacaagaatcaaatgaattggacaccaagtgaagaagagcattctaatacaaaagtcatgaaagctaatcatgactttaattagtgtttcggaattgtaggaatggctacaatggttgtccaaaagttttgctccttgatgagatgctacaaactaactacaaaccaagtaaagagatactagtgtagcaaccagtagaaactgaaacatccaaaataaattcagactaaataatgattgatcttctaagtgataagaggaattattgaaggttccaaaaaagcaacataacaaaggctagagcaagggaaataattgggtaagttgttctgacaatcaacatagaacatagttagactggaacaaaagggacatagaaattcaaaccaagagctatagaactgaactttctgaacctaatgtttaagtatccgaaggcaacaactctatctgcagaacacgacaagctaagaaaagtggctcaattgcagttctcttgttttcattcaactttactaaaaatttagatacttcaactaaataaaagaaaaacatagagaatggaacaaacagaatcattgtttccttcaagcaccaaacctggtaagataaagcaaatgcaaacccaagacagaaccaaagacaaaaaaggaagtcctacttaagtggacgttctaaaaacaatactataagatagatacaagaatatgtaccttttgggaggaaaaagcagcattgtttttcattgtctttgaattcattattgacgaagtcgggacaagaatttgtaccttgttggaggcaaagtcgggatgcctttgtttgtcgtctatggccgcttttagtggcagtttttgaggtcatc

SEQ ID NO: 4411 - DNA, 1461 bp, Zea mays
  misc_feature (1)..(100): optimal_loci_129496_G1, chr3:222969899..222971359, Cluster 27
tctaacaatagcatgagcgtcgcccaccttcacatcgagcaacaacagtcagcaactacacatccaacattgttgagatgtcgaaactcgaaacacctagatagctcaaccatcattctgtgatcagggatccatcgcaaccatgccctcccttgttgatccattcgtttttcattgttgatctgaccaactctgtgatttattaataatagttagtaggtgccatactagaatgtaaaatctttaaatgcttactcaagattatgttagcatagattgagatattacagtttaacactaatggcatttaagggaatcatgttttctaggtggcagctggggaatataggtttggatgagtggctcgtaagggtttttctcaaaaatcaccttctccagaaatcatttagagttaaatagacaatgtcaatatctagaaaacaattttcattagtgatctcttaaaagatgccctagaaatgatgccatttttagactcgggtttgttgaggcacagtctctagagattaatttatagcgacacacacttaactaagagtattgcctttgttaaaaaatcataatgttctcatatcagatcttttcaaggtaagttttatatcaaaacagtatagctatatatgcgagctactcattttaatctacatataaatttttatttagaatatatcatttagaggctacaatgtttgttacaatttttccatattttaaaatatctttttcgaacggtctctaatacgaggatggtctaggccaagctatagagattaactaatatgatctacaattttgtggctgacatttttatttgagaatatttagatgccaaaatattcattttgaattttcaaacaacctaggatgttcacatggtttatcctaaagttgtagttttcaatatgatctatggaattatatttgagactgttcaaaggcccaagtgttcattacaacctttcatatctattaataatattttcattgttttatctaatttaataacatgctcttatgaggtctatctctgaaaattgttccgaggctaataaaaggaaggtggttttggccaccgctgcctctcaacatggctcatttagacaaactatttgttctgggcggttgggtctttgaatgtagtttttggtgtttgtctacctctagttttttaagtcatgatatataccctcttcattttatggaaatattgttgttttctcctttggtacaagaacgcagaaactagctatataaaatgactatctcaaccttagttaggccaccacaaatggcttgttctaagctaatatttaaagccacataaaggagagatgtgaaaaacctttgagctcgccggaatataagagctaggctcttttctacatgtcctaatgtaagacagacattactcctctttgagaatatgtgaatgtaaatgac

SEQ ID NO: 4412 - DNA, 1417 bp, Zea mays
  misc_feature (1)..(100): optimal_loci_129573_G1, chr3:223295498..223296914, Cluster 27
tctaggtttcaaggggacgggtgtagctctcgacccataggtcgggcaaggcgttctctacagggcatggttttgtaactgacccctgaagcagttagaggtcgggcgatacaaagaccatggtcagtccgtcctgccctcaatccttgagggtcggggatcagtcaagacagaaacacgaggcatgactattcgcagggttgggagttaggtaagacgcgttatttaatgtttatgttgtacctaggttattcatctgacacatgtgtctttagccaccatgttgttggtcttcttcctctcctttgggttgaggcagtgcataagatgttgctcgtgggcggatggtgcggggcagcgtccacatgcaccaaatgaaacatgctaagccaaacctaggatgaatacacttacaacccttggatctttcttagatgatggatgcaatgaggaaagttacaacttggcttgctaaaagaaagtcactgaatctatgttcgcttctcctttaggttttgtgagttgtttcattggctaggctctgagcagagtgagtcatgaaactttcttcatcagcttgattaatcgtagtaaagtccatatgagtcatgtccctaacactaactttatcattcatagttaattgtcatattagttttgtcataaataaaacttgtttagttttaatagagaaattctacgatgatcagggtgcgagttgagacgccagtgataaacttgatctagatccaataagagttatggtagaagaactttgttgtctaagattacaatttaacctaaaaggtggtagagaaacttcacggtctaggatcattatctaatgtcaaagggtggtcgatgaggtaggaaaccttctcttcatagtatcgaattgtaattcgaccaaatgtggtgattggtggggtagaaaactatagtgggtgtttgtagaaaagggaagaagaatttgctaataacaaagcaaaagcaaccaacgataaggaaaggtaggccatatggggttgatgtctgcttgatggatctatatgaatgagaatgaccaagcctctaagcttccctaattcacgagccttttattgggaacccaagcaaggttgttgttcttgtagtgatctataagtaattttaggacccatatgttattcagaagttccctatagcgtggataccaataaactttgactcaacaatactctcactagtcttttttcaaagatgacgagtctcagaagaaaataaaattgggacataaattaggagaaaatgattggggatatcccaaagtaacagagagggtttcccctaaaactataagaaaattttgtaaaaatatataatattaaataaatatgttattaaaatatatttcatgttacatctaacaaatctctat

SEQ ID NO: 4413 - DNA, 2360 bp, Zea mays
  misc_feature (1)..(100): optimal_loci_129812_G1, chr3:224492734..224495093, Cluster 27
tctttgaccatgagcagtttaggtattaaacacaaagtagatagtagagagatgctttgaaaattaaggacagtttaggtattaaatcttctcacacaccgtcgtcacgccgatatcatggatggagggagcctaaggtcgctcaacaccaaacattgagctgtatttttgtatttaggaggagtacgtcccgttaatttgtagacaagtgagtccaaaataactttctctacttaactaaacttcacaccgtcgcaccatcaccatatgtaggagtgagccttttttaagttttatcgtaaatttaatgtgcctcggtccataaactccaaatttagtttcagttaattgattattgcctggcctgctgacttttcggttccggtaccagtccttttgacggtcctttcatgttaatatatccgtccctttctttctcgatcaacacacatgttgtttagttatatttggaccattgtgttttcagcaaactaaagaaaaaccaggtttcagattgttccaaaggagtaggtgttgacagtctccgccgggtgatcttcgagtctactttcctataggtaaatatataggtagctaaaaggaacaaacaatacatacacgaatcgagtcaaatgtttgattttcttggctggtgaccggaaaagtgcttactcctttgccttcgactgagcttctcctttaatttttcgcattcagcgtgtttgattgattgattcaaaccggttatttgatccatccagttcatcagttatttgatttcaactgctgtatcgatccaataagcctcatgtttgactctgatttgttattatactagtagctcacaacaacatggccggtgcgttgcattgcactacagctaggaaaataagtccttcctttcatcaagttaattagagcgactggcgcgccatcatcaacttatactatatgtgcttgacaaaaaatggcttgaccgctgattcatgtcattttcatgactatattctaggtgattttaataaagcaccttacattcgcatcttattctagatgattcatgtttacaaaaaaaaaatgcagttttgtggttaaataaaagaacaatagcagtagtatgagcttgtaaatgtagatgtttttttaaaggaagtgcctaacgacgttgaaattctatgaggttggtttgacattaaagctggtcatttgcatgtaaattctatgaggttggttttacatttgcatgtaaatcattctcctgacgagctgaggaggtagcagagggtagaaatggttacatgtagatcatgcggtagctaggcattgccgtcatcgtcagtgactagcgagacggtagtatgtgtgtatatatatatatatgctcaactactgctagtcgttggctgtctacgtcttctggttaaatttgttattgacgaaggtgacaacccccctcgcagccaatacgcgagtgcaacttgctccttgattgattgatttctactgcgatgagatcaccgatccgggcaggtgaagagtggacttgaacggaaacataatccacgtcgttaattaccaacccaagcttcttcgccgtttcgacggagagcctcacatgactgcagcagctgcaggcccacgttatagttcacgtacatccccagaaccaagcttccccagatgaaatcatgctctctttttttattcttcttcttcttcttggaaaaattacagaataatgattattatttctagcccgacggtgaatcatcgtaatccgaatgtgcaagctgccaagtcatcgatcggagctgctgctgccccgtcacgatttggacttttgactctggtcccgcgcgcgaaccgtgagagaagaggaacgggggggcaggaaaggattgaccggcgagtggccgagtggtaggtggtcaaaactttcttgtgtccagaccacatgaggggcgaacaggaacagatcaacccggaactgcgagcagtctcttgaccaatcatctcatccatcggcgtctctcgctcgcgcgctgcagcagcagtagtaggtgcaacaacccgaatgaacattgtccggtcagcgaagtagtaaactgagcatgaccccagtactagtactgtgttactctcgctgaccaatgatcatggtttgactgctgctcctattggcaacaagtagagatacataagatgcgacgaaacggacagcgctggtctaaaagtcgttagaaaaataagcaattctagtattttaaaaaaaatctagagaaacgatatactgacaatatatcggtgacggcagatatatgcatgcatataccatcttaacgcgacgaatacgtatgtga

SEQ ID NO: 4414 - DNA, 1554 bp, Zea mays
  misc_feature (1)..(100): optimal_loci_130405_G1, chr3:227273997..227275550, Cluster 27
gaagcaatagtgccgaaacctaaaaattcttccgcccgggacaatggtgctaatcacgtttgattattcgctgctgcacggaaccacctactacgctgtttcaaactgagaggtattttggcgttttggttgttacatacattgtttttatcatgtattgtacctattcaatgtttagacatactgtatatcaaaatgtataataaaaaaattatttatctacaaaaattaaaacatcttgcagttttgatgattgaaggttgatacatggtaaatttatgtactacaacgaagcaaagaaagaaaaaagagaacaaattgttgtctaaatttatgtactacaacgaagcaaagaaaaaagagagtacaattcaactaatatggtctccaggtcgatcttcgacgatgcggagcaaacaaaaagagaacaattcaactaataatgcttttatcatgtgacctaccgtaagcaccaccaccagcagcatcctgaactcacttttttaaagtagtgaaaaagataaggacaatgttctggcatctcatagatgttggtggacttggaaccactgacctcagatccgagagccgtggttcggcacatcggctgctcccggcttctctttagggtatccacctagattaaagtggattgagtggattttaattcgtaacaaaccaaaaaatttcataattttttaaattccctacaatctatatatggctaagaaatgaccaagcaaggtcttagtttatggatatttttacgaaaccttaaacgcatactatgtgcctagttagcaaggttatataaacctatgtgattagtcaacaaagaacatcaaaagtttctacgcatactagtgagcaaagcacataaaagaccaagcaaaacacaaaactagtactacactaattagcataaaagttcctatatatggccttatagaacgaaaaataaccaaacacaaactataaaaaaaacattcttagaaaaaaaaacaaataatcacaatcaggcgccctctaatctagcatataacctccaaccatgtcttgcaaaggtctgcatagctacaatctctaaagatttacatattacaagaacctcttgttgagcatcttctttttgtaacaatctccagaatctgaaccagaatgtttctctaaaaagcacctacaagattgatagaattggtttaaaagtaaaggccacgtcatggtggtaaagccaaataaaccaaaacattaccttaaggtttgatccattgatttttgtctcaaggtttgatggtttaccaaccacttgatccctatattaaaacaagtatacggctgtcgtcgatactcttactaatggtgagcgcacaagctcactctctccacacaaagtgtgttcgcataagagctctactgtgtcgtttagtggaatccggatgttccgaagtgctgtattaaaggtaggtttttttttttcaaagggatagtgttacacgtacatctctcactacggatggttacaatcgaagccgtacacagtattagtgagaataa

SEQ ID NO: 4415 - DNA, 1548 bp, Zea mays
  misc_feature (1)..(100): optimal_loci_130688_G1, chr3:228641347..228642894, Cluster 27
atatgctacaacagtaataaaagtatagtatttttacaccaacctcaacataataactgaaggcgagcttgcatataagcagcaggatccagaacgtagtatacctggttttatttaaacaaaaatagtattagatacagaatgataagaatggaaagaataggtgacaagaaaatgtgatgtttacttaagaagtgagcaagtgtcttcatacatgcctcgagcaacatataactttggctgattaggaaaaaagatttgtgagatgttatgtataaacagttctgctaagaacttatgtaaacaaaaccttacctgtgtccaccataaaaggaacctaataatgcgagaatttgagcgctctaaggcccgtcgaattggtagaaacatgaaaaacagggcactgaatatgtttggtaacatgtaaagggcaacagcataattataaattgattcattctgcaaattttgaatccaattgctgagaaacttcacaaggcctgtgggattttgaatagagcttgagtacgtagtaggaagaattatcaaccaggcaacagctacagcaaattttaggatatatcttatcctttgtgagcactccaggctcttccaagctttccagttgagaattaactctagcgtggctgaaaaggtttaaagaccaatttcagaaatcgtattgcatttgaagcaagggccacagcagcaacagatagtattaagactccgcatacaagtcaagattaataaaaacttggttaaataatgcagtatgagaaaaaaagtaagataacaaatgcataaagcccctggagtcagtctgtaccttgaaggaagttcagaaatgccgctgttataaagattgtcaatacatttttgaaaacatttggttcaaatatagaagaaagtgacccagaagggctccaggcaatgattaccatggcctgcaagagaagaaaaacagattatgtggcacacactggaaaaatgaacacaaaaacttctgtgcagggacaaatgccaccattacctggaaccccaatataaagaaggcccacatacgatcaaaacttctgaacatatgcaaaaatgtacgaacttcaacaaaatttgtttttgatgcccttcttctcctaatcacgtgaccatgttgctgtagaacagctgaagttagttccatcataacaccatatatactttattctgatcaaatttccttcagaaacaggcatatgaactcaagaataagtaattgcaattcaatctatgtttctttgttgctttatctaattacacattttgaggagcttataccatcaataagaagcaatcgctatatgacgtctgaaagcatgacttacaacaatgccaaagaagggacatcttattccaaaatttgctattttgcatggcctgggattccttttcgcactcactccccaaccaaacaatacaagcgagggggatgcataatgcacgtattcatatgatgcaacttcttcatagtgagatttgcatctattgaggaactcatgtgtctagata

SEQ ID NO: 4416 - DNA, 1565 bp, Zea mays
  misc_feature (1)..(100): optimal_loci_130785_G1, chr3:229303481..229305045, Cluster 27
aaataaactagaccaaaacaacaatcaaatagaatagccctatcctgaactcatgctgcaagagaaaacgacaccagctgccacaacataagtacttgaattagccctgaccgtattaaaggcagcaagaaaaccaatgctctcaagatgctttgcctaatatataacgactgttgtttgaatcgggagcatcgtcgtagcactattcattcatcaatttgccttcctgtctttgttggtggagtatatcacatatattaggttggttgcagggaactggtgatttgttgagccgctatatatgagtacaccttttacatgtacttctgagatcattgctgaggtgtctgaagactgaaagctaggctgcgtccagtttctgcatgaagttcagaaaagaagggaaacatcaggaagaactccagggaaagataatattgttgttttccacaaagatattatgcaatacatgttgaaacgattgaaagagacatgaagcacacacgaggcaaaagaaatggccacacggaaaccatatatagtggcttatttgggagcaaaaggctattcaatcccctctaatccttctaaacacctcttaggctatccctactagtagcaccctgttaatcatctaggcgaagccaatgacctccagaattgctggtgtggtgtcagtttatttctaacgggtacttgatttttcaaattttgttggtatcagttgacactaatgtcaagctctacctccaccatatccatctttctatttatatgtaataaactctattttacgaataatagaacagtatttttgaaggcggcaagaaataaaaccaatgctctcaagatgctttgcctaatatataacgactgttggttgaatcgggagcatatatcgtagcactattcattcatcaatttgtcttcttgtctttgttggtggagtatatgtatatcacatatattaggttggttgcagggaactggcgatttgttgagccgctatgagtagaccttttacatgtacttctgagatcattgctgctgaggtgtctgaagactgaaaggctgcgtccagtttctgcatgaagttcagaaaagaagggaaacatatcaggacgaactccagggaaagatgatactgttgttttccacaaagatatgcaatacatgttgaaacgattagaagagacatgaagcacacacgaggcagaagaaacggccacacggaaaccatagtggcttatttgagagcaagaggctattcaatcccctccaatccttctaaacacctcttattaggctatctctactagtaggtagtagcaccctgttaatcatctaggcgaagtcaacctccagaattgctggtgccagtttatctctaacgggtgtcatcaatactataaataatatttaaacattattttacacttgatttttcaaattttgttggtatcagttaacactaatgtcaagctctagctccacccgtatctatctttatatttatatttaaactctaatttacgaataataaaatagtatttttaatgaccata

SEQ ID NO: 4417 - DNA, 1668 bp, Zea mays
  misc_feature (1)..(100): optimal_loci_130888_G1, chr3:229982246..229983913, Cluster 27
ttcgggacaaatataccctaaacctacgtaacttaaagtacagatagatctatagttgtagaaaaacaatattatgcccgcaattgttccatcgtttggattggatcgtccaaccatgccagattgcatgcacgtgcgcatacataaaaataaatacctaacctgagtttggctggtcgacggacacaaagaccaaatttttcgtgcatgcgcacatgcaatttatgagccacgacatgaatacagtacacaacctaccccttagcatctcaaaataaatatacatcttacatctcaaactatttcaaatctaactggattttaattgtataaaaattatattgacatctctatctgtaaacaaatttattgtatgtaaataatataattgatctatttatccgaattgtgatgcggcacctatagctgaacaacgtacacgtactacagggggaatccgaaatgtgtagtcacggcctagcttcccgtttcccctggaccgctgccgcggcccaaaatagtgcacccacgtcccacggcccacgggccgaaatgtaagcacacatgccaaacatggcagttgtttagccaggagtttatattcagtcttaaaaatagctgcatgcctgtacacagaccaatacagctgccaaattacgatactatatttgtaaaaaacttgacatccatgtacaggtacaagtaacaggagcatcttgatttttttttcctgggtagatcgattggtcatgtcaaagaggaatgcatcgattgaaaacgtgctagtctaagctttgttagcactgggtttctggtgttgtcaggtagtttattagtaccatatttcaaagttaattaagaaagtccattccactttaataaagaaacagattccccatgtttcaatatcttcctcttcttttcttttcccgaatagcacattttgtaaagggcaaaaggtagtatacagctcttcagtcctaccgaagggctaacagaatatcagccagttagttctctctttttgtttccttttagcattgattgatctaaatagcgggctaatacattcttcttgaacaactaatagtagtagaaatttcatgactcacgacctacacagaaatgatatatacaaattaagaaggatgtcaaaaatcctaaaggtatatcgatcgataacaactctagaaaaagtgggatcgagtccacagtccagtaaaccacgtgaatcatggataggttgacatgcagaggacagttgactatttagtacaatgttttgaatcaacaatgctttgttgtgatactttttaatggaacttattcttcttccactagagactttgcccacctgcagcattactactggagacagttggcaatttgcagtcacccaatattggattcttgcattgctttgacaagtttgctattgctgcccatatattatttgtgaaaatatgttagggtgttagctctatcagaaatatgtgacttgtatttacattacattagagaatcgtaatacaagtctatatcggttacaatcaccatatatatcatgttaatcctcaagcttttcatctacacaaatagagaagtccggttggattactatgtatctaataaaatatagctataggggagttcatttctaacaatcct

SEQ ID NO: 4418 - DNA, 2442 bp, Zea mays
  misc_feature (1)..(100): optimal_loci_131859_G1, chr4:3031062..3033503, Cluster 27
taatctatcgccattttatttttcacaagctaataattagtatacgcacaaaaaatttgttaagttcacccaaaaaatcataggataaaattcataatgcaccacctcaatacaccattataaaccactttgtgcatcccttctttccaccaatcttatatcatttttatatatacatgatgacttaaaaagaaactgaaatcaaccactcttaatcaaatagaagtatctcaaatgcacctattcaccattcttgtacatatataccagtagttcctattcttcgttggacctcgccttcgccaccattattgtctccattcattatttgaccatatgtcctattccccgtactaccacaatccctcatgaccttgtcggccaaatttttttttaaaaaagtgcctctaccgccaagaaaattatccttggctgtaaaccatcaaataaattaagtcaaggatagaggataagggaaattatttttcttggtggttttacactcaaggatgattttctcagaggttgactcccaaaaacaattaggaccacaaccaattcaccaaagagacaaagaatgttctaacaattaagtaaattatatataggtagaaaaatagaaagagcaaataaagcaactcaataaaaaaacccttatcatgtggtctagggattcaaactattgacattaggtttgacataaagcacactacataccaccaaaccctatatcaatttgtgacttagtgaattattatttttcttttgtaatcactttattaatcttctaatgaatattgaaatcctaaatgatttataaaaagtttgaattgaaaagttttagatctcattaagtactatgactttggtttacatcatatatccatatgagaccatttacaaattttcaaaatagaaataaactttaaagttgtgagaacttccttggtggtttccaatcacacccatggaaatttgaattaccttggcggtttcaaatatcactcaaggaaatataaattaccttggcagatttgaatagcaccaaaaggaaatgaacactcaacttggtggtttgtaacaacgctcaatgaaacatggagttaccatggtggtttttagactagcaatcatgaaaattagcaattaacatggaaatttagtttagtagttaaaatatgatttttctcaggaccttagaggtatatatcccaagacaagaatgctaaacttttcttatcaatatcatttcatgtctccataaaattattgtccctcaaggtaattcaagattgtagtagtgtccatacatcatctcactaaccaaagtactgagtttctagtcgttgtctatttccactaccctaactacaaaccatgcaactttatagctagcactgtcacctagctaagttgttcaactaagatgcctaacactcattatgttggtcgctactactcaacttcatggatgagtcaccaagtgccaattgggtgcatgatataagtgatcaaatgattgaacaattgaacatttgatttgtgcttgagtaattaaatggcttagtggaatactggtagagtgtcgcaatgtatgtgtgactaactgttcaaatcactaagtgagttgctgagttcctgagtgactatgttcctatatggccaagtgcataactatgtggatggtcgagttacaactagctatgcgattatatcattatatgttttactagttaatatgtgagtctccacatgcatattttcatgctgagatggatcttagatcaacaccagcaagtgctagatctctcaggttaccatggaccaaagaacatagtgggtaaccaacacttaggtttatgggaaaaccactaaatcgtagctaggtgtacttacatgacaaagaacaactagtttccaagcaaactagcaaagaatctaacaaagctctcgcctgaaagggaccccgtcgaggcaattatggtgcccgattaccctaggttggacgatgatccttggacacactcttagtcattggaaaaatgttaggaaaaggactattaaatataaagtatcgattatgtgtcctattttatagggagtaggggcaatcttatcccattgaacaagcaatatagtattattattatgtcactttatagagttttccttagattgagccaaaactaaccatggccctcaaaatttgtctgggccaaatttatttgttaatataaatatgttcttgccactttaagaaaacaatcaatttttgatgggtgacacacatgataagtatcgatccacaacaggtgacgcatgggcttcattactctactaacatcaaagtgaaataataatctattgatgttatattcaaataattaaataattcttcatgagaccgaatcgtacctggttgtcgttgacggatagagacga

SEQ ID NO: 4419 - DNA, 1409 bp, Zea mays
  misc_feature (1)..(100): optimal_loci_132782_G1, chr4:6429363..6430771, Cluster 27
atcgaatagcgcgtgcctgacaaagggccttactagatgttgatccaagaggagattgtagtcctcgcaccattccttaaacacgagtgtttcattctccacaattcttcctcgaccttcttcaatgttaccagattgttctccaagatttcttatcaatcgttgtgtagatgtttgcttttagtgccttatatacaagtgatatcaatctctagaatacattttttggaattttactagataaataaaagcataacatttatgtttgtaatactattaagaacctaattatcaaatgtagtgatgttatcctattgcacccatagaagtaaaacaccttatcattcatacattcatagttccaagatgcttgatatatattgttgatacatgcaaaataaagaaacaatgccacaaaatagaaccaccattaacataatatcattttatgtaaacaactaaaagggattcataaatgcatgcatacatattgttacaaacgaaacaacaagaatataaactctaactattctatgaagaaacacaatacatggcatgcaatgagagactcgaagataagacccttaagactagcagatgaaatgcaaccaaaattattagagaatgtgagttctgctatagtgtcttgcatgggaggcccgagaaagaacccaggttgctatgctccacaatttcgcacccacggctgctggcatccctgctactactgcatgcctacaaaggcaatatataacatggtaccaatccccctagagtttaggcctaggctggctagtggttccatgatttgtgtcttgtcgtagatgtagggagaagaagcatgtgtatatgatgatgaaacgagttgaatcacctgcaatgaatctaggagggctccttgctcgatgacaatctcctaggattgtgctttggttttgctcatctttgtctccactatctccctaaggctaacgagctcatccttggtggtgccaccgaggcctaggcgacgtccatccaagctatcatccaagctatcaaggtcacatattcaccctcctctaggtgactattacgtacacaagtgacaaatattggttgattactactaaagaaccacaaaacatagcttaatagaatgtgataatgacattgtaaaaggttcacttgttggaggatgaggcttcactttaaagcgaatataggatggcatggggtgtgacaattcgattaaagaattggatcattgtttcaaatctctatagttagtgtgtatttcaagttgtaggaggaaagtagtttagagatatattgttttaattttttggtagtgaatctttgatatatagaagtccccatatgttttccatggttagaagcatatgatggtagcacaacgagccataaaa

SEQ ID NO: 4420 - DNA, 2140 bp, Zea mays
  misc_feature (1)..(100): optimal_loci_132843_G1, chr4:6639597..6641736, Cluster 27
gctcataggggataacaaccttcgaccaattcaaatagtcgatcaaattctttctcaatgtcacctccaataaccttcatggtgcctgccaaaaaagaaaggtaacacaatacatctatcaatcaccaaactaaccagccaaaataagcaaggatgccttcgtccatgggagtagtagaaacactattataccttgaggacctatagggacctcaatgtgaaggtcacatcctggagtcttcgacttctccaccttgtccacttgggatctaacaacactagcatccacgcttccatcatttaagccatggctagaccatgtgactgaatcacacttccccactaaaaaaatgctagaaccacatgtagagctaatgatccactaccttgcttggatgagcttttctccacctctccaccccaaaggtccacctctagaaggacaaccttcatggattgactatcactgtcaacctcaagatcattctattacatggtagtctttgagccaacaaattgctcaacagcagcaacaccaccaccaccaccaccatcttctagcatactaaactacatattgcttcatcaaacattagtggcaaattggtcatcaattgcgcaacactttcaaccatagaagatgaccctgcaatcttagcagcagtgcgctctgagtggctttcccctcaccttggtagaattagcctcaacaaccatatcaacgtcctccacatcatcccttgaaggccttagccctcttaaccaagggaccatgagtcatatacttcctttttcttgcatctgttttactagtgttaaccttagacgtagtagccttcccttcattgaccttcttggtgagagaatttgaaagtttcttgaagacctcttagggattgtattttaccttaagatcttcatacacctagatcaactaaggcatgctgctgaccatagatcctcaggtggtgtactctttctcagagacatcccaagattttcgcatgccttcaacatgtgcaaagataacaaaatctatttttcctcttctctgaatacatgcagacatatcctctcaaatgtcatgtcttttctgatgaacctatcaaagggccagactagctttaactgctagaaatgcttcaacctagtccttgactctactataatgaattgcgtaccacaaggcatcttgcagaactcacataagtccatggagccatcttctccatcttatatgctaggatgaacctaaggacttcccacctccttgaatccttcaaagtaaccctagagatcttcacttaaaaccaataccaattctagttgtttgtccaacaattgtgctaaggaaaatagacgtcacacttatcttgcccatagcagtacatcgcaggttgaaggactagttaccaaactaattttctgtagccacacctttgatagtaattttctttggctatcttgcccatagcagtacatcgcaggttgaaggactagttaccaaactaatttttcttagccacaactttgatagtaattttctttggctatcgctaaagctcataatgtgcataaaaccaatcaatgtctattttaagtgggatagattgtccattttctttggctattttaagtgggggagattggctattttaggtggggagattgtctattttaagtggggtagattgtctattttaactaggggagattgtctattttctttggctatcgctaaacctcataatttgcaagaagtcaaaaactaatctttgaaaagatcgtggatgacatagcttacttcttaaacatgattccttttaagattcaaagggcaaaaccttgctccattaattgcgatattttttgggtcttagtgatgacctcaacggcgacatgaacaactacaatgctcaccacccaagtcatatgtagtttttatgtcatccacatctattataaattggagccgtctataaaaagatcattgtagtagtgtgaggtgcctatacacaccattattcatttcacataaatttatcttttatttgtcactctataacccttattttaaagctttacttctaaacttagccacacataattcacgtagactatgcattttgttttatatttc

SEQ ID NO: 4421 - DNA, 1916 bp, Zea mays
  misc_feature (1)..(100): optimal_loci_132845_G1, chr4:6642692..6644607, Cluster 27
gggcatgactgttctcatggtcgttgtggtcatgcctaggcacactcatgtatggaagggacactgggaagtaggttggaggttagtggtttaaaatgcgatgaatgatatgcttgttgtcaattgatcttttgtgactagaacaataactaggtgatggtaggcttcagttatcataggatatgttataacatcaatatgatgaggctaactctatccttttgcataacatttatcttttgttgggtttacatttaattattcaatgcctaatttgcatgaaagttatgtttgtatccaatagaaaatgtaaattacttagttccatcctaatgaatacaatagaaaccctaatactcatgcaaaaaagctacaactacattgtgctcttgtggttcaaattgagtgcttaaagagtagtaacaatagatcaaaagatgaataggatgacaaggtaaactattatctaataccacatatgcatctcattatcaacttattaaacatagatgaggttgtttcccaaaaggtcgataaatatggcctggatctcatgggtgcacgtatggaactcattacgttatatatatttagttcattggaattttcccacaaaggggagttctttccatttcagattgatgatagtcatcgttgccttaaacaaacataatgctttggcaattctattttggaggttttacattctcgagaaagtaaatacataaatttaaatccttattaccaatataattactttgtgcctccatgacctaagtagattgattcccttgatcccataatgataatcaaatttcctttaggcaaagtgctatttcacaaactttgccagcaactagtcaaactataaacaagtttacaacatagaacttgcatgactatatttgtattgaaggtttccacgaggtgatattgattattagcaaatgataatatattgtacgagaaattaggagtccatatgtacttttaggacctctcccaaaaaatacacatattattcaaggatgtaaggggcacatgtggtagaggcaaaattggcctagcaaaagaagagcaaaatgaagccttggctgaacatgtgatgcttttgttactctacaccttcctatcgttacaaaataagtaatattgacctagaaaaacattggatcaacaccaacacataaattaactcaatttgtagaataaaacagaacataattggttgcctttgtaattttcatttttcacctcccaagaaacaaaacaaaactcaatggatttgtagtcatgggagattcctaacaaaacaggaaagggaaaggagatagtgacaagatcatttagaaatacttgatgtggaccatctctttatctccctctattgaatttacttccatttaaaatgacaacaacacataggtgcattgttgggttcatatatatcatttgaagatttggcatgtcattgcagaagagcaaggagaattttgaaatgccataagccatatggcacactaatgacagaagtgcgcgtggtgtgtcaaacatacttatgactataagtaagtatttactttttatacttatgactataagtaagtaagaaatttccatttttagagcctagcaaatgccgacacattaaataaatataatattgtagccatgctattttggagaattatatcttgagtaaatataaaaaattaaagttttagtatctatagaagtatctagaacataaaatttatctctaaccactactatacattttcactatagaggtggttggataggctctataccagtcgcctttttttcatgaggtgcctctatgagtcattatccataattcacaaagccagtatagaaaaatagcatcagaaactctttaaactctaggagaccct

SEQ ID NO: 4422 - DNA, 1730 bp, Zea mays
  misc_feature (1)..(100): optimal_loci_133080_G1, chr4:7304311..7306040, Cluster 27
cagctctccctttgtatagaaagacatgaatctccctgtatatatagaggagcattgtgctcccctgtatgttaagtaacacatttttagttctaattaagtctcgtgacatcataacaatatgtattgtggtactataagcattgtgcgattttttaaatttcataaaaatgataaatagatgttaattaattgagttctaatgtataggagaagctatatagggggaattatgtatttgataaattatgtgaaaatgataaattatgccttttttttttgcatatttctctctccaagcagggtgatgtgaccgttggacataaagatatctgaatgtttcagatatttagttaacttccattaacacaagatataatttggatgatgcccatctttttctgaaacatggaggcttttacatctacatgttcctgcagaaaacatctcaggatactgttatggagccatgaaagagtgactcaacttctaacattcaaattctgctgtcatctctattgcagaggaccgtaaaggccttcactacttaataacatttataatacctgctgtttcatcaatagaggtggtgaaaacatgtgacactatcccctaaaacactaaaatgcttagtgatttctagagagatacggtccatcttcggtgcatgtgtagtggtggtatggtcaatgagatctgtaaccttgtaactaaaaatttacaattctcaaactacgacctcaagatttatactaatacctaagattattttgaggatcaagcttagttttacactaatggataatggggcttctgttcaacaacatttgttccgattgttttaatactggtactgatactagatttattaccggtttaaaatatctagcccgtatagataatattagcactggttgaagcaaacaacatgtactaatattaagttttttagtattgcttggaggtttgtccctcctttgtgagcagtcaaaggttgaagcaaacaacatgtactaataaatatgtttttcattctcgccaaattaattaaatttcccgtcaaaatcagtttagcactggttcttctaaataagtaaataaccagtaggttaaagatctagtaccggttctttgctagaggtgtcccgtataagtacaaccattcttcaaacctttctcattcatgagcactgagtgtgtcactaaatgttttgagtatgcgtgtcgagtgtgatgcacgtcttccagtatatattttacacactttaattagcatgttagattttgaaatataaaatttggaattcttaaactacctgagatggcaacatgatctcgataaatgttgagttctcaatatgatctatgattttgtagcggacaagatttttattttaaaccattcagagtctaaatatgtattttttattctcatattttaaaatttgcaatggactttggatattgacataatagataccaaagttgtagtggtctacatgatatacaactttggaattgatatgtcttttattaaagttatctagagagtaaagtattccttttaagttctcatattttatatttggcacgagtgaccaaggattatgttaatgcgccatctaaatgattggcacgagtgatcaatgagtgttttactcgtacgtatgggcggcatactactctacggattgagtaaatcttaaaaaaaattaatagcttttgtaaat

SEQ ID NO: 4423 - DNA, 2331 bp, Zea mays
  misc_feature (1)..(100): optimal_loci_133408_G1, chr4:9643776..9646106, Cluster 27
atatcattaggtatgactccaagataccaagggtactaaagaaatatgtagagtagagacaaagcgaaggatgtaggctagaggccactgtattgacgttgacttggctacaagcacataaatagttaatagaggtttgggtcacacgattttattactctatgtcctctttgcggtggatgaattgatggaagtggaggcgaagtttacatgatcagatgttgtctgagctagaggactaactagctacccttttacttcggctctggtgaaagttctagtcttaagtcccaagattctggacatatcgtctaagttccgagacctataattagccttcatatcctttttgaacctcttccctttttacttgttctgtattgctttactcctctttttatttatagagacacaatgaatgtccaatcactcctacttatcgtactcgtagagccatacatcagtacaccttagtcgtaccacaatacacctttactcctcttagggtcgtccttctgagcccgttccacccatagccttcctgcccccaaggcagtcttgcattggagagatcgagggccactgtgcgggccccttgtcctgtagaccccctagacctatggtctcggggggcttggtctctgagttgcaagaccctgatgatgtcaaagctagtacgagtcaacaagtctcctttattttgataagatttgaaacggcatattgctagtatcttgggctatacatttttatagacgcccataacaaagtaatacatgtagaaaaatcaaaatgttttgtaataatttgaaatgaaaagagtatctactatgatagtacaccgtctattccaaattattctaactgttttggagaggaagagcattttaagtttgaccaaaattattataaatatataaaccatccaagtagcctacgtgaaactagcatatgaaaagataaacgtgttgcattgataaccgatgtcttccgcacgtgttgaagctaagcatatgccttttcctcctattattaaaaaggtcattctcaataatagttttataaaaggtttgtttttattaaataatgtattatactattgacacggtgaacaatatatggagaaagagataaaaatagatttcatagtgtgaaatcatgcctacactattatctagatatattatctcttacatattatctatgaaactgtaccaaataaaactcttcactatgagagactgtatctcaaccaagattttatttttttttcttgattgcatggcatcttaaaaagaactcccattctaataacaagttgatctctttaaaaaataagtccaaaaattcaaagtggaaatcatatcctatacaaaataatcatctcagtctgttgacttcatttgcatcggaattgcaacctgtaaactaacacaacagtaagtgtggaaatccctatcagctaataggtgacgggaatgaggctaatactgaccgaaattagtaattttagtaggtaatgtgataattctcgttggcttctagctgacttgtttttgtcgggaattaactaaaccccgtcagttggggactggagctaagtaactcttatcagcctccacgtccgcatctagtttgaacaaactcggttttggatgggtcggccaagttacatcacttgtttttctgtcaggactctaagtgaatattggttttaactgtcaggactctaagtgaaatattagtaatagattgttggctttaattaatattaatgtctgtttttcaatatcggttaaagtcatcaattgatactaatctctcgaccgtaaattagtatcggttgatgggttcaattaatattaaccgcaggacgcggccgaggaggatgcgtggtggatcggatgcggataggcgtgtgctgttgcggcggtgctttcacggggaccggcgacggatcccacgtggccgcgcgcgctgagccatatagctggctagctgctgtagtgcccgtagcgccgaggcggcgactgcgtgcgtgcgcggtgggccagctgcacaggcagtactcccgccggcgtcatgaagcgggaccgccgctcgcacaggcgacgtacggcccctcgccgacgccgaccagccgggcgtgcgtcgtctcaaccgttggcccagcgcggcggttgggcgtgactgtgctatggtcagggagaaaagaagaagaagaacgttgatgttgttgcggtggggcgcacgggcagctagggggtcgtcggtggttgacacgtagtacgcgtgtgcatgcaccatcgtatcatcgatctcactcgacat

SEQ ID NO: 4424 - DNA, 2852 bp, Zea mays
  misc_feature (1)..(100): optimal_loci_134993_G1, chr4:16797786..16800637, Cluster 27
tattttctcctccatgtcttctatacttctctacatggaaaacctgtacataactcatagaatttgttaaataacatgaaattcgtatatgaattacattttttaacattaaatgttggtgggcataatgtgattttacgtatgaccgccaacaaaatgattatgacatacctaggcacagtactggggtagatttaaggtccctctaggaagggcagtagtatttctatggttttgttgttatctacacgttgaaatcctctacatgggcatccgaataccaaaatactatagttaataatctctctgaggagggcggtagtactgcctctatgactctattatagtatacactttgaaagaactcctacgagcatttgaagaccgagtctcaataactcggtcatcaaccacttaaagaccctccatgggcagtggaaggctaggtccttgtaactcagtcattcgttgaaaaataccttccataggtgtagtaaggctgagtccccacaacatggttctctctcaaacatccctccacgggcatgggaaggtcaggtccttataacccaatcatccattgaagggtcccctctgagggcatagaaaggttgagtctccatgacacggtcatctctcaaaactccctccttaagaactacaaggcagagtctctataattcgctcatttgtcaaaaaagtttcttcggagggaactgccatcaagttcatataactcaaacattcatttgaaggctaagtccacaatacttagttatttactaaaattccttcctaaggcaccaaagtgttgagtccatgaggctcaaccatctaatatcactatccatgagggtcaagtaatgttgagttgtcaagatttagatatctatgacatatacctatgattttgtgaaactcaaatgtttacaaggcacattcgtgtaagcatcgcttctcgcaaagcaaacatgattcaagagattgtggaaaatgttatcataaacacaagctagaaagagttgtatgttacaaaaacatacaagttgttcaatcattcttaggattacatcagaatggaatcatagttgaatatcaagctaagatgtaatatgggttgcagctggctagacttccttcaaaactccattaatcttttcatcattaaagttgtttgtaagtccttcttggaatctagacaattccatccctaggtattggaacatggtgatgcctagagcaaaggcactgacttcttccaaatagatacggttgaattccttattctaaatagtaagattgttcaacctttggatgtttgatgaactagacgaggacttggaaaggtacatgtagttcatcatggctttgaaccaggccttgtagagtttcagtagctcttggagttctaaaatacaaggtttatttgctcagtttatgaaattattcaaaacaaggacaattggagccttactctgtttatcttcctaggctaagtcattagcctccatggccaagtccagcctcgcagcaagctcttcattgacaaacctatcttggtttatagtcttcttgaaatcaaccaagatctattttagcttggcaatcttttatttcatatttgccttctctaccatcaccgattcttgagcctatgtgatagagtctagcctcttagtcaggtccttaaccacctcgatcatcatgtcaatggattataagcaaagcatgtcaggatttgtcatcaacaaagtatgatcatgtacattaaagttcaaccaacttggcctcgaactagtcgcacagcttttagaccatgttaactagccctgagttgatttccttgtcctttttctaaatcttgccgagtggactcaactatttggagcttcttatgtgttgacatgagtagcatggatttcttagttgtctcatcgaagatttactctcaatggaattataaaaaatgggaatcttctcaataaattgagatccaagagcatatccaatggtgtttatggaaatcagtggcaaattatctagccttctctagctgttgcctgtctttttccaggtcaatattcactagcaagtattgtttgagtgccaccaagagctctagttaatcaatatcagacataggggcctttatgtcgcacaagacctcctcaatgtttgagtctacataatagttggcaaccctaaggttatatcgaatacacaaagactctactagcgaatgatgaccaagatgagttacctcttggctgtttagcaatagtatgagaactcagcacagttaggggctcgattacagccatcatcagctcagtcacaaccataacaagagcaacttagggtttgactagaatgccactgccttagtagcagccataatgagagcagcttgggctagggaagtgtcaccttggcatcgttatctcagatagctgcactaggaccaaacccttaggggctctagaggactcgaccctagtacacttgttagttgcggggttttggcacggtggcataggacttggctctaataggtgtactgatagtcgagcctgcttcaggttgcatagagttcaccttatcctttggtagctctatggactctctatcacatttcatattcatgcttagaatcattcttattaaagaaataataactatgctctagtcgtatcttgcatacttcttgatatttctcttcaaagaagtagaggatctcctctagagctcagtcttggaggtcaatcatcttgggctttggacctgacaatagagctagattgggggctggttgttgtcttttttaccagttccaggttgtccccttggggatg

SEQ ID NO: 4425 - DNA, 3570 bp, Zea mays
agattgttggaaagttcattaacaaagaaaataatttgatcgttgagatctcatagttgattacaaatgcttcaatcatgtttttaacattggaaacatttttatggtgatcggagtccaccttcatcttgaatatcaaagctaggtatgtcctaggcaatcgtaaacaagagggtactactagataacccatgaaaagggtgactaaaaagtgaagggatgagcttattgatgttgttacaagcgagaagaatgagagtggatctaaggaggatttaagataagttgtttgcagtgtggtgggaagttttattgcaaatgcttttggtggtggtggtgtttcgttgatgttgactccccttgattatttgatttgaaacttgatgtccactaggtctttgggtgtacttgaaaatattgagagtcagtgctagaatgaaagttcccttaaagaaggtgaaatgcctataatggcttcacaaagaggacttggtttgagtcctcaagaaggtagggagatggcttcaccgattgaagtccaagcaactaaaggtgacacttcattgatgtttttgcaaaacctaagcatgctcatttttagcaaatttagagctatagttagcaaagatgttccaagaaaagtccatgttcgtaaaggtaccattgttgctttcgttaacttcaacaacaatgttggtgtgtttgatgatgaggccgaggaggcatgagttggctggttaaatgattctaccattgatgttgacactagtacttgagtttctagttgactcgatgaaggcattactactagtaaatcttcttgctggcttagctttgaaattttatttattgtatgtgaagctttagttgatattcctcctagagttgacactgaggcctataaatgacaccttgagttttactagagtcaaggtgtgcctcttgatgtttttaaaattattagcattatgttggacaagttttgggttcttttgaagactgggaagttgaagttgtccaagtgcattgatattgccttcgtaattcctgatgctgaggcaaagcttgctgtgaagtacactctagagttggttgatgcatcttttgtgttatcatataaggtagtgttgatttattttgcactgatgttactttggtcttttattatacttaaggaattcttttatgtagaatactttgctttaatgagggttgaggaagtctatcaaagccagtgttgaggcttcgactcttcatgagaggaagatgatggaagaaatggattcattaaaagctcaactagttgtgaaaaaacaaagaatttcttgtgagaaactaggcataagatagaaactttgctacttagtgcttgtatgtctttggaaagtaaagatggagagattaatcaagtgaaatgacatggaaacgagcatagatatcttgagaagaagttggacaaaaatggttcctactttctttactctgctattcatctttagaagtctgagtagagattgttaagacaagtttatagcgaagctcgaagatgcttgtcgagagatgggtgactttaactctttcttcatattctttgtcataaatatgaagacctaccaagcgtgttacaaatggcaattgattaagctacatgtaatcgactaagacactcttctatctaatgaaagaagctaatgatccactttattagcaactcttagatgaaggatacaaatttctacatatttagcctttgagcaagttttttttgcatagattaatgagcttggaaagaaatattttcactagtactagaatagcggtggtcgagagccaaggctaaaatatagaaggtaaggtctttgtaactttcttgccttccctgttttttttgtttcctaatatattttattacaactgcttgaagaggagctagttgtagccgatggataataaaacaagatggaagaatctactgcaacaagagcgagggaatctggaaaagtttttgatcatgttgtttgatttgttttttaattatcgagggtcattggtgtgaagactctaagtattctaacttttgtaaaccctatgtaggttccacctatcaggcctaggcagggtggcatgaaagttatgtcacttttattgtgaaagggcaacttcatggttgaacctttgtgtaggattgaatattgtgttaataccaacaaacctttgttcgagtctttcatgatgcgtacgtgttgagttttgtgtttttaagtgatcgcattatgtgtctttgaatataacattgagttttcttagactgtcacaaatgttatatgattgtgtttggcaaagctaaaaagttttatcatcgcattgttgaccatggtaagactattattggcaagcaaactaacctagacatgagatggtagtaacaaactccattggataaaatcttcatgtgtgtgaacaatatatatcgggggtacttataggcccctatctttttattacaattaaaaaaagtcctaattacacttgaactgtgaagttacaaggctaatttggttagtttatgtctttaccatccactgagtctttgttgataaataacatttgtaggtgtgttttacttcaagcgcggattcattgacaccttcacttgaatgtagggagatgcaaccctttctattgaagctttgttggtcttgtgccctcatgcaagctcttcataagtgaaactttgcatgtattgaggcttcatatcatctcttcataagttttcgagcgtagaatgaaagatgaccgaataacttcaatctctgtgtggtcattgatttttttcaatgtgaagttgattatgcttgtcaatgtaaaataacaaatgtttgttagtaaactccaaaatatggagagatgtgtttacttatggtgaaattcctaatgatagccctcgcaagcgaagtcctactccaaaggtctaaaccccacgaaatcatgatttctagtaaaggttataacattgtccctgatctttagagttgtatatgtgactaaaagatttcaaattcataattatgaagtttgacagtcatgggctatgaaaggaatgtgaacaattgtcttggttgaggtttcctataaatacagtgaccatgggttgtggatttactggtttcctctgcctgagtagtcttactgctctgatgatcattgcaaagcttttatgtgaatcttgtcttcttattatatttgcgatatctagagaagaacttgccttcacaacctctgatggtcctgaaaaggatttggcgtacattgaggtttctaaattagagttgattgataatgaaactaaatctcttaagcttgtcatatatttgatggatgaggctgttcttgtcccatttcttcatacaaggtcgctggtatgggaccaaggtcgtttgctagggagcgaagtggtttgaaagccgaaggcaaaaacatgtttagtgttcaaggacttctttattttcacacttcactttcctatgtaagatattatggaagaaattcttgatgcatataacatagaga

SEQ ID NO: 4426 - DNA, 1584 bp, Zea mays
  misc_feature (1)..(100): optimal_loci_143731_G1, chr4:68413262..68414845, Cluster 27
agctagctaatccactttcctccttttagcgttatatcttctacatgcatctagaaaataaaaacgtcgatcatttttttaaggtcaacgggggacctggttttcattgctttgttcttttcactccataggggcataacagtttattacatagccagcgatgccggattggaaagaggggaggggggagtttgtgtggatatttcagcttacatcctatcactcgataacaccactattcaggcctctcgcacgtctgtctctttgcgcccataatgtctgtagctccaattcacagcttccatgctacattgttgaagagtctggttgatggaggtggttacttgtctgaacaccagcgcattccggcgcttctagagctaccaacagcgtagaacaatgccggtcatttttttagaagacaccctctagcgttgcctcctaaaatccttaatatatagagtggtgtatgttgcggatttacaacctttattcccctttcaatgcaagagtctagaatccaagagatcacttctctctctctctctctctctcaatatacatggatgagcgctggcggcattgtttgataactcaggcccactagcttgaacagagccacgtattgacctattgaggaaaactgcgtgcatgctgcccatgttatttcgagcatctcaatacagttccatcacaggaaagaggttgcatatccctatcgaaacgaggtactgctgcatgctgtcatcttcaaacattcgacaacgagtttttatttcctggaacgtaaaacgctcgtgtgcgcttgtccagaattcaatgcaatgtgggaatcatactgttcggtgttcgcccgattggagaagcacatgtatcttttgaagaaaaggctagatctgtatacaggagctagcgaggattggttacgggtgcttgtccgagattcagagatcgacgactggcgcgcgtgcagtggcgtacgtacataccatgggccaatcattctcttgtagacagtgcaaagccatgcatgtcataggctgctacacagcacgatgggtcttggcactttggaattcagatcacactagtggctcataaacaatcaatactgattctttaacgtgcgtagtttcagaatgtttcaccttgtcgaccaaacatgaaaaatgtgttcttttgtgtttgtgttacttgttctaccagatatatatgctactgtctccgtttcagattttaattcttttagtttttgtatttgcagtcaatgattctctaagtatagtagtacataataaaaactacaatacttgaaaaaaagccaaaatgactgaagagagaatatatttggaattaaatctactttgtatagggagattttttggcactcagcgtcgccaccactcttaggtttttgtcctgttctgagataaatgcgaaaatgaaggctagccatttctgttattcctacctagcaagattcaacaatgaaccaaaatgttattagtgatctttactgaaacaaaggtaacttttgttgtaggacatttaagaaacgtggtacacaaaaggaaactaagaagt

SEQ ID NO: 4427 - DNA, 1602 bp, Zea mays
  misc_feature (1)..(100): optimal_loci_143779_G1, chr4:68779023..68780624, Cluster 27
ctagtgatttttgtttgatgttgtagatatttgtacatgtaaggagttaagacacaagataaaaaaacaaggataaaagacacgcgaagaaacagtcaaatgggtgctacatagcaacacaaacacggctggtggtacaatggatgggacaccatatgcgtgtcacacgagcagctacaataatagtaacaatgtatccaatgtcgtgccttgctgctgtggaccactggagtgcaaggtgtgcacatgaggatttctaggaagtccaaccagacgcatccagccagacaccggagtggtgcacctagaatcctaatttaggagcttatgaaaattctccaaaggttttaaatgaaaatatatcctttaataagattttctccacctctcctacaatatgtggtttctaacaaaaggaaaagatccttatataaatcaacttatcctttgcataattatatacttagtaatactcactaaaatatttaagaggtttaacgacgcttctcaaaagtgcaaataacggatatagcgggctaaataaggttatagtgtataactttttcctgctaaaacagctatagcgatggctatagctggctatttaaaaccctaatgctaacgaataaggcagagatcctaacacataaggaagataaacttgtaatcctaggtcggattcatataaagcacatatggaaattttaagtttggattgtatgcaaactattaagtgggtgaagtgaatttgcatattccgatatatgctttatctacaactaataaatatttgagtgatcgaatatatcaaacatgaatagaattatacacagatgtttcaatatatatatagtaattgtataaacaaatatatataatttataaaagggaacactaccactctctcgtgcaaccactacgtatacgttgttcttgcattgccaagagatcgatgtgtagaacagctgttaaaggagtgcgcagtgggcacattttttttttctcctgtcatcgcggcggaatcaatttagttaagaaactaacctcatatgcagactaaaatcatgaagtatgtcacggtctatccacgcgcgggtgcaagtacaattacgtttctaaagaatgaacaaagaaaacactagtcaaaaaaagacaaaaggtgcgtgcggaaataattaatatatttgcaagcacaatattcctcataggacaaactagttaaccgcactcagatactaaaatctctccgttccaaaagttcacttgatcacacaccaagaccactcactacgacatagcggctttatcctactcgatcgagaataatggggtcaacccatcctcatctaaagaaacactaaacaacaagcggcgctgcattattacttaacctcaccgatcaggccggcgacttgcttgtgaaggtctaatgccccttatattctgtaagttgtttaggtgagtctactccatgcatggccggtgtcagacgatcaacacagccagcttctgcttggaggcacctggcagagctgtgatgctccatatgccttaattgcctgctaataagactagcttcaacaagctaagggcatctaaagg

SEQ ID NO: 4428 - DNA, 1577 bp, Zea mays
  misc_feature (1)..(100): optimal_loci_14955_G1, chr1:82587234..82588810, Cluster 27
tgctcctaacaccctaccacgtacgtctaaccgagtaaccgtcatgggttgtgctaggtctgagggccccaacattcgctaggggttgacctagaggcctaagtccgcgggtgttcatgggaggtccccaacccatcgggaaggggggggggctcccgagatttattgggagcacttagtttcctctagggtcctaaacattcatggttaagccacacaaactacacaaagtccaagtctgagattacaaggaacttatcgactaagcctaggtggtcaagtgattttaatcctgcaaatgatggcatatgtattattttttatgaaaataagggttaggctaatgatacttgcctttaaaggggttgggctattactctagttacccctatagtttcccctaggacaccttgtaatggaggcgaataagtccctaagacgaggataaaaatatatagtttacatatatggtattggatacttaattatgtttgaaatcttcacaacaatcatatgctcttttccctatcaatgctcaaagtagaaaatttctcatcatttagggccatgtgcgtgagttagtctaaaacttttattgtttctaaagattgtattaagtgtggataagatttattggtgtgttatgtgattttgaccgagtcacacctgtaccaagtgctacctctagggaacatcgttaatctgagggggttgatgacatgtataccctaggacattacctatgcaccctagctaggccattttgtatgattatcaatattctagttatgcatgcaaactatgccaattacaacaatatataaactaacaaaaggatagtctctttctgataagcataggccacagtcgaaacgacttataaccaacattatattatatcggtaataaaaaagattatatattgaattactaaccttaggggcaagatgagtgacaaggggcggtaatgttgtccaaaaccattaaggatgaaacttatgtaggtgctttatatttaatgggttgggtaatggtgtgccatattttgtttctagtcttatgttgttatgcatcatggtttgtagatatcattaacccagtaggttccctcccatgtaggggatagttgattcatactagctcaattgaggatgcattagaggatgagacttctttatcaagggttcgtggcttgacatggcatagatgatgtcagtgcaaggtttgttggcaatccacgacatataggagagcacatcatctccatttatgacaaggtctagatcctcaatgtgcacttgctcccacaaaacatcttaatatgctagtaacatatgtccttgttgtggtgagtctctacttgatggttggtacactaactagcatcacaatactagacctatacttgggtgctacaagaaccacgatgcgctccaactagccatgatttcattgtagtttattttcacgatctccctgttggaatgagcacaagagtctcttaaaattgcttgatcaaagctgacagtattcaccaatagccgctcaatgatccacagttgctccaagcaatttat

SEQ ID NO: 4429 - DNA, 1743 bp, Zea mays
  misc_feature (1)..(100): optimal_loci_15098_G1, chr1:83385774..83387516, Cluster 27
ttttgctgtggatgggatatggtgaggcacttacaaacatttagtagtggctccttagtgccttgatgtcacacacattgttttatgtttttgatttcatgttctatgagatagaggatataattctatatgggatcaaggccaaacatcggttaccctttgatcactatttgtcctctatcttctcctgattgagtaatcatatagaacaggcactatttttggggaactcaactagataatatgtagtttattggcatcagtctattgtcaatgcatgtacaagtggtttagctcttagatgcaaacactaggaaaccataaaaatagctaaggaaagagcaggagtagaacgagggtattcatttggttgagtagttagagctatagtaactctttgagcgtcactatgagactgatgaaacttcataaaaggagtatgaggtgccaccacctatacttctagtgccaccaccgtgaccacatgacttagagttaggtggttctagtacaacactcccacctttctttctctatccactaataatcagatggctaccttgctcgagcatataataacacaaaaaatagttggccattgagtaacagagacttgcaactgagcaactaaggattctagctgagtagttatgcaaagaggtagagaataggaaggagcggagaaattaggctgaggcctagcatcgtcagacctagaggactcataccctgctagggttttagggttttagggtacatttgatcacctgctcagctagggttttagggtccatttgatcacctgctactagcagatagggcaagcaacctttcctatttcaatcttagtctaaagtagataggagtgtcaacaccacccctttagttcagatgtcagctcatgcagcactttagaccttagtggccccagcgatgtagcttgaagtaatttagggctagggtcgttactattatgtgttacaaatttaacctatgacccttgacttctcctcaccaaggcatggtgcatctttgggaaatgctggagtgtcataagttatcacttctttagcacttttgacacttttatccattgtcatgaaaccaactatgtcatcacttagatggtctatccaactccttagtcatatcacaaaagagatctctcagtcaccctagctcttgtgccctcattttagctgctcctctaacaagcaccgacgaaaccatactgtcattggttgtcatcagatcctccacaattggtcacaccacctctaattgatcaactagagtgtacgacaatagctacacgtcagatcctattggtcagacaaaggactctttagatacaaacaaggcacctttcccataaatttcaaggttttagtgcatccctacatgacaatgtctaccactccatagaacccttagtttttggctcttgacgtcaaagggggagaggggagagtttgtgaagcatagggagatctataattgggatctagatttgatatatttgtgtgtcatttttcatattttgtatgcacatttactttatgcattgtattaagccttgttcttgcatgtgtatgatattctacgacaattgttacactcttttatgttcttccatttaaattttatgcaaaataagattatttaatcatgtactcgtgcttaacctataccttatggagtacacgacatggacttgatttttatgaacttgcattcaaatca

SEQ ID NO: 4430 - DNA, 2281 bp, Zea mays
  misc_feature (1)..(100): optimal_loci_151807_G1, chr4:126002468..126004748, Cluster 27
gtgtgataaattgccggagagattatatatgttccttgtagtgtttgaggacgaccctttcttttgggcgaacggtggattgatacctccacggaatatggaagcaaataagttgttgtgtattgtatgatattgtatgtatttatgatgcactatattatgcttgctgggtatacctacattgctgtttgtgatgacaaagatggtatattgatgtttcaaccaactacacttctgataggatttgttaaagaactactgtacttgatgactatatgtattatatacaacaatgggtaagaaagccaacctgatgtagaacacagatttttttgtacggagtaactatttatgtagggttcatatatcaagaatcagcggtatatagtatgtttcatatatttgaatatttctcataattatatgataataaatctgggcacatgagaatttgattgtgtatagtcgttccatggcaccagaaatccagcacatgtaactttggaaggaaaaaagtgtgctatatagtgcatctgtgcatgatacaagcacttcttttattttccaaatgtatatgatatgtgccttggaaccttggagagtggggtgggggcaggcatgttaaattactgatgttctctcaaaacatgtcacatttgatttgaatgataaacataatattaatggcaaagtccattttcaccctcaaacttgcgaataatctgtttttcaatcttaaaccatgaaactgggtaacaaacaccctccaattgtcaaaacaggacaaatttagtcctcgtgttggttttgtatttttgtaaaaataataaaaatctgatttactatctaaaaattcattaataatttcttttaaatcagaaaatcatgacactagtaccaattggtttatttatttacttgcttatatataggtatttagaattggtttatttctgtttctatagctttatttcttgtatttgcactcagtatttatttaaaacaagtaaataacactaaatatatcaccaacaaatagatggcatttttagaacgaaactaaagtagtttcatatttttatggtttaaaataaactaatatttgaatttatttttagtattagaaaatagaaaaccacattgaccaattttgtttggttttgacaattggcgtgggtgtctgtcacccgatttcataggtcaaggttgaaaatcatactagcgcacaagtttgagggtgttcatggaattcttttctctcctcatgccatgctgccatatgtgtttctactaggtagtttgtatggtggctttcactcatatgaccatttgaaactggttacacagtagaccaccctttatatctaaaagaatcaattggtgattttatattatatcagaatatcatgtaatttgatagtggtaacaacatgaagggagaaatttgagaggatagttctctatttctctgcttgcactgtgttactatatgtttcacatgttagttccaatttgccatatatctaacagttgtccataaggtcacccttttgataagcctttggcagttctaagatagcactatttcattgcacacccaccattatggattattttttaagggttactaacgcggcctttcccaagccattaaattttgaagtggttaaatataatttctcagccataaaactaacctaattagtctagcgcggtggaaaaaaccatctgtgggcctaaattagaagctcgtgggatcgaatttttgtgctcttttccccacattttttagatttaaaagggggttcaatataaaaatgggagcaaaattagaccatagaattggtgcctagaaggttgagggattgaattcaagttcgtgatattttcttctaacattttttaagacatacaagtagttcccattaaaaaattggggcaacatcaaacacgcagttggggatcgatcggaattcggaaggattgcagaatgaatgctcctgaatggaccagctgactagatggcaattgaagttgcagtgctactaatgaatttatcaagtcatttttactggagtttggaacaaaaaataccagagctcatatattccggtaattctgtccgggaatgcaaaaaacatgtaaaatggaactagaatccctgagagatatgatgtatgggtcatacattgaaaatcccttgtaattttgagaacaggtaaacagaaattatggggaaaggtagccttggtgttatcagatgtgttgaccttctaggggg

SEQ ID NO: 4431 - DNA, 1584 bp, Zea mays
  misc_feature (1)..(100): optimal_loci_1554_G1, chr1:8020011..8021594, Cluster 27
attaacagatttaaacgaatactattttgatacggagtgagtacaatcttagaggattatgcgacacggtttcaacttacaatagaagtgtgctacaatatcaagtcatcaacagtattaaaaaacacacacaaacaacccaggatgaactagatggttatgtaattaaataagaagaaataggcatccaaatcgaagtgggtgtgacaaagacctggatgtggatgtacagtgtacacccacgcctcccacacggtcccaccaactgagcctagctcaatttcttcctagagacactagtggtttagacaggcaacatagagcaataatcatagcaaacttttgtttaagaaactgtggccttcagtttgcttatgtaactctacttggaaaaatcaatcctgtagaaactacaggctaggagtgccaggcacaaaacaagccaaaacctggaggccaaatattcaaacgttccaagactaattgtgatccaacaccacatctaattctgtaagagggctgaaccagatctaggagctagcccttaaccatccatattcatagaaagaatttcaatcgaccaagttacagcaaatccaaaccccatgctgcttcaatactcgatcccaaagcttggacaaaaggtttctctaaacttgctaggacgataccaggtgtttggtgtggctttcaaaacttttggggatagagaaatttgtgtcaaaggttaatttgggcacaaaccaaacacacatgtgacaagctaggctggagaaatctaatgagtaaaagttcttgcaaagaaactagagccagattaattctgtggagacgtcaagataattcacatcacctaatacatcgattcccagatctatttctcctatggcgcgattaattagttgtaagttcaaactaccagctaaacactgaaaaggtaattctactgaaggaaacctggtaccaaaagctataaatctagacctaattgtagtgaaggaagcttgaataaacacgtaagttttggatcaaaagttacacatccaagtgaacaacctcacaggaaactagaacagaaatatgtatcattggtatcaatgacgacaatgaactatagacacccacagcaagtagatggttttaagctcatcagttttcaatatattatggtacagtacaaacaagatgctgttcttatcctatattcaagaacatccccgcacattcacaattagggaaaaatcatataatcaaacttcaagagttatccagtttatgtgcactgtctaagattcatgttgtcaattgacaagcattaaacatcacatccaggaaaagaacataacactgatacaataggaagtttgtgaaatgaagaggcagaggctgtaaaatttcaaccgataataatgcatgctccagaggaggacaatgtcatctgatataacaaactgcaagtcatgatggaaggaagaacaaagaagagatggaaggactaaggagcaaggaagggacttgtggtcctacacctactacatacagccatacaaaaccttattctaaaacaaaatatagaacctctta

SEQ ID NO: 4432 - DNA, 1589 bp, Zea mays
  misc_feature (1)..(100): optimal_loci_15623_G1, chr1:86626219..86627807, Cluster 27
tagtgaaagagattaacctctggttttaagaaagcactgcattggatatcggcctagggttaccagtctaacataagcaaaccctgacaaggcctaaacaaaaactaagcaaaccactacaaggccaccaaaccacaagaacattgaatagaactacaaagggcattaaatatctccgacatttgatagctccaccaagtataggcttgaaggacttcatccaaattagcttgtcttccttcattctaaaaaatcactaccggtctaccatctttagtataatgttccacgtatgcagtaaagtcaatgcaacatatatctaagtcggcgcccttagaaatcttttctcatttgccttcgtgtttctagtagtctaaatggcccaactaaaacctgcaaagacaaaataagcaatttaactggtgaaggcccttgccctatagccccacaccagaaaaatgatcaactagtcttggacacgtatcaaggttaaacaccaccttaataatgccccaacttagtttagccagtaaacacccaaagaaggtgattcatcgattctggccccccacgaacacaacatctgtcactaactttccacccattttgatgatcccagccagcctactcataacccccatcagatataaacctataaagagatttattagagaagtggcttttattttccaagccccaaaacataatacctatagaatccatctccaaataaaccacattcaaatcctctagcatctccttccataactcaaactctctcaaggagagggctcttcaaagtctacatgccattctccttgtccccaaaaaaattatccagtgtacaatcaatgcctctgactaacatgtacaactcttaatcagatatccttaggggaagattgtgaaagcatcgatctttccaaaactgatagctaaaaccaacttcaactttgaaaatagcaccccacttgaaaagttgtttcacttcaagtagaccctaccaaaactgagaactccccttaactgaagatgcaaataaatgacatccttccatgtacttcctgataattatttcaatccacttaacaaataactattattcataattcttatactgatagtccaaactcccttaattcttgggcctcctcgccatttcccacttagccatgtggtaaatccacataacaaataggatattattcatagttcttgtattgatagcccaaactcccttgatccttgggtcgcctcactatttcccacttagatatgtggtatataaatttctccttggtcctctaccatagaaaattggctcttctactacacatcttcttgtgtacttcacttgaatctaataaaagcccatatattataagggtatgatcctcaaacaagagttggttaaaatttgtctcccaccagaggttaggtatttccctttccaacagtccaacctattttccattttctgtatgatagattaaaagcaccaatgccttaagtgcctatcactaattggtatcctcaaatatttccaacgaggacatcactaccagcaaggaaccactcaaggatgtgta

SEQ ID NO: 4433 - DNA, 2418 bp, Zea mays
  misc_feature (1)..(100): optimal_loci_161085_G1, chr4:181996942..181999359, Cluster 27
taacttgatttttttgtttgttatttgtgatatataatatatattcatgtgtactgatgactttatgagaactcttcaatgtcctaagttgtggtgtctaatatattatgtttacatatgtggacttgcacaccacaatatgcttgcttcatttactcctagtatttcttgtcattgtccgacgagacacctgaatttgatgatttcgataggtacacatgtaacatgtacatgcaacgacgactaagagtccgttctaactacttcagtgtcaacacgtacattttgcaagcatgagtatctactatctcctgtagttcttgcacatatggtgtaacctcaccctacaacaaacacagaacatggcaggcacaaaacaagattacaaatttcgcacgaggaaaagaaaactatgttgcgtggtagaacttgtcaatgataagagaaaatgcatgcttatggtaaatcagaatgtactctgatcgggtaaatcggggttacttgaacctgaattaccctgaccgtttattctgggtacattatttcatttgatagcagttttcaaaacccaaaatttgaaaacctgatttactctatcgaaaattttcaggtaatccgaatgcacgctcagtgtccactaaccgattttatagtttaagattaaatatcaaactgcctatataagtgagctcgggaaatagctttgttctttctggaaaaaatggaaaagttcacaacgcgaggaccgcatggaagacatatataggttttgcagttctgagaaatacgacccaatgaacagaccaatcatgaacaatactactctcctgctccccccgtcctggacctggtcctggacctggaagagaagatagagctatccatgcggtgcattaaatgtcggcgcagaacacattccgagttgtctgccaatctatcgagttactccctcttctacaaaagaatacaaatatattaggagtacgtgttaattagttagcatgttttatcaatttctagtggatgatatttatacttatagctctaaattaattcgttgttaatttatctttgtacacaacgaatttaacagcttttgttttatattgtaggtactaacagttttttatccatagttggttaaatttaaacttgagatacaaaacagtaccattgctagaatttctttcagccgtgtgattactagcctactgccgatgtcatcagcgtcggcgctgcggttgcagtctgcagacacaccgccgcggcaagcgtttggtttcgcgcgcatggcccgccgccggcgcatgcgccatcttacacgtcctccattccttggctggtgacatcctagctaccagactttggaggcatgcatggcgacttggcaaggcaataacgactcccaaattaaacaaggattattttggaaaaatttctcgatgcaaagcatggggcagcgtcttgatgcaacgtacaggccacaaccagaatgcacgaaccagctaccggtcacatcaacgacgctgaacactcaacactcaacactactgcactgtctcgtcaatatcaataatgcatgtatggacattgtacccgtctttgtagaaagaaacatcgtactggtaccataccatgcaagcaccgcatgaaacctaataaagctgcagcaaaatagctaggcagttggcacgcgagagagagagagaggccaaacaagtgtacgtgacataaacgtacgacatggacatgggaaagagagctagctagcacactgctgccattgtttccagctcagaacaaggatgagcaacttgaattcccgtaccgttctgtgcgcctgtaggcagcgttaccgatacgctactacgcttaccacgcacggggatcgcgtcgagctgcaggttcacagcagctgttcttggagatcggatgctgctgctagcatcatgtgggagatgcaattacagcactgcttaaacaagtactactagttgtctagttgctactatcgttggataaatatgtcatttttttgttgaatttaggattgattgggaaattgatctatgaaggaatgctagttgaccaatagcagctatggagaacacgaacagcacatgtgtgcagcagcatgtcattaatttatgacgttttttttaccgtgaatctggaaatcaacattattgttttgttcaaagaacaatcgtcacaggtaactgaagaacaaaaatgagaaaaaaaaagtagtaggcgtcacttgaaaaacaaaaactgtgtgtccgagtgtccgtcgtcccagccttgcttcttgttcactactactaataagagaagcagcgagaggatgataattactgtatatgagactgaacggctcaaccatcgtaatcgtggcggcggcggttgttcttctcg

SEQ ID NO: 4434 - DNA, 1621 bp, Zea mays
  misc_feature (1)..(100): optimal_loci_161342_G1, chr4:183933593..183935213, Cluster 27
agtggatagacggcggctctaattaccctactgaattatagggtcaaacgacatatgcaatatatgcagcagtcttaatactagctagctagctatgcatgtgagatgggatgtttgtttttcttcttccctgtggcgttatatgttgacacttatggtttgttgattcttctctgctgctacaaggcaacaatgaacggagtcatatgattgggccgggtgacgaaaaggccttgggttcggtatctctccaatctgatgcgaaattctctcaagtgcagtgctagcgtttgctgttttctcctgtccgagatccaccgtatcttaattaatgaaggtgctcatgctctctcttgtcaaagaaattaataaacagctcattcgtaggcttgtcttgtgttttctcccagcatgcatgtatatatacttagctagcttgttcggtggcgacccactgcacctactttaatttctttagaatgctagctcttagaacgaagtgcctaaatcgaatgtctactgcaaatcaagttcatatgtaggtcgtcatcatcccatgcatatacattggctcgaacttgctaagtcatcatcccatgcatatatatcgactgcccattgctttttagctggcaagcaacctgtttttcatttgacaaaagcgaacacaagtaactagccacaccaaacccactcagcctagattagaatctgcatgcctacggatcgagcagctgcagctccatcgtccatcttctttctctttgacgacgcaactagctatagcagctagccgacagtgtaatgcatgcattatattattggtcaataacgacaggagaagtagaagagtaaattggtcacctgatgcctacccacgaactaattggtgatcaacaccaaatctctctcaccacatcagcgacattccatctgtctagctagcaatataatttcccctgatgagaaaatggaaactaaagcatgtccactcccaagcctttcagtacctatagaataagagagaatgtgcattcaacttttcctttttattttggtctagctaggttggcatcatccaacacacacattgaaaaaatgtcgcatatccctttcgagtttcaacaattctagtactataccatcagtgcacgcaaacatgtagctaccattctggttcccaaaagcaactttgagtcaaactgagctgcctccttttccggcacaaacatataacacattaacagctctcgaatttatgagatgccttctttgtttgttaacgctgttgttcctaggaagaagatgatggtatttatgaaaatgacacagaatatctggtatccctcctcgacttctcgatcactgatcgagttctccaacacatccgcttgacttggttaattaaccaccgtcttaactcggccaacacggtctatttcttgatgtatttttgcacttgtcgatgtccttagatgtcacccaccacggttattccttcggcctcactaatccctgacaatccattggcacggacccgtttgaccttcatcttcactgtggaccaccgcttctacactccacacacccatgcaccacaagccaagagatataaaatgtt

SEQ ID NO: 4435 - DNA, 1407 bp, Zea mays
  misc_feature (1)..(100): optimal_loci_16534_G1, chr1:91778759..91780165, Cluster 27
tcgcaaagatcaactaagagttgatgcatccttgaagttcacattggtatacaagtttatgttcagtaccttgacattcgtaccaacatgctcagcgaccccatcatctgcaatgtatggctcgtcctagaccttttgggaatgtccgcaacatacgatcaggatcactaagattcaaccaccatcacatcaactttgcatccctcagatctcatgacaccgactcgagtttgcctccagtattgactcagactcagactcaagatcgacttacatcctactttaaccctagccccgactcagactcgaacgtggactcaaactcagactcaaatgtggactcaaactctgactcgaacttggactcaggttggtagtagtaggcaatgtcgccgcatggagtaagatattgtcatcaagaatccgcgggaggcgctaagggcaaaaaacgagtacaacatgaagcagcaagagtactttgttaattacaccgctcattaaaatgtattattgtaagtgtgattttagaataattagtatttcgtccatttagcacttttattactaataagtgtatttacaatcactactgcagcagcatgcccaaacaaacatcttgtcatagtggcaaccaccaccaccatcaatattcctgcaattctatcctttgagaccttctggagctgaggttcaatgaatttcctcaaattcagtttagtctagtcaatgcaactcaatttagtaaattctagacatatttagtcaatctaactgaacttagtaaattatagctttatttgtacaaatttagtgaatgaaactattttggttctgttctagcttaacatactcaatcctatttatttaatctatttaaacttatgtattctggggatcaaaagtagatatgacaaatatatatatatcaaacctctccaatagtggtagcattatcttgagatgaggttagtttattagatctcaataactatatttatttcgttacttataataatataactcatattttttcctctaatggtggaatttgctctttattacaggatgaacagatgaacaggctactgactttatcaataatatattcactctcggatgtgggaacacaagtccaataacccttagttcctataaaatttgctttttttatcagacttgctttgttgttgtatttatgaatgagattggtcattttaatgtgatggttgaatgtgatgttgaatagatgatatgtgtatacttgattatttgaatgtgatagattaatgatattcgatggatattcaatgatataaatatatacgtgatgttgaatggtaagatgatatgtaatttgtatatggatatgcaaggaaatacaggagaattctggaccctgggtatgac

SEQ ID NO: 4436 - DNA, 1556 bp, Zea mays
  misc_feature (1)..(100): optimal_loci_16718_G1, chr1:92808705..92810260, Cluster 27
cggttagtcttccgtcatcagctcttcagtccaagcctctcgaatgtccttccttcactgttcccaatttatcggcacaatttgaccccgcttaatttctctatagtcatcaaccaccttagtactctacacctgtacaccaagtcaccaacacaaacggagagacatgttgctaacatgttcacgttagtgttagtctcagactcaaccaaagcctgattatctcctgacaatcatttattactggtccacatatattagcacataattaatcatgtgtttgcactatatactaaaggttatatttcctggaccatgtatgaagacagaagacgcacagttccgctgtctaataattggatccagacaacaagagctccaagagtggatcatgttttaatttggttggtcaggtgcgggcaatccagttcagcctgccagtgccagagtggattgtattggggctgcgccaacgtcaagtggaccgctcgccctgcttgagccagacatgcatgggaggcaacgaccactatagacgatgatcatgagcatatattgagcgacctagctagttcatctctattcatcagatgaaataagggtagatccaggatcactttctttctcttttttgcagtgcacattaattgttggtccccacaggccgcaacaagtcctatgtactatgtgcaatactaagcttagttcatatatctactgaaagtttatttgtacttaagatatatgcaagcttaatgctattagactaacaagtccatgaacacatgctcctgcatggtctagtcagttaagagaggtaagtgctagaaattaagggataaacttagagcccattgttaataatgaaaattgcttacgttttccctcattactgctttatcacgcatgctaaatgattttctaaactgaacccttctgacaaaggaaaatataggtgaactccttgctgcaacatttgcagttacactagctatacagaaatgaggagtccatgttgcgacgactgacggcaagctagaaagctacacctgccctaaattaaaaaaaaggtaaaactaagacagatgtgctacgtgccaacaaagtaaactttcatttgcttcgtgcccgaccgaattcaacttccgaaacgtcatacgaattattaattattgcaagtgtatataaacatgtaatcatgcattttcgagttcattgaccgcggcaaccacctcttggagctcgccgtggggtgtttgcatcttcgagtttccctcaggggtgccatgcgtcttcgagtttactcgggctcccaggttgaagcaaaaattttcaaattttttgactcttttgtcagccattatatcgatcggttgtcgcattttcgagttttccactcagaaatcagaatgacgatttgacctgggcagcacttggattctactcaccgcttaatgtacactgctagtgggtgatagcatacttactgctgctctagactacttggaccctgttttttcattcgaagattatataatccagacatccagcttata

SEQ ID NO: 4437 - DNA, 1465 bp, Zea mays
  misc_feature (1)..(100): optimal_loci_176374_G1, chr5:22634582..22636046, Cluster 27
tttattgtcaactgtttcttagctcgatggcggcgcacgacacatcttcatccttttctcaacatatatcatgtaaatagacgaagtacaactataaagttgagttaatatccagtataggatattaaatcatacaatatagtttatttaatacgattcttagaatttatttaattatttatacgggctaagcccacaacatatctaaaagaattatcgagtattaggcaaactgatgaggcaacacataatatatttgtggagtgcagatacactaaggccttttcgtttatctcgaattgaggctatgaactattccagctaatcaatattatattaatacaaataaaaatatcattcccgctggaacggtcctagagtaaatgaacgataaaaatatcatttccgctggaacggtcctagagtaaacgaacgagcccattgaatgcatcagcggagtttacaccatgagagctggtccatgagcatcatggtgcaagaactgtggataaacatcatgtcagtgtaagatgcaccacggaaaacgatcaaaattctaactctcctcatattttggagatttggaggagagaaatagtatgaaacacagagcttttagacagcaagatttctcagcaatatttcctcacgaatacaattaaaaatgaatcctcggcgtgaattgcagcaggcgccaaattaatagctaagctagcgatactttcgctccctatttttctagacggattgtaaactactctctaaataggcaggagctcgtgccggttcgttaaaaagaagacgtttaattagtacgtgcgtttggacacgcaacaaaaaattcagagtaatcagagacggcatcgatggccagagagagcccaaagcgctagcgttttctccggctcttaaattatcttttgattaccccgactggatgacagcgaccgatagatggccagcatccatgaaatcagtgtgcacagcccaaaccctgaatctgaagcaagcaagcaagcaagccgttttcacggccggttctagctaaacatcaagtccgtttctggtggctgagatgaaccagatctagctagctccctgctgccttgctgcagcaacgtcagcaccccgtaagaaactggatgtagctacgtcatgcatgggcttcattcgcgaggcatggctgcccaattatggacagtgaatttcggggttggtaggtagcccttcatatagacttggaaacgcttgacgatgcgtctagcttttgtatgtttggtcgaccgaaccaccatggtgcatgtcagtagaacggaagtgccagtatcttttgtgcgagtgtgacactgtgacagcagaaagtgtatctcggaatgcttcgggcaaagaaatcgatcttgaagtgtagtacaacatgcatggatgctatggcacaccggacaacactgttgagtacgtagttggc

SEQ ID NO: 4438 - DNA, 2762 bp, Zea mays
  misc_feature (1)..(100): optimal_loci_182110_G1, chr5:55196583..55199344, Cluster 27
tatcttattcattttttctcactagcagaatttaatggccaaccatcttcgttgggctaatttgctattgttgctactagaagaagccaagctatggtgtgtgattgcatgtgatgggtcagaagtatgtgaccaatttttgtgccaaacattggtgacatttgtcataaacacctaaacaagacacatcaagtacctatgaatgccattatacatgaacaatacacattgctatcttagtgctaccattgtcattaaaccttaggctattgcataatcgacgaagctgagagagtccacctttattgctctagatacatcatagttgccaaggatgagataacaaaatccatcattgtagcatgaccatgaccttctctacttcccacctatacagttgtttcacatggatgagcatgcatgttgatgcatcataaagatgtgtgatgcacattgaactctcattattgtcacacaacacccactatcccctaagttttgtccttgttctgaactcgtattcactcaaacttgatttagtcaacaatgataagataggttcatgtttaggtctctaaacctaacttgtctaaaggtgataaacccatgataggctactccaccattcattgtaactcatatgccatctttacacccttcacatacctctcttcatatctcccattgagctcacaaacccatcaatggcatcccatggttggctatgtacataccataacttcacgtccatagaccctagaacaagacatgtctagagtccacttccataaccctcaaagcgagattatcacactttttatcggtgcaaataccatactagatggtgcttactatttaaaaccctacttctatgatttgataatatcctatatggttaggtaaaattctcatttgtcgttgtccctgacccacacaatctttggcaacttttgtctctagtcttcatgcatccatagttctggaaaagcactagacatcgtggtcctacaatcctccttgcaaccctcgcatgttcaaacttacaacgaccacacatgaggatgatacatgcaattatgcatccaagccatatattctatatatttttatttgattatttcaagaaaataacggcacataatttatgaccatcatgttatttatatttggtttctatattgtgtcatgacaatacttgacatccaaagagataaatattaattttaggaaaacatttactgttataattaaccacatgattctagtaatattgattttacaaggaataaccctgtccttgttgaactataatatggtggaataagccatcaggaattgaaactctcagtttatcttactttctaatagatgttggagagtgtaaccaagaacttttctttatattttttcatagacaaagaaaagagatcacgataatggatatggttgcacatatgaccttgactgagatatataatacatattctagaaatgcagtgtccttaagttcttatgtttgaagtttgaacagttatactaacacatattagtttgaaggatgtatcaaccatattatcattattatataacaatataactttatttttcatataaatataatttatttagaagcatgtctaaaacataattgtttaaattaattttatgttatgatccacctcttagtctaagtttgtttttgttgcccatttttgtctacaatttgatttcaaatgacatggtgcattaacatcaagcgtgccatcgttttcatgatgtacatccaagttctatgcaaaggttagtagctaatggtccaacccaaggaatcacttagctccccacattaaaatttgtatgtgcattaattctatttgtgggttttgataaatagatgacgatgcatataaaaagctaacaacattttatgagatttgcagtttcatacaactgtgaaaagtgaacatgaaatgcaagaccccttgattctaacttcgtcgaagataccatggttcaacttaaaagagagtttcattgtaattctttttttatattttcttaagcatacgatgtcgtactattgagatggctaaaaaatcattacttgtaggtacaaaaatgtgctcaataagttttactcatcaacttctaacactttcaaaactactccaaaaagattccctaaaaatcatccattgatagaaaaattcattgttattttattcatatatttcttcctctagaaaattccccttcccctttgaaatttctagtccgtcctcttcaaaaaatttggacagactctcaaatttctaaacatggtcctctagtgaagtttattatgcacctcggaaattccccttccccttcagaatttttgatccatcctttttggaatttctaggcaggctatcaaatttctgaacgctgcttcactctaaacaccttcccgtcaccgaaaattttgaaggggtgcttcctagtcaacctttgtgtacattatcatgcttgctctttcctctttccacccaaaaaattctaagcctcactggttagaatttccaaggggggtcaggtcatgttgcatggcaacaactctgtagctgagttagagtatttatttcttttgctctcttgcctttttctctctttataccgttttaatgcactcaactaatttgagacaaaagaaagcactctcttttgctccctctcactcttgcatagatcctggaccgagttctttgttcaatcctggcttt

SEQ ID NO: 4439 - DNA, 1999 bp, Zea mays
  misc_feature (1)..(100): optimal_loci_185183_G1, chr5:78395457..78397455, Cluster 27
ataggtagaggaggatcatcgagccactttcgtgattgatgttgactctggtcattgattgtaaggggctataacgccatctccataggagattagcaaagactaactctagtaatatcatggcttgttatactatctcattagtgtgattcttatgatgcctatattgtgggcttggcttgttacaccgattaatgcgtgaatcaccttgtttggactcaccgtatagaagatataggttgtcacccaagaaagtgaaccttagggataaatattgtgtcttctcttgccccatgtggtttgaactccaaactatcattgtaattataaacacttgttactagttcatctacttattatgtaatatttgttcctctagtttattaaatagcttgtcattgtcacatatatatttcacaggttattagtgtctttaggaaaatagtttagaacaaaactataataggtaaccgctttgacattttcatacttaataactctagttaccatttgtaagttttctacaatagttttaatgagttattcaccccctacccagctatgcctttttcacttactgcatgaccattaattatgtatcaattatcatggcaaggttaatacaagcagacatacttagataagttagttgtgagttacacttgtggatcttagttgacgtagctaggattacaagacataattaaggaatgaatacatgacttagtcggcacatacaataatggtatataacctagtcagccataaaaaaagtgtagacacttttaagtgttaccacaaaagcaacactgacctcgatgacagtgcatcaaggtctatcgaagaagttggttcgtgcatgagaatgttgcatcctaagtaccataatagcaaaagagtgtgtccaagatatattataattctagtgataactactctacttctgacatggggcaaccttgggtatcgattagagttgccaagaagaacaagtgtgccagattgaaactatatctagccatcacaagagtccttctagctataactgacaactacttggccttggactaaagcctataacatgatttttttctagttgcaagataaggtttcaactcttccaactaagtctgggcccaaacatctcaaaagctgacatattcaaagcataagacaaagttttcaaataaagataacactagtggaagtcttctacttgtgagaggatatttatagcccaacatccgtggataaggacaatgttaacatgttgcaagaaggcagttagtgtgtgcttgcttttgcaacgcactcaatactgaagctaaatcatcttgacaaaagtaacacataaaacaatacaagattccctatactatttgcacatgtttgtagaaatcaacaaaccacccactgataagtagtccttaaccattgccattggtggttacttttcaccacccttgaggatgtttaagactctaaaaatcgatccctagttgggtactcgcgttttaggctttgtggctatggaatatatgcttagtgaaagatttttaaatccttcagaagattgcaagaatgatttccaatctttttatgttaaattacacaggggtcagggctacacgtaatggtgtgatttgcaagaaagcacacaccattagaagtaaaactttaagagcattttatggcttatcttaagaaggtaatcagacaccacttcactcaatttcgtaatgatctagagattcaaatagactttagagttcaatcacgatgagcttgggggtttaatggaccaaaatactaagggttccatataagcccaacttcccgacaatgggattgataaatcatatactgcgagaaagacacataccaatatatggtcttcaaggatgtaatctggcttagttggataaataaaatgctatctttgtaataggattagaactcttatatcttaactaactacgactagatcaaacacttgtcc

SEQ ID NO: 4440 - DNA, 1453 bp, Zea mays
  misc_feature (1)..(100): optimal_loci_197620_G1, chr5:160470784..160472236, Cluster 27
gtgacctcatgactcaatgtagcttcacaaaacaaagaatcagaattttcaggcatcaaagtgagaaatatatacttaagagcatgcttaaagtaaagagcttaagttaaacagcgttgccatttgaataatttgtaatcccactagttgatatcctgcattacaaccagatgttcaggttcaaaaatataacattataatgagatttcaaaaaacgatcagatacatacttgtaggaactcaaagtttaaatgcagttaggaacactagtccacatttgagagcaaccatgagggatataatttccaataagctaatcaatgtgagcctaattgatgtcctgcaaatatggccacatgctggtgaatgcaattgattgatatttgcctaacttaccatgcacaagctgaacaaaaaaagatccagtagctaatcaagaaagaggtagtagccacaagtgacaactagttgaataatcagtcagcaatcagcataagcttcagttcattgtcgcagaattgtctgaacatcaagacaaatttgcactcattcaccatttttaggtaaaaaaaatgggaaggaaaaacattcaatatgacaccaacaccaagttcagactacggtgctgcaaaatatcattctacaaagtacaaactacgcttcaggataataaatacaaatacataacaatatacattcgttgtcctatataccaggaggctgtttaattaactacaaacaagcttcatgaaacccataagaaattctccaaatttaacatgaatatcaagaaaattagccatgtggtcaggaccctactcatatatagcaagcatcatccttatattctagtgtggacatcacattttcttgcatatttggaaaaaaacaatccctagtaaggaacaggcgtggctataacacaccagtgaggacacgccggtgacgtcggctgaccagagaactccaaggatcttaccacttcccaacgcttggcagtcctagccgcctccggcttcttgctctccagatctcggcagggacgcacgtcgtcctctatcgcctcctcctccttccacgattaaaaaaaagacaaaccatgagcacaattagcaatcaagtagatgggaagagagagaatggcctagcggaaactctcggataggcccagacgctgctgtcatcgccaacgatggaggcggcggcgggaagctggccatgcggcaccaagatctttcttcgtgctcttcctcttgcaactgcctgtgctccagcctaggtgtaccattgctgccgtgccgagtctaccgtctacccatgcaagcgcggcccgtttggctatagaggcgacatgtacggaggggggggggggggggggtgcggagaagattgtgagcgtttgcattttgccgatgcctagtcatagggcccattcgttatttaaaattaatat

SEQ ID NO: 4441 - DNA, 1523 bp, Zea mays
  misc_feature (1)..(100): optimal_loci_202179_G1, chr5:186492481..186494003, Cluster 27
attaccatactaatcttgcataaatatcaccacaaagtgctctccagaagcacaagagagttctcatttgaaatctctaaaactgtagattaatctaaacttaactaatatattgcattatctcttcagatcctatctccagaaaaagaaacgaaactgattattatttataaggccaaaaagatcttatttggtccagagctaattctactcgctagaccgcttgtcccttcgcgggccgtcagccctagcctgggccaaggccccacgcgcctggccatcccaccgcaggccgcgtcgggccgctgcccgccgcacgcccactaggccgtcccagccggtgtgagcgccggcgccttgctggcttcggccaccagccggcacccagcctggtggaccggcctcctcacgccagtggttgggccactcgagccgtgcgaccaaccaagcaggccgcttagctgctagctgggccggtcggctggcagcaccgttttcttcttcttcttcttctgcttttttttttcttttccttttcttgcactttcatgaaagtattcaacgtatgcaaccatcaaatgccccaatatttggtccgaacaccccgctcaaaaatctctctaaatttatttcagataccaatttttttacctcagtccccacccaaatttagtatggaaaactagtttacattattgccaaccatgtttcatctcaactaatccatacaaacgagtacgagcacaagttcacgccttgactcaaggttaatccttgcaataccactcacacggatgtgttactttagtatcaaaccacttgtttgatcgcatgcacatcttacatcaatatcaaaaccacatatataatcacacatgtataacgaccaaaaatatattaatcaataccaagccatgtcaacctaacatgatgtttcatcacacacgatcacaatctctccatgatgaaagcattgacaacaccacacaaacattgtagttgacattcatttttcaaataaaaatacttgagattaaaatccaaaagcaaagggggaaagatcatcaacaaaacatccaaaaaaaatctccccctaaaatagtaaatgtgtaatgttgtgcgatgtatgtaaaaaattgtccatctttgacataaattcattaagaatacaaaagagttaaacttccttcttttcacacactttttaataatgatgagcatcataattaatctacatatgtaacaaatactcatccaaatcattctaaaatatattgtcactttcacatccatacacacatgatttcatcaaagtataactgaaatctaaatgcaactagcaatttatttaatacacaatatttttttctcaactaacttaaaacttgcatatattaaatattttatataccttatgtccttgaaaactgattgatttcatttttatatgtgtatgcgcgcatatgtgttaaatgtccaccaatataaagttgtaaaggtatataataaaaagcctctagaca

SEQ ID NO: 4442 - DNA, 2790 bp, Zea mays
  misc_feature (1)..(100): optimal_loci_203810_G1, chr5:195471239..195474028, Cluster 27
tgatctgcttcatctttgctaaatgttctattactatggtgatttttttaaaattgctttcaatggttgttgcgttatcgttgttggcgtggcttatttaatgaaaggaagagaaaggtctttattccaaaccaattgatctaggtagattatgataattatttattggggctcaagtgtttgtttcttctggctcgtttggtatgacctctgtttgatttgcaaattttttgcatgacttcgtagagacggtttttgcattggtggctctctagcgaagtgtgatatgatatacattgtcccatgcccctgctatgtctcctcttggaaagcgagctgctccaatggcccaccatgcgaagcccccgtcgtggcaacctttgtaggatctacgcggacccttgccctcgcacgtcgccaccaccaccatgccctcacccttgcacgcgcgccacagacccacagctgtcgacgatggtgatgaagctgacggcgttatcgtggaggcctcaagtgaatggacaacagagaggttggggttggtgtggtcggaagaacatctaactacactactttaatcatccaccacaactacgctactaaaaacattatccttctaataaaaatttacttttttatccttaattacgtaaaaataaaaaaaggaactttttttctggtgccaccgatttagtaggcctctcagtgcttctccccctcttggtgtctctatttttttatccatccaatcgttcctcgccaaatgtccaaatttcttcgaccacagtataatttctcatccaacaatattcatccgggtgaaagatccaatgaactactaccggggtaattagcataaggtagctctatgcatggattaaacaacacgatgagcgagtgaaagaggggatgtaatcagctttcagaaccattcattacttgtgaggcttcgttttgttgtgtcggtaggcaagcaccgcacggcatacaaagtattgagctcttcgacccagctagttttagtttgttgggttcttcgaaaggtttaacgttttgaccgaaaagttcagatgatttggcgtgaagggacaagcacatactaaaggcgcaacatgaaagggcgctcgatctgagtgtttgactatatacttacaattctttgacccaaacagctaactaaactagaaaatggttgaagtatacttgtagctgatacaaaccttagctaaaatgtgcaagttgcaagacaagtaaacaggcctcgacaatgtgcaactagtcaaagaagatgacacaaggcgtcgtctctgaagtctgaatgcactgaaactgttgacaagcttgcaactctggagcctgcagtggttcaagtgacagtgtgacacggcacacacgagcgaagcgaccccactgatccaaatgtagacaaatagacaactgactcctgtggcgactgttggattgctaccatatcgctctatcaggatccgaccgccctgagacatgccagcatgtaccatcaaaaggtgaacatgccagtaggctagctgctccatgcatgcactgatgcaccaggctctagtggcaagttgttgaatccatgcttgctgtattattcgctgtgctatcgggtactgttggcacttggcagcgccgaatttgagactccaactgtcatcatataaagtaggtggaaacgggggcgggggttgggggggcgatagatcccccatttgaccttttgccctagagatacctcgtgccttggattctttcacctattatgccattagcagaccacatacaccagtgcgatcagtcgaccaggcattattatcaaccaaatagctaggtccagtaatgaaaccattagcagggcaacttcaggcgcaatcgatgcacaattgcagacaccatagattcaggtcatcgcccaccatgcattccgtcctgtagcaagcatctcttacaagatactgctgtctcactctcatttgtccttttctgaaatcttggtttctgacaaagtgagcagtgcaagttgcgagctgcatatcgctgaagcctgaagggataggttggcttgatcacacggatgattcttcatggctaggctggtcgagtggttggtcaacactcaactcaacctcggactcctcgttcgttcgtctcacacccgtgaagcaaccagtgcaacttgggagcgagttgtcccagcagtagtttgcacataatgaagtcattcactttgaagaagtttcaagcttggttgctctttgagtaagttgttatctaagtggagttcttttactgaatttagttttccgtttgacccctacaaaaaaaaagcagacgcctttctttctctttagcactgcgctgtgtgccgggtttgcaagctgtggcagtaacaaattcttcacatttctgctcgatttgcaaaccgtgacagtcccaaactcttcacatttctgcccaatcagcgagcgtgcaaaacgctgtttagccaaaatcttttggggcttgtttgggctggaatcctggcacagcgatcttaatacggtaatgaaacaatatgggcttcaaaaggcggcccaataaatgtcatgcagcaacaaggcataataatgccacaatggctggataagttaactggttactgcaaaacttgctgaaacttactagcagtatcggtagatcttagaatcatttgtcggcgtgctagcctccataaagtatccacaaatgagctgtatgctattggacacttcgtgctgtccaacagcatgc

SEQ ID NO: 4443 - DNA, 1494 bp, Zea mays
  misc_feature (1)..(100): optimal_loci_203853_G1, chr5:195664180..195665673, Cluster 27
atgtgtgttgtcggcatgatctagatgagtggcgagccacaagaagcttgtgtgagagagcagagagaaaaaggagagataggttgcttggagggcatttttatcatttgttaatttgttggttgctattagccgtgtagctggtttttgctgactagataactaacgagtagttgggactttggataaaactttagtccaaccgttagctattctgtttagagtaattgacaaattttaagtagttccaataacacttacttataatagataggttaggaagtcaacacatagagtataaatagaaacactatatataaagtcaaatcataacattgccggtcgtagcatgcgatctacaactccgacaacggttgacggcaaataaattagaagaaggaaatgcaaaaacaaaaacaaaaagtcaaactgttctagaagggattggaaggccttaagttgaatctactctttttagagtctatatcactttgacaactcatgacgaagacggcagcccactagctaacgttatccggaccataaaaatcagattcttcttgagtttcttagctgaggttccttgcttaattaaattatcataatattgtttccgcaaagatccaattcaaaagaaaaatagacgtgccgctcagtgttgttgaaatagcgacgagagctgttaaaacaagaacattagcatcagcgctgcgttgttgaagtagccgggccgcatcgcgccgagccttcatgattagctgattcgtcgagtgcagctctagggtttattttcttagcaatgtccatggacttgaaaatagtgtacgtctagttttatcctcatgaaaacccatcgttcgtttccctctttttatggatttagtatcttgttgttatctttgtctgtgtgacatctcttttaatgagtgtgaaactcaataagacctcaactaaaaatggccgtagcgtagacattggagcagcctaaagcgcgaggtgtaattgggccgaaaaattaccaattctaggtccaagagctgtctttgtatcagccaatacgcagtacgctgagcaccaagtagtcgcggcccaagctggcagcggacccccgaacttccagcagtggaggctttcagcccacaacgtgttggtctgctcttccgtttttttttttctttcccaccttatcaaattgttgaaagaaaactttgtttctaccggcggttcaagaaagcagacacaactacaaaataaagcgagtgtccatgtcgacaaatcagtagtgtagaacaaccatcagtataaatctctacacctataaacacaggttttctagtttctatcggcgtcccttttgagaaaaaagcattatacttttctgatttaacttgtgatccactgtcgttatgcgtagtcaagtgacatgggcttaccatcctaaataaatgagttgtgagaaaactctgaggcccaacacgacacaaacctgcacgc

SEQ ID NO: 4444 - DNA, 3164 bp, Zea mays
  misc_feature (1)..(100): optimal_loci_204260_G1, chr5:197877708..197880871, Cluster 27
gaaccatcagatcagatgcagcacaacacaaacatccagcagtaagggttagaaaagggtagcatcctacctgatagagttgtgtgtgttcttacaataaacggatgactgacatgcatggtgcttcctagttcctacagttgatagagctctgcatttttttctcttatggcaaaccgaggtcatgacaaaagatttaagtgtctaagacatttataatggtagaaacacttagtcgcccgaagacatctactagtcgctaggtccataaggtctctggcctcacataatatgaatggtcgagccctgagccagggccaccggccctagtgaggcaaagggacttttggtacaactaagtataaagttgtatgtgataaaaaaagatgtggttggtcccactaaaaggcgttacaaccttaaaactgggatgccgtgtttgaggcctatggacctattcacctataatgtcgttactttggataagacttctatatgacacattaaccatgtggtgtgcaatgttatagcttcataggcgcacttttaccatggcttaggcattagggtactccataccactattatgtgagtgcatcgacgctatagccacgtatttgcatgtcaatgtaccataaagtattattaagaattgattgctacactagttaccaactatattttacccgacatcatagactctagtgtccatagaagcgacataacatacctgccactatggtaggtataactgtaactaaagaatgatatctctcacactgtgtcataatcgaaggcattgccccatatatgatttcaagactaggataagatttgttaggtcttaactgatcgaacccatggtccaaccaatatgtgaacctctctcctcccttgctttataaaagtgagagtagagtaaagtttagaggattcattcgaaaacataggaacataattctcacacatgacatcaaagggcaaacatagggtgaaatagggatagatagactagaactcacaccagaaccaagtgcaaagggggtcgaggaattcatgatgctcagttggttcttgaaattgtaatcttcttgacctttatgttcatcaaatgatgagtggcaagcggatgtagggtattacacacattacaacatgaacatctctaaactatatatgtgctagttcatagccgtatctaggttcaacatacattacctacgcccccactatcaccaacatctctcttcttttttatactttatgtatcttcctagtgtcataccccgatgatatttgtcactccaagtaggtaagtgtgcattttctcttgaaattattgtgttgtgctatgcaagacggctatggagagaccaacatgttaagtagttaattttgacacctattccaacaacttggaccgcgagtcacgccataggcaacatcaaaacatcatgttgaagtattatcaagtatagattgctacactagttgccaattatatttcccgacatcataaactctagcgtccatataagcgacataacatacttcaactacggtaggtatggctgcaattaaagaaggatatccctaacaatgggacagaatcgaaggcatggccctatatatgattttaagactaggataagatttgttaggtcttaactgatcagacccatggtccaaccaatatgtgaacctctctccaccattgctttataaaagtgagagcaaagtaaagattagggggattcattcggaaacataagaacaaaatcctcacacacgacatcaaagacaagacattagggtactataactcgcacaaaaaccgaagtgcaaaggggtcgaggaggtcatgatgctcagttggttcttgaaattgtaatcttctagacctttatgttcatcaaatgactagtggcaatcgaatgtatgatattacacacactacaacatgaactctataaattatatatgtgttgatctatagtcgtatctcggttcaacataccgcttgcttacacccccactatctctaatatatatcttctttttggtactttatgtatcctagtgtcataccgtgatgacatttgtcacgccaggtaggggaagggtgttttttctcttcaaaatattttgttgcactatgcaatacgactatggtgagatcgacacgttgagtagttaattttgacacatattccaacaacttggaccgtgagccacaccataggcagcatcataatatcatgttgtcctctacactgcaacttctagttaacaaactagtttcagtgaggctgcatggcatggttcccgtaggcctggctttgggtcgtgccatgactcgggtgtgcaatgccctaggggaattgcactagatgctctatgaaccttgagaggcatgacctcttaatacgacgactgggcaaggcgaccttcaagcatgaaggttcctctcatcactagaagtatggaaaaacatgcctttcattccctccaaatggttgatcgatattctaagaagtgtggtctctctgtaaatatgttcttcttagaatataaataaagttgtgcaaaagtatgaaatagaaaatatggacaagtgaaggtataagtgttgaaaaaatgacatgaaggctcatggaaaaatattaagaaatgatacacatggctaaaaaacaataagttagagaaggagatcataacaacccacctctaaaaatcacatttttagaaccggttttctgaagagagacatctttataaataggattatttaaagagacgaccattttaagagggccatgtttgaaatgcccattattgtgtgagtctgtaaccacaacaattattagtatattatttgaggtggtattatagtggtctagcactcaaaatacaaaaagatgtttattctagcttaggcatcttatcactatgtcaagaaatggtcctcattttaaaatgcttaattgagtttttataggtcatagaagagcactatcagtgatctaggattttctaaaattcatccctcctttagggtgatttcacatgccttgtaatacaaagggtgacaggagtgtagtatggagggtgactagagagtgagttcaagaagctccatcgtctggctaggaaactctagggtt

SEQ ID NO: 4445 - DNA, 1413 bp, Zea mays
  misc_feature (1)..(100): optimal_loci_206705_G1, chr5:211469481..211470893, Cluster 27
gatgtagtcgtgttagttgagctcatcaacctccttgacggtctcgttctcaacaatgagagtggaatcacaagtcaacccatcactaatagaagatggtgttgtgctacaagagggttagtggccatgacagcaatagcagcaaagaaagattcatcaagaatatcataaattactcttatgttgctaattggaatagactccttttgagaaagaaatgaggagtaagcttcctttagcttctcatgagtatcaattaaagcctcataagtagcaaaatgctcctcaaatatttgctcaagaggcttgtgcctcttgtgcaactccttgaaattcttctctcttcttattcaaatcaatgagaataattactcatcgatgcacatacacacttctaatccaaaaaaaaacaaaattgtttgtactaaaaacaatccaaatcatagttgtctagaaccttgaaaatagtttaaaaagttggatgatgaagtttaaccttgagcactacccctttcacaaaacatgtagtagcaaaatgcagaggaaatggattcctctaagagagacagagagaataaagagtgagagctgacatgtagcatgtacgaggaggaagaaagctgccaacgtgtgagtgagaactgataagggaaggagctagcacacgacctctatacccccttatcacgtcaacctgtctagcatgataggcccattgcgcctgagtcactagtagggattccagtggaccatgccgattgggtcaaagtttgacatcgctgaggaggcttttgttgccaacatgtgtggcacgatagagtgagattgtcacgcgagacgcatcgaagtgaccaaaaaaagttagatgtgcaaaacattttttagagtggatcattttaaaatattgattaaaaggaactaaaaatgcttgaccagcgagaatccgagcttatctcgttattatggaatctagcatgatgtcttccattcgatcgtattgaattaaaaaaatataaatcatcattggattatattttaataaggcacaatcttgacaaattggtaagactatcagaagtattgcttttatgatagaaataagagaattaggcacctcttattcttctgttgttttttctatggttatggggctagttatacatggctttgggcctttctcaagctcatattattttaaatttgtttaggactaagattttagggggtttaaaaaatatgaaattgtttgttcttggacaacaagtattttttagttgctcagctttgtaggaatggcttgttttattttttaaaaaagaaacacttatattatccactagttaggttctcatatgatgttgtggtatccatatatcatataggcagaacatgtttaaatgagatagttgtcaa

SEQ ID NO: 4446 - DNA, 1436 bp, Zea mays
  misc_feature (1)..(100): optimal_loci_206852_G1, chr5:212034300..212035735, Cluster 27
tgcagcaaaacaagcccaagttcattatataagaatggcatgattattaggaacaaaaggttaagcatgtttacacaagccaagttcattatatgtacttaaaggataaaaaataatcataagtaaaggaactaaagctcgtttaacaatagtatggtgaaaacatagtgaacaccaagtggcatggtctttatataacaaaaaagagtgcttaccaacatgtaggcacacatataatacaatacatgaaagtaaacatgcatgtatgaaagtgtcacacagaaagaacaagtccatatcacaaactccccttgaatctatcatacctgctccccgcacctttggcgttagacgccaaaatctaagggtttgtaggtggtgaagggacagatgtgttggtcattgagacgtttagagtgagctagaacgccaattgactgaacactgaatgttgaggatctctttagacccgatagaatgtggattcagtaattattataattttataatatttaattgtctcatgtaacgagtttatgagtgttcacacatacattatattaatttagtgaattagtttgttagttgtatggactcttatgagattagatatttatcatatatatgtagttagatccagaaattcttagaatagatatttgtagtgatgtttagttattaactcaaggctctcgagcggctccgactgcaactcgttgccggagccctcccaaacgatgtctgaatgatagctccatctagagaggtggagcaggttttgatattgggagacggggccaaagaaatataatctatttttgataaaaggaatagtagatctttttttatcaacaagatagagaggggggaaatgataaaaggaatagtagatctatttttgattgattagatgttggataccttaatcagatgcgatcatctcatatatagaggtgggtagtcttatctaagaaataaatttaaaacatgtttgaaaacttttcaattcctaaaaaacaacttagaaacaaatcggcaacaaaaaaagcagaaaaagtcgattttgcagtatggtactaggaggccgtcctagctggtccagaaggtggcttggtctattttgcactaaaaagtctgcttggccaggttttaaggatgtcctaaccggcttcagcgacccgacgtaaccaggttaattaggggccgacttcaaccaagaatatagaattatctttgcacccttgagtatgtccaatatacaaggggaaatattgatgacatagttaagctgaagcatcagctgaatacaaacttaaaagagggtagcatactgtatagatcttcaaaacaagcagcattcatgttctgttttgcgagaaatacaatcacctgtgtggtctgtggataactggataccggcctggtcttgcaggtaa

SEQ ID NO: 4447 - DNA, 1611 bp, Zea mays
  misc_feature (1)..(100): optimal_loci_207338_G1, chr5:214350502..214352112, Cluster 27
catgcattgttctgcacaagtcgaagctcaagtgaccttacataaataaaaaaaccatgtaactaaattattaagcgtgatcgcccagaataaattagcccttagcttgctactatgatgtttagaattgcttcgatatcaccattattattaattacagcagatcactaacgagtcaaaacattgcagcagaaccctaattatatatctgtatacctcgtgatgcatgttgcagcaatccctacctagtgatatgttggtagatcatccaacgcgcgcggcgcctggtaatcatccacctcccggccggcccccaaaattccggccgatcgagatcgattcggggagatctccgaccgatcaacgactggtctctctctctctgcaatttcccacagctttattgaactgccctcttgcttgcttggatcaattgaaactcgatcaggtccacagcacagcctgctgcatgcatgatgcagttcaagaaagctgtggaagatggcagggagggccattatgtctacgatattaactgatccggggtgtgggtacggtggtgtcctagcaaatctgggggaagctagaggagaagagacgatgggcggttatttatagggccgacgacgagaagatgacacgaaagggaaggagccgaggagtcgccggccgcccggaatggttgaacggacggtgttagtggtgcggtgagaaggaagaggtcattgtttttgaaaggaaaaaaaaaccgacgaaacgcctgtttgtaaaggaaaatttagtcaattaattttactgcttatttagagagttccatcccacacaagactcaattttcctctcctttaaaaactatttatttatgttgaaacttgtatcataatcaaaattaaaacagtttgacccaatttcacaagacgtcaatacctcatcgtgcatgctatctactggtacgtactatacggaggtagaagtagtacatatatgcgtaggcagctgacaaactgactcgtcaactttcttttggcacatcaagcctagccaggccacaccaccagcagccagcaggtgcacctgggcagtgtcattcaatgatttaagtcaccgtctcctccacggtccgcctgcgaaaagcaatagtaccattctgatcgatgcttcctgtgcccggtaaaagacgacgagaaaactaaaactcttcttcattatcattggagtttatttttgtttcccgatatgcataagtaatatgacagggacacctttttaaccaaacatacacagacgcgtgctaaattatattggttatgtataattaaatttaaagcacacatgtagcagtatatataagttttaaatacatgtagcgacacatttaaatttaaaatacacatatttatcttatatcatgtatatttaatttttaaaatatgatgctataatatttcttatgcatatttaaattatatgtgtgtgataatttagaatgggattaataagaatttgtggtggctgcagttccagcgttgatgtgtccatgcacgcatttggtatacgatgcacgatgggcgtatcagcagtgagcagcaagagcttttgccgggcctgtgt

SEQ ID NO: 4448 - DNA, 1487 bp, Zea mays
  misc_feature (1)..(100): optimal_loci_226569_G1, chr6:117431952..117433438, Cluster 27
cctggcaaggcaagtggacacaaacatgtgtggaatgtcaatccctaccgtttgatgacaatcatagcttatgtttacctataatcgataatttatgaccaccatgcactggcactgggtgagggtatctagattcaaagaatctagctcctcctgcatctataaaaggtacaaagaccctctgttagagcacttctttccacactaatagcattatgtactcctatttagtaggcctctctgtttttcctatggtttttgctactagctatgacctttggtatcccattagacatcaatatatgcaagcatgcaaaatattctccattgtatcctactttgggaatatatgcatttctatgttatatacatccaaaatcttctccactatatcctccatagggaagggaagctcgaaagtgttgaaaccattgaacaccacacacacatctgcctctagttttggaaccacctaactcctaggtaaacaaacttggttccttactaatggccacctttgaacaaatggggtcaagagcagcgtcatccatcaaagatgttccaaatctaaacgattagctttgttgaccacaaactcttactaggaaccttaatatatgctaaatccgcttcaaaaccagcgtaagttacaaatggaagatcttcgataccaaacatatttgaaaatacaaccagaagttctgaagttgtgcaaatcaagaaagaaaacatgcttcatcaaaaaacctttgctatgcttgggctaaatagcaagactattcgcacacaaaaaactactgaaagccacgacccacatgtgtggtatttataggtatctttggtcaaaatcaattattaacctttcgtttataatttatgttgttcaaacttgaccattacaagtttgaaattcatggttcgctccttaacgacctattccaaagaccggggactatttttactttcctcaatatcatgatttactggaattcaaccaccaaagttgagcttcgcccgcgaggggttcctattgaagaattcacctcgggaaaacgtagcctccaatattttggagattcgatcacattcactctatgctcgaaagcttcaccaacaaagactccatatgagtcatcaagacttacaaagcttcattgagaaaggacaaatctccataaagtcaagcgaggccactagatagtcttcactagaagtgaagctttgctcacaaagactaatcactgacaaggtttcaagagctgatatagataataattgtttaaatttcccttacatgggtaaataattggaaccttatagtttagggtagttaggactgcacgattatttacgaagcgagcacctctatagataccctcttatatatattgtttatggatagacaattttttatctaattgagttgatagccatattttacatgtctggattgattcgttagctaacatgtataaatctgtatcgtt

SEQ ID NO: 4449 - DNA, 1409 bp, Zea mays
  misc_feature (1)..(100): optimal_loci_229002_G1, chr6:129885902..129887310, Cluster 27
acaagaacgaggagaccaaagggatggagaaagatgaatagtagtgttttggttatttttacgaactatataattttatttttaaatatttttatatttaaaatattttgataattataaaagtttatctacttaattatatatatctggatgcattttcacaccgtattttttaaaaaattttattttaaattatatattatcaataaaacgacgtgttttattttaactaattgactataaaaaactgatgtaactttgaggtagctgcactagatggctgatgatggatagtgattggaactggcggctgttgtgtagtactagtagcaaagttcctgtgatgttattacttaccgtacttgggccttacgaaagctatactaattggttgttttactatctgaaagcgtgggatgatgagtttgtctttgatgcacggttcaaaaaattggaccaatgtttgtaatcatacgtggaccaatcaatgtttgcctggttgggacttttccacttgggagaagcaggccggaaggaggcgtgaaccaggaggagcttccgagcgctaccggcccatggagggactatccgccgccggtccgcccacgggggctccacggcggaatcggggaacggaggggggacatggttttggtgttagaggatccgactggtttgctggtgcccgtcagccgtggtccggacggctcgcacggggactgcccgaggacggcaggcgattaggataagatcaagcggagcgggggagcagagaatcaccggcacatggcagggacaccaaggacgggccgggcagatcatcaaaaccgaaaaaatattgggccgcgtcactcatgtcacgtgaagtgtgtgatgtgattgggtagggttcaccgtagacccgtagtactagtacacgtacccctcacctacaaacgccgagaaaatccaaattaattggaaaacaagtatagtgtacatctactagaagacaaatgtaattttagttctcaattaaaataaatgtttctagtgtacgaatttgcgcccatttgagaggtctattctattaaaattccaaagcaaagtgactgttagtttttaatcccacattgctagttcaaggtgtataaattaacttatatagctacgctcattcccatgtctaaatatataaagtaataggagagagaatatgactagtctcacacgcacgcgtgcgtgtgtccgcgtatttttcacgtgtaatgccgtatgacttgtgatgtcgtgtcatattattttggctatttgtatctttcattgatttaaatttttaacagttgagatttaatgcagattttattgtcataatcatggttaattggccagttgccaattaatgcagatttcactttcaccgatccttc

SEQ ID NO: 4450 - DNA, 3047 bp, Zea mays
  misc_feature (1)..(100): optimal_loci_229023_G1, chr6:129956069..129959115, Cluster 27
ttgccctatatcaccgtaaaaagttaagagtagtcgcacaaattgtgttttgtaaaaatattatccatcatctctctcggtgcgtgaacgcaaggatgagggttttggagacttgctattgcaatcaatggtgcatgtaggcacttagaatggggagacagtgacatcagaccacggtgagaagtggcaaagaccctagctcgaactacaaaatgagaatgcgctctcacaagtagagctaaatgttggcagaccattcataaaggtgtccgccggcagtccggcaccatcccacacggcatacgatcaatcaagcaagtgcatgtgagttacctcagtttctccaagaatgacgaactacttccaaatatacttaagaaagcagaggaaacttttatatttaaacatggctacctcaactttcttagaaaaaagattaaatgttctcactctagtttcttttgctcacatgaataaatagatcttcgagatctcttcaaaaagaacttcagaatttctagtaggccaaatccatttgttccaacacgtactattgtgctcctagtaacacagtgcaattttaaccttggaagacaggttgaagactgaagagtgctggcactgcagcgcgcgggaaaccggcgatgcatgatgtaaataaacgtgcacaaaacgaggaaaccaatcacacagtacaaatgtttttcagaagaaaaaaaatagtacttcaattctagtgcatgcacggtcacacatggaatcttagctaggtcgagtccgagagctctccaatctatcaaatcagaacctaatcattgctgagacgaaatgcatccctgagtgcatgcatggacggatggatggttgccaggctcgtggtgtcttcatctgtaggcagtcaggtcgcctggtctgatctggtcttggcttgtgctgacccatctgcgtgatggcctgaaggccgggcacacagatccaagtgccaccggccgggtgatgttcaggctatatggatgcaaacttgcaatgtggttggtctaagattttgttatctaattgttgtgtgtgtatcaccgttcgccaagtaaaatactagcgcatcgtccttacgcgtagtctaagatgttatctgctcgtgccaagttgtcctacataataactaataacataaaggtgcatttgattgcgggactgatagagacaatcagggacgtccctcctctcttgtccctttaattttgaggaataattggaaagaacactggatagtctgtcccaatctacgattctgaaacaaacaaacttatttgaggaataattgcgttctgtcattacaaccaaactcatcctaattataccatcactattcactagttactaatataatagcgaaagaattacgcaaggctgaattttgccacaagcaggtatgcagcgcacacattgcagcatgtgctgtcaaaacgacaggtgtacgaacagaacagtcctgtcgacgccacttgtgacgtcacaaacagtatcagcgagacagcaactgaaagcatgcagggcgccaccggccacttgctctctgcggacaggaggcggcccaccaggtcgccctcacctcacgtgctgggctggggaacggggatccagtcgagggacctgcctgcctccagcctccgatggctccccccgcccgcccgcccgcgcctcccggctccaggtcggaggccaagcccacgggccacggcgcggcacatgccccctgccgcgtcgcgttccggaggcagctcagatctccctgtcgcccgccaacggggacgtgacgagacgagaccactcacacacctcacgagtaccaaaataagtctctgtcttgtattacgataaatcaaacaatcataatattaataaatatatatgatactaaacaaatattattattatattaatcgcatcatatattatcgtgctatatactactcttcgtcctgtaatataagtcattttaaaattcttggagagtcaaaaaattttcaagaagattctccattaaaaatattttcatacatacctgtcataaatctttatgattatcgctatacttgtgatcaaactttgactcttcaaaaatcttgtaatgatttatattttttgatagaagaagtgcgtatttagagatataagtgttaatactatttttaaaaacttaatcaaagttaaatacgtgatgaggggagtgtacgagtgagagaaacccttgtcacttctcgacgtcccgcctcggcttaataaatctgaaatcgtggagctcgtttgctcgatgtcttgtgcatatcgaatataatttgcatgctccaggagtccaggtgttctttcgttatctaggctgggctggggtattctcgttaggtttcgaacacccgtagggcaaagccagtaccaaagcccctacatatatatatatatatatatatatataccccctatattataatactaataaataaatacgggaagaccattcacgagctgatccatagggttttcagttttagtaatttgccctagctagttcaattgattcatgttctagtagtagaattgtatatatcggtactacgtagtacgtacgtataaaatcagggctcaaatcatggatcggttcaaatcgtcggccacttcgactgccaactcacactcccgttcactgaggcctactccgtatagtatatatagggcacttgttatttaggagatgtttgacatgcctttgcttcaacctagaacagctctgctataaaactttaagtgaagctgctttgctccgaattctagtttacattccgcataatcagtggtagtatgtctaggcagtaaaaaaagatactccaaaaatgtgttgcagctctcaaaacttcatgaagtttgcaactctagcgtaagagtttttttgttggttctggccaactccccttatgatttgtttggatactctagtattgacccttatccacatgtgttgagctggactggggtgtaaattagtttaagttaca

SEQ ID NO: 4451 - DNA, 1407 bp, Zea mays
  misc_feature (1)..(100): optimal_loci_230461_G1, chr6:136432538..136433944, Cluster 27
gaaagatagccaactagagcacctaattgaaggcgatggttgtaagtgtgggcactttcattaatctagtgttaacaactttatagtagaatgaccacaacaactctataaccagtacaatgttgtacaaagtaagtactaggtaaagtaaatgaagagaattatattaagtaaagtaaagtcttacaaaaaataaaatgatataagagctataccagaccaaacgactagtttcgggaacttgagcaaagctcactctacttctaactcccacactagactattctactaaagtttaaagtggaactaaactaagaactttgcttctttgctttcacaaatgaagagaggttgtaaccatatatatatactactctaagtgggcccatgtatacatgtgatcgtccttgtgagccatataatcaaaccactattgattaaagtgtgtagatgttcccacgatgtgctttcatgcatactttcattctcaaggtggtggagctcaaatagggccagataggtcgtgaaccaacctaggggcttgacctaccctcctctatgacttgtgggccctcctttgccatatgagatcactagggaccttctatgttgggtgtgtgctaacatgggtacactttgatgtctgtccaccttacatgtgagtcatttcaatccataagtgttcatattctatcattgagagaaagcaaagcttcattcgagtgtggagaatggtttgagagtgtatgacaaggattgcaatagcttgggaggctagtggaacccataggggtggtcggtcgacccccctatggggagcccacaatccctatttcttttattaagcttgaatctacatatatagaaatactcgtgggcatgtgaaacttgttgtttcataaaaatatgctcatgttatatttatcttctttttattatgtgattgttaacggtgctctgagcatatggaagtatgatattttcaccatgctagggaagcagtttagttggtggtaagatgtcaatggagaattctccgtcgaagatggctccccatctccacggggagaaaattcgtctcatccttgtcttcgtatagcgaatttatcctcgtgacaaactggttcacattactaaatacagtatttaaagacatgtctaaaggagtttagcttgctatttatactcgtctatatgttgaatttttagtggaattttaacatgacaaaggactattttagagctacataattcagtcacgcagttacgtgaggaatagggatggagatggtttttccatctcatcttcatgaacttggggactaaaatttttatgttttattctgtgtgggaattaaattatctgtatccatatcatctaaggactaatttagtggacatgaaatt

SEQ ID NO: 4452 - DNA, 1991 bp, Zea mays
  misc_feature (1)..(100): optimal_loci_230703_G1, chr6:137666663..137668653, Cluster 27
cttatacatgagtggtcattattccatgtttgggatgcttgatgcatgaataaggtatatgtaattttgacatacaaaaaacataatagggattgtaagttaagctatatcttaagtgggtttttattaggtatgttggactatccataagaaagtcttggtccattttgacataggagtttagcttgtccatgtaaagagttgattgctttgggcattaggtgttggtacatcctatcctatgggtgggtttgtatctaaaagacttaggctatttggacttgttcacatttttggtatgtgttctcagattctcctatgtgagtctcatactctcacattttccactaggctaggttagaactatatagagagctcttaggtctaaagggaatatctagatagcttatcagggtgtgttggaccatcacgtgtcaagtcaaggttatctagtgattgtgctcatttgcgtgattctatggacttctgaagtatggatcaagcaatctatccaatcaggacaaagagggcatgtatctaatattctctagactatgttgttgaactagctacgggtatactcaaaccttctatagcttcaacaaaggctcaaaggttctatagaaagatcatacaagttttagaccattaaagtgacactaatgggtgtccatgtgttctagacataaattcacaaggctatgtaggatctgcttcgtgcactcaaatcgccaatgaggtactcttggaccatccgaggggtttgggccaaaagccattaagtatgtgggggttttaattggttgtgccatctagtaggtgtacctagacgtacattagtattggttaagacaccaagtttcactttcatgcttgttgagagtggatgaagttatgtcttcatagggatcttattcctagagattgctatagggctttaagacacatctaatgatatatattgagtggattgtctaagtgtgcctagacaaagttttgtgtcatctttggttatgcttaggttggagataggaggcttgttactaaggcttctctgttgcccttcatcttcctcccttgatgcatcttaagtctccttggactcttccttctatcccataccttatctttccttgttattccttagaggagtgaagtatgaaatcataaagtgggataggtgttgtgatagtgttatgcaagacaaaatccatgctaatatgtggggttaggggagaaggagatggaaagctctccatctacatgggctgatgcgtcactcgacatagttaggtcatcaagcacccctactagaacatctaattgtcaatattttagcttattggattagataggcctatttagcaagtgttggaccatatgacgaccatagctagaccatttgataccctaaaactactaggtacaattgcacttaactttgcattagtatttttttgacatgctaattctcataatggcatgcatagcacaataatgcaaactaggtactacatacatttgttctcctacatttttgcaatatcaataagcctctccaatgcatttgggttagtggttttgagggtcagggttcatgctttgcttagcgcttttccttaaactcttaggcattaagtatgctcgtgaaggatgtttgtcccaaagtataaatgtgcgagtggggagtcaagatggtgtcgaataggatgctaaaggtgatcgctaggaaatggtcacgaaagggggagctcattccaatgggttagcatgaggacaaggagtggtaatagatctagtggtgaggccatagagatgagtaaagaagggcaagaggagggtacttgacgttgctttaagcactaaggaagaaatgcttgaatgaagaacaacagcaaataatggaaaccttggatcaaaggcggtgaatatcctaaggttcaaaaaccaaatgtgtgataggagggtaaaacagtctagtatgataatcc

SEQ ID NO: 4453 - DNA, 1410 bp, Zea mays
  misc_feature (1)..(100): optimal_loci_231906_G1, chr6:142768513..142769922, Cluster 27
ccaagttttttccaagaacattccttgcctccaacaacaactcaaatgatcagagaaacattcgagttaactatttcgaaaccttagtcatattaaactactaaccttcatggtcgaccatgactcgagaccttgttatatgttcgatacgttcaaactagtatggttacaatgatatgatccttaaccgacacaaacaggactaaaagtgcacctaggatctccattttctattgctttaccgatcattgacctccgctcggtttgccattattgtttttcttcataaattatgatggtaaaatcaatatgaaacctattgtgagcaatggtaagtcactcatgtactaccggaatatctaagctagcatctacatgaaacctatcatactaataagaatcatagcatatgaacatttatgcaaatgtaatccaacaaaatacaacaacttaatgaacacattgcatggtaataagtgcttgaaaaaatatgggtcatgcaccaaggcttggcttgggtataaattgattgtatgataaggttagtgggggcttcaagaaccccatcaatgaggaactcctattactccttgataatttcctcatactctaggtcagtcttcaattggtcctagtgggtccaacacaacaatttgtgaggcttgatattcatcacaaaagtgcatactaagcatccaaacaaagatctctatgaggtcattaaatcctagaggtggctcaaattctctttcataatatccttgtatggctgtttaggaaactccaattctttccttctcgatggaatatcattccctcctatttataggccaagacaacaacaacaacaacaaatatttcacacaacccctattctatcatgcaatacaacttattttgtatgtcacaatccacagtgcaaatttcttcatgcatcattatccattgtgcaaaagcctttgcgcattgaaatccatagcatgtaaaaatcatttgtcaagttttattaaggaataatcccctactaaataggtgcataagactagggatgctacaatgcatgcctcttggattaacacgactcattccttaaactctttagatctaaggaacacccttgagaactttgaacgtcttcatcattacgtcacccttggtgtggtggtagcactaggagaaggctctccagttaagctaccttggacacctagatgtagcaggggtttctcaatctaggtgttagtcaaagatttatgaataaaggggcatcgccattgggtgagtattgtattctttttcttataattgtactcatacgacaccccaattccttgatagtgatgacacagttaacacacttggcctaagtctcatcacactcgtttgtgctttagaggcttttgaacacca

SEQ ID NO: 4454 - DNA, 2020 bp, Zea mays
  misc_feature (1)..(100): optimal_loci_232496_G1, chr6:146213259..146215278, Cluster 27
gttgcatcgaacatccatggtagctggcatcttgcagcttgcagaattacagtattagtatcagagaaggatttctctaaaaaatcatttaagagccctccaccactgctattacacattcacaagatatatggatgtgatatgtccttgttgttaggctttattcagcagtttacccatccacatatccaaatttaaatcccgctctatgagcagtgcaaaatagtatttttggtgaccatatggataaattgttggacacggtcttatggaactctatcatgtagcggtcacttatttatattgatattgtatcttgtttagtcgacaggtgtaactctgtgttaaattgttgtttaattcaacattgggtttaaatagcgtaccaaaataaaagttggttactgagatattttatctcacacttgctccagtaattggtgcttgcttagaaggggagaggattagctaccttcgttaattaacttcgtatttaaaagcttaatgattcgtttttgttcattagaattgagagggggtgtttaaagtatgcttaatgaccgtattttttgttggtgttgaagtaactcatattcgctactattttctttaacgttaatttgatgcttttaggcatctatatatctttctttggtgttgcttataaatatacgaaggaactactgtcaaaatgctcgtttgagtatatcacgactgttgtctgtgaatcggacgtgttacacttttgaagcgccttttccctgtactgtaaacaaaagcactattggtacaatcttgtgtttgttttattttttttccccctcaaacttgtacgtaccgctggatcgaacaactcgctgtgaccatgggacaaacggcgagcaaagcaaactgacgatgctatcgtgtcatcactcgaccagaaatcgatagtgacgataagcagagcgacaaaggacgcgacaacagaccctgcaatgcatgcaacatggatctaccatggaattgactgtgaaggctaaaaacacgcacatcgtatctcggattgatctatcgtagaccgatcacccacaccaccgatggctcactgaaccttgccgcagagtcgcgccgcgcgtcgccggccgatgacgtcgtcgtcgtcgtcctctcctccctcatcaaggcgccccacagcctttgcccgaccgaccaaaaacaaaaccgatggtccaaaaccggatagtggatacgtgtccgtcgctcgaccacgtacaagcgcaacaagtacggccgagaaaccgatggaccgatcgagacacgcctgagcgggagcgctcggcgcttgacgggtagtactactactactagtagaaccggcgattgaccatgaccaaaaaaaataaaaaataaaaaacgtgcgatgccggctgcccacgggatcgtgacgtgccttggcgaccgaatcgaattggaacctcggcgcgcgtggttttggttgggcagagacgccggattaggaccgtccagccaatcaatcaggcgtcaggcaggcgacgatggagctggccgagcagacgagagcgcgtgggatattcctgtgccgtggcctcgtgacaagacgacgcggacggcgcgacaaaaaaagaggaaaaaggcgagccccggatgccggttgaggttgagctatcctatagtagtactgctgctgtagtactgtacttcacgcaccgctacgggctggcaacgaattgatcacgtgcatgtccggagtagtagtaattttctgcgtgataagaagtacgaatttatcttttctctatatataattttttttatagattattcgatttttttaatcttaaacatttccaacggcgttctctatatcttattttttatatacatatcaaagacagatataagagacattttgctccaaatttttatttaatcggttgtctaaaatatagagatggatggagaagaaagagagtctacatagaaaggatgtagtgtgtattttttttactcttgtata

SEQ ID NO: 4455 - DNA, 1652 bp, Zea mays
  misc_feature (1)..(100): optimal_loci_232648_G1, chr6:146846269..146847920, Cluster 27
aacacttcaaatgcatatagtgatattttttatacatgttaaccaaaatttgtatttacaattaatgctggaaaacaatatttagtttattttaaaaataaaatttcaaatttagtgagttgtatgccatgtaaaatacatggatgtcacatcatttcttttatatcattttttgtcattttttggtgattgggaacatgggcatcagaccgtgtgattttgtctgatgaagagcatcagactggtctgatgccactagatgctctctagtgcgtttttggcgagcatcaaatcgtttgctggtctaatgttgttggacttaaggcatcagaccatacacaaaaaatagatgttgaggtgacaatagtaacatttaaacgactagtacatgtagcatgatctaagggcattagaccctgagacatgtcgttgttgtgttcactattgatcaagggcttcttaactagcttagaggcattgcttttagcatcaaggtagacaggctcattttttgctcttggcctcttaacgagtcaagcaccatgttcctcagagtttattgtgagagctcatcaatgttggccatcaagtcctcccaagaggggtgcttgcatccctagctctccccatctatgttagagaaaggggagatggtgaggaggttagaaatggagtgggataatccacaaatgcagatcgacacttgatgggtgaaaaaacttagcatgtgtgtgattcattcaccaagtgattgcattatggaaaatgagcattgagttcctcaactataacaaaagttcagaggatgaatctagtgcgatctccaccgacaagcctagagccaaatcatggaggttaagtttgttgattatcttagaatgttctagaagtaatcattgagttccttagcctatcacaaagctaggttgtagaggtgaagcttgctgactttatcgatcacgaagtataggatcccaaagcaaaaaacttggttgttgatgaaagtggagacaagggatggatgcaccacgaagagtctgtagtagaatgcatggggtaaaaggagatgccctagcttgaggtaaagtcaacgatgccattgttgttaaagaacccattaggaagagaaggcaaaagtgaaggtttcaagagagagggaggtcgatgagagagagagagaccctatgactctttgtggtgttagggtttgtttagtgggctagtcatggtccttgcacttgtttttagaggtgggccacatataagcttgcctctaaatcaattttgaaagatatggttgcctctataaataaaagagattacctctcgaaatgtcatgtattttggctgagaagcacattgtttcctaccagtattaacaaaatcaatattttcctaaaattaaatttgtagtaatgatagggctcaatttaacctatcatgagaaaaaacactgctctaatcaaatgtgccctcaagatttttctaatgttaacctacatagagattagaaatctatgtaggttacacaagtaacatatagctaatataggaaggaaaaggtcacacaagcaaagcacatgtgaatgcaataaaagcagtaagtaaaaaactaaggatagataggacaaaccccaagatgtgcaatgatg

SEQ ID NO: 4456 - DNA, 1671 bp, Zea mays
  misc_feature (1)..(100): optimal_loci_232833_G1, chr6:147680096..147681766, Cluster 27
gaaagaccaccctctttagtggcatctacaatctcttgtacatggcccgagtgacaaaaccgagttcaagatagagcatacgtggtgagatcttcgccagcagcccaagtggtgcaccagacatgacgacgacaacttcaatgatgcaagcaaaatattatgtctcgacttggacggtgattatagatctacgtcataggaaagtatgaacacaccatgctctattggctacgatagggcaagagccaagtaacaggtagcagcgactccatctatacaaggcttgctagaggatgatccaaactaaattgtttaagcaatctaataaattgttggatcactctacgtcgatatggatgaagatagataaagacctatgagttagtattaaaaagttgataaagcaattaaaactagacgagatgaagaggcagaggaggaaaggcgaagataagaaataaatagtggtgtattgttattttataaactatgcaatttttatattttaaaagttttgacgtcttgatgtttttataaattatataagttttatttacttaattatatactcggatgtatttatatttcaataaatagatgaaagtatgtaaaaaagttgtagctttagaccgatgataaataatatgcactaaaatgtcgtagtagataagaggcaatgtagatgatgtgatggtaagtagaatataccggtaaaaaatgtattatacaaccctgagtcactagaacgttaatacagttaaaagataataggtatagaaagtcgtaaagagacgagctcgtttgtctcttgatttttttatatttaaccttttaaaaacctatcaaaaaatcgtttaattaataccctatgaaacgtagagttgaaacttgtctaaggacccacatttattggttgagctaccgcctgtccccttctcttatccctgacagccaacaggcagtggccaacaccaacagggtcggctagggatggtgctgacctggcagaggatgagatgggatccacggcgctgaccaatactgtgcgagtttacaattcccttctcccgaatttcggatatctcaggataaaaaagggagagagggaaaaaaaggctcgaaaatttggagaagccctcttcttgtgaatatggttgaagtgtagctggagattacgtatttgtattttttttaatagagagatggaggttaatggctaattataaatttggttgctggtactaaattaagaagtagaacatcacggtactctacagggaagttcacgcgaattcggatgtaaaaatatttaataaagtctatgcactctttatactagctagaaggtagaagtggaatcataatctcgtctatttgtacgtaagcttttatcttagatcttaataggactgactatatatacgtagaaataaagaatagtcttttcatatcttgtgtttatgtgtctttactttcatatgctatgttgatcgtgagagacgaaaagaaaaatgttctaaccacttgggatgtacacgataagcttagtgtccttcgccgatcttccatgttgtcctccgccgatcttcttcgtctacaaatgaaaaagaacgggtggaatatcatatacggcaagagtagattcaggggtggatgcacgaccgaagctgc

SEQ ID NO: 4457 - DNA, 1555 bp, Zea mays
  misc_feature (1)..(100): optimal_loci_244428_G1, chr7:41046342..41047896, Cluster 27
tgccaaacagagcaatgtaaacaagaagtcgaaaaagctatcttaggacctgttcggtagggctcttcctctgctaactctagctctggctctggcttctatagtaaacaactctctcctttttttaaggaaaacctctagaaagagcatcaggtttggttgaaaacacaacttctcctgcgatgtggtggttcacaaagagaaaaatatgggagagaagacaatagaatctccttttttgagctcctcactattttaaaggaagagcctatcaaagagcatctgtttctctgtttttctgtgctactgcagtactaatgcatagtgatgatgtacctggtttcagtggtcacaaacccagtaccctatgcggtatgcactacctatatggttctatcttttatttgtaggcccaccgacagcctctttctctccctttccccctccagtaattcgaggagaaaatcaggcaaaccgatgccaagattgctgctaattgctctttccttctccagtgattcgagggaaaaaaaatcagggaagccgatgtcatgattgccgctaattaacaccagcgtgaaacaactcttcgatcgatgatggaggcgatcacgttcaccacccccaggatttggataaagaaacggaaccacacgaggaagtgccccttttgataagttcgttaggatagcacggtggttggacgacgacgaagaagaatcgctggcccatcttcatttgattctcccttttctcagatgtatggctggctagttcatcattctctcaactttagtcatacgagctaacgagagaccaaatgcactgatcattctcaagtgccaggaaggagaatgtttgaatatctcattttttattgttctaacaagaaaaagaaaatgagatctgaataatctgtgcactgtgcacctcacactacgcacaaagtactgaataatccgaatcatgtgccatgtgatctgtcgatgcgaggaaccactttatccagaagggccgggctaggaatgcgaagagtataatggtatcatgtttttgcaagagcttctgtgttgttcaccgctgcattgcataaaatttgtagttttaattagtggccagcttatattttttttgaaagcaattttttgataaagtagtattttattaacttttcaagcataaacgtctctttttaaaaaaaatagagtggactcagttaaccacagcctctgctgatctgtcccgaagcgagccacctatagaaatgcatttgtagaggtgacatctattttcgtttgcctctataaatgcatctatattctgatgcgtctcaaaatacatttgcctctataaatggattctagagatggctttcatagagtacgtacacaacatgaatagttaaaaatttccgccagctaaaataattctcatcggtttttatgtaaaccgacgagaaataattaatttctattaattattttttagctgatggggataacattaattgtcgttggctttagaacatgtacaatctagagaccttcgaacgatt

SEQ ID NO: 4458 - DNA, 1458 bp, Zea mays
  misc_feature (1)..(100): optimal_loci_244439_G1, chr7:41068791..41070248, Cluster 27
agtcctagacaaaaaaacaactaggagtgtcctagaggaccgtctggcaacgcttcggtgaaaggacctaattagctagaggggaagtgaatagcctaaaaatttgtacaaactttagaaatactagtaacaaggtattagtaaaaataatagatcataatatccttactggcccctagtccatgtgctatccttgttaccaatgatgtcattatgattgtgttgcaactatggacttggccacaccaatgatagaccatacataaaactggtgcgtagcactgatttttaaccatcgtgtagaggaccttaagatcctctttggtgacacatcatgtgtcatctcaaggaaaaacaaccaacatgacccaacaaagaagaaaccataaagttggattatgagtctttgtgatactatgctttccctttccatcattataggcaatcttcttccaaaagtctaatgcattgaaccctgttggttcttttctcaaagagcaacatctatagaagtgcagtgtattaccaaactccagcaatgtgatcaactattcaatgttgaagattcaaaatttgatatacatgtctctcgtgacatgaagagtcattagaaactgtttagtcaggaggacacacccctcctcaatttcccataacttccctaaccaatggtctagaagacaatggaaaattcctctagcatacctgtgcgatcaaggctaaatgagtcaaaatacctggacctaccttggggagttgcagggctttggtctcgatttctccccatggaattatggcactaagggacatgaggatgggttggtcggtagctgatgaagcctctccgagttggctgccacttatggacatcctctcggtggctgcctgtgagctttcgctttgtgaaagagagcggaacctactactcacaaccttcttggctttgctaaagaaactaatcctgcaaaatattgcccaagaagacacccaaagggaaatggacaaacaaataaagttagtgttagtgtcagctatcactgttagcgttcttgtgggacaagagcctccataaaaaattcttatggtcattaaggttaagagaaaattatcttattatgcttaagcgacaaaattattaactaaattatgttagtcaacgtttaagcaagagattatggagagaaatgagtttgttgtttgaggcattgaactcagagtacatgggggtgcttttattcgtgagggagagtgagaaagtagggggttggtggctagccaaccatgtggtggggccagacaaccatgttctgtagctagtcgctcgtgggagagggacaacacagcgatgggatgtggacggtggcgtggcgaggaaggagggtctgggtgacaaaaggtgattgatcgatcatagagtgggcctaggtggctacacttgtgtccccttatatatatatg

SEQ ID NO: 4459 - DNA, 1715 bp, Zea mays
  misc_feature (1)..(100): optimal_loci_252609_G1, chr7:99833057..99834771, Cluster 27
aattgcctctaaaaatacatcctatttttcaagagactaacttaagacgtcaacgtgcaaaaatgtatgcttttttaagcggtcttctaagcctgagctcgcccgaccttttgcctacaggctctgcctcgttcgatctctgaccacgaagaggccaaggacccaagcatctcggtcttaagtttcgcctcgctggaccgcgagggtgaggggccaaaaacttcgcttgaccacccaagcgcgagattcctaggtccacactgtcttaaccacgggtcacttagtttctgcaagcgatcatcttagctcgaccacttgtagaaatttttattgaaaacgactgacgtaaagtaactgtctctaaaaatatgccctcatttataagcggctaacttaagatgatcgcatgaaaaaaatctatacttttcaagcgctcttcttaagaagctgcatgggctcgcccgacctttgctaagaggggttcaacttgtccaaccccgaccatgaagggccagggactcgaacatctccggcttaagcttcgcttcgcccgatctcaagggtgaggggcaaaaaaacttagtttttacaagctatcatcttagtctgaccgcttgcaaaaatgctttttttgcatactgtctatttaaggtgatcgtttgcaaaaacacgtttttacaagcggtccctaagaacaaccgcttgtaaagatgttttgccatcatgaaccctaacgtagatggtttctatttgactctagatggctacccaaattttctacgctttcgtgctttcgccgtcatcagctaatctgccatccctgtgccctgcagttgtcatcttccaccctttgctctatcatcctttccattgatgcaatggctatcgtatcttcactgagatcaaatcaaagtatagcatgatgctcacttggaataaactacaagaatagggatggcgatgcacgaagcattgatggaagaacgtagcccatgttacatttttcttctctctttattgataatataaaactatatatttatatcccaaagacttaaaactccaaaggaaattttaataactacaaccatgtttacataatagttcctaacatatatgacattgatcacacttaggtggactctacaccgcacacaactcaaaccttttggccactaatctgacccatctaggattggcgataacaataactttgtctgagcttttaaaatatatattaaggctcataagttaaaaaataacttttgtatgatccaccataatgatattgccaattattcactattactgctaatgacgacatagttccattaaacattaccattaaccacaaaatttatttagcatcaaaagcataacattgtccaaggaaaatattcattccttgatcttgatggctataatctatggagctttgtgtgatctttaattaattattgatgtaataaactattgactaacttttaaattgattgattttaagcatcgaaggaattaaaattttgattatagcggtgagtatgttagttgttttaatggctattcagtaattgacctacaaatatgtttcctagatcgctgtacatgtactctctaggttctaaattataatttttttttgtcatttctagatatattgttttaatatacctctagatataatgtatatctaagtgcgtagaaaaaatctacga

SEQ ID NO: 4460 - DNA, 1852 bp, Zea mays
  misc_feature (1)..(100): optimal_loci_253408_G1, chr7:104277641..104279492, Cluster 27
ctgatgcaaggaataaacatgaatgtctcccatattagcctttgcttgatcaaaatccaagcacttaagcaacaagcctttggtggttctttgatatagcatgtatgcaaatcaaatataaatacattctaccaaagatattaatcaccttcggcacttggatggtaaatagtttataataggagtcctccaatcacctatattagcccccaaactcattggaatacatttggacatgatttggattcatttctttcttttgcatagtctccttttaatatgaaatttatgtcccatgatgttaaagcttaatgcttcctaagccactatgttaggcttattgttctcatgctttgaaatatgccaatttttgtgatttcaagacatttatctagatagaaattaggcgatccttcgaacattaaaacataagaatcataatggattattgcaatattctcaagcctaatagagaactcacattcgacttgaatgatggcacaaaggcactttagtcatattttcacattcataagataaatttaaaacacctatgtcatgccccgtgggccttaaagccatcaaaatagttttatgtaggctcttatcgtagcacgatggttggaattactcactagctatatttttgctaagggtgaaaggaaagaatcagtgatatgacttcattgaagagtatgcataactagagatgaattcaagctagacataggtagagaatatgaatgatcccatgaccaatatttttcatgatttggtgcaaaccccaacttggcaattgtttgttaaatattcttctctcgtttgcttccattgcaccactttcttgaacaccatcattgtgagcttgaatacttatttaggaacccatgccaagacctattatctcagtttctctgcactaagcttccagaactttttttcttgccactttgataaaccaactgagcatatcaattttgtttccgggttggacaatggcaagtctttcttgattttgaactatctcaccttcttttgtttagatttggtacttataatatcaatagattatcctcctatgtctttactatgaatagttagatcttttagcaatgtaaatggcttttcaatagtttcatttagatttgatcttttatccttgtggttatctttttcacatgataaagttgctttgccactttcttgtttggttgaactccaaactgattttgatgaaaatgtcttttacaacatgatgatctctctagatgtttagaagatgcatattgtatgtaatgttctataaaatatagtggaacatgtgcctctttaataaactagccccaagatgaataaggatgaaaacatatgagttctcctctatatgacataaaaatgactttgctttgtggaaaattttgatgactgaacctttcttcttatatttccttcctatatttagctagaagttcatagaaactaagctttgaccttttactcctcttccaatcacgacctttacctacatcagctctatggacatacttattatccccatctttatagacatgcgacaatggaggatcttgagtcgattccccttgatcagtgggatcaatcaccctttccttagttagacagattctttctatccctctatgtctactaaaattgtgatgaccttcatgtcttgtggaatatatctaatttgtagttcatggataacaaccatgtgtcgacttaagggatccacatatttctcttgggcatttgaaccttgagctttgagtgaatcaactaatggtagccaattaaaaacatattttgcatcaagaccaattgaatccagttg

SEQ ID NO: 4461 - DNA, 1481 bp, Zea mays
  misc_feature (1)..(100): optimal_loci_26001_G1, chr1:157978947..157980427, Cluster 27
tttccagaacagttttaggatctgatacctttggcctagcacctacctcacagctcaccgccctaatctcttcactaatggcataatcttggacagattctgtggcatcactgttttccactccttcctgagagtcaccaagactagagatctattcttttgtagtttcctttcctttcctatcgaatcttccccctattttcctcatctcttcctcctcaaaatgtctctatctttattagagtctttgttagctagtttatccaccccagaaacaccaccccggtctgctccgtgctattgaattccttcggctaagaaattcagctcgtagcccacattgttgaagaagacttccacacaacctttaattctggaagagttacaacattatattctcactctcacaggaccatcccttatcaggcttaattcatctatgcaatcggcttccccattagacttgctacttctttgacaatgttaacgaccctagcatgaactaggaggttgaagatcttaacccatgtgatttgtaagcttgcaaaagatttgggatccacatttgatttagagatcttcactttgaacctataaaaaggcatctcaaagctacttagtttggcatagttatccaaggaagatatgtctaggaacgatacgataaattcacatttttccatcctccccactccaaaatcccacttgacttgaaccaagttattaagttcttcttgaagcttctcttcgttagcctctccttctagaacatatatcatcacagataatccagttgcctgttccttaccttctagaacatcaattccaaagaagccctggtccagaagcccaaaaccaaatagatttaacttcttcttcgagctacattttgttgccatgtgccccatctctttacatttgtaacactagggttcattcatgcaatctaattgatgatgaccagttcaagtacatcaaaaacatttaatctccttgatcgattcctgttgagtccatgaatccttttccatatccactcctttttctgcaatccaatgacctgaccgctctagaagcagacaaaaacccttgctccctttcactcttaacagcttgcctaccttcctgaagatggtgaacatctcgacctagacccctccgacctccaaggccacccctggatggagcaaaagagatgtgccctctctagcccctcttccaagtccttgagtccctagagaatctattgccaggaaagcaacacacctgctcatataactctgatccaaccaaaccatacagacccctctgcaatttggctctcatatctttctcccttatttgctccgactccaagagatcataatcctccatccactcttttggacgacaatcccaactgctctcccattgatcacgcctgcaggccatgccccctctttcaccacctgagcataggttcttgagcgaggaaaatggaa

SEQ ID NO: 4462 - DNA, 2381 bp, Zea mays
  misc_feature (1)..(100): optimal_loci_265547_G1, chr7:170122541..170124921, Cluster 27
ggcaaatagagaggctcaagcaattcagaaacctcactgccagttctgcttgcaagcagtgataagcaagcctgcacgttctttctcacaaccattgaagcgtttgggttaaacaactcctgtgcaaggaattcaacaactccctgaaaactttgccgtcgaggttcactgtttgcttcatctgcgttgtttactactctaagtacttgtgttaggacatgatttgtctcctcctgctctttgtttgcatgcactggtaacctcttaagaacaaaaagaagaccacgcacgactctgacctgaaaaatgcatagggtatccacagacactttaccgaccaatgccccgagacccattacaccacccatctgagcttgccatgtgctactgtagcaacaatgcaataaccgaggtaacaattcctcaaatacagcaacccgcacacttgggggaggtgaatatactggatttaaagatggactagagactagcatgggggtgctaggacctccccttagcataccagtgtgtttcatccgtgcaagaaagattaatgtctcggcaaaaatattcaaagcagatagggcagcttttgcatgttgacgattttcgctggatagcacttcaactaaagcatccaaaaatattaaagggtccagctcccggagattagatgaagtgttgcatcttgatcttgatcccatgatgatagatgggagtgaagaaccaataggatgcataaatccagattggctggaggatggtgagtcaacatggaaaagcatagcaaaatgccggcatatatcgacaacataatcatccttctcatcatgaagactggtgtcagcattagctgcaatgatagctacaagaagagtcttgaaaacagatttttcagccagtagttgtgtttttgtcttcacacctaaatctccctacaaataaaccaaagaaaacaagcatggtgttgataagataactaaagcacaagaacaccagaaagaaactataagttcaacaatctatgaattcattttgctgtttgctcagacaagaataactaaaaactaggtaatatgtgatggtttattaaaagacatctaaacatcaccgatcgcggcaatcatttatatcgttttattgagtaacaatgatctagcaatgctactgttgcaactcacaatacatgcagatagttacaaggacattccagaaattgcaaccaagccaccaaaaactccacgaatgggctgttagcatttggtacctggtaataactaacaatacagagatccaattctagtagtacagatacaccaccgtctcaactataatcagaagaacggaaattttctttggttttacattaatttggcaacaatcatcaggctagaattatatcgaccataatatacattgttctactgtttttatcttttaatggaagaatttactatcatactatgttgattaaagtgatgtaagttggcatgcttacactcaactgcttggcagtcgatgatattgtaccctatggcctacagtgcagcgctcataacaattcatctacatgtaagtcaaaacactaagttcactttagattgatgacaacaaataacatgaaatgtaaatcaagcaatcatgatccaagggtaaaatgccaaaagaaaacagaggcatggacagaaaattgctactttgcccaatcataaatttcgacattggcagagtctccaatataatatgacactttaacatactaactttatgttaacagtaaaaaattaaaaaatgagctagtgcaagcttccaacttctaataggagttagtaaactacagtaaaagcaatgtataaagaacattaattatcaatcacttctaccaaccttcatatctgaagcatcattccgacgtcttgagggatccaggttagagattagcaatgtaccgagaacaccagggctcacaccctcgccaggtacattttccctcagatttaacaaagaatcgaggcacacccgaatgaattgaagagccttcttcctgtagaatgcttccaagccattgccttgcataactgcaccaacagcttggtgtatgcatctgtccagaggaaccaaaaaaggtgtcgcaggctcaaaagtcagaactaaacgtaatccatgctccggattttccttggattcaagtgcaagaggctcccgcaaaaatcgcctatttcgtccccccagcttccctaaaagttccaaagactttgtgccccatgtgtatggaggaggccttaaatgagaccataaagcaagaatgacttctgacattaaatttgccatgctaggttccaaaaagtcaggattcagactatcaatccagaactcaagtg

SEQ ID NO: 4463 - DNA, 1800 bp, Zea mays
  misc_feature (1)..(100): optimal_loci_266047_G1, chr7:172721205..172723004, Cluster 27
aaatacggtagatattcttcggaaacgatacttggaaatttcgtttttcgttttggatgcacaatttcgttttcgtttccgcttttttatcgtttccattttcgtttttgcggttaccattaccgttttcgtttaggctaaaaatcggcaaaatctcaaaaatggtcctcgaaaatcggaaattgtcatttggttttcagccctactcctcggtcaagccacccaaaatacatatgtcatatacatgcccttgttggaagccggtttcgtgggaaatagttcatgttgacaacacatatgcctatgcatgagcgttgtggtcgatccaagaagcctcatcccaaaagcataaatggatcatggtcaactagtataaatgggttaaatcaagtaggtcttgttgattacggacaaattagtacaatttagattatgcataagattatgaagatgagtggcggatccaaaggggggacttggagtgctcgagcccctacaaccataaaactttatgggaggaggtgaagtgtagagtaaaatagagggtaaagaaggcgaagagagaaaaaatgagtctctatcagttcgtagtaccctacattcataggactgaattggataaaatggtagatgttatgagagaagaaaagagaaagaaacttgtgttgcctctatcagttgtcaataggaaatcagcctttcctttaactcatttctggattcaccactaattgagatcatagatttgaatagtgattgtgtttggacaatcactagattattacagtgagttattattgagcaaaatgagaaatacctaataatcacccacaaaaaacaagtctcgcccgaattatatagaaatattgtaattcgaggttttggttataataattcaccctacaatctcaaaaagggtaatttaatctgtgaatagagcccacgtacttggctgatcttagtcaccagcaaagcaaccgaggccattttggtaagaaatagtagtacattgttctggccccgtttggttcgttccttatttgtaaaatcacattttagaatttcattattaaccaaataactcttgaattttatattggaatttatgctagaatctcacactagtaaggtcatatacaatctaaacatttggaccggttttccaagcataagaaatacctaaacacgactacatgaaattctagtctctagatcgtagatacagtcaagtcgtgaagacacaatatacatagagtcgtgcagagaaagagaaactcttcgcgaagagtcatctcttgatttcttttcacttagctatctagacctctcaatggctattcatttaattggattgtacataccctaatcccactataactagataataacggaagttgcattggattttgtgtagtatccaagttgtcaaaataaatcagtgggaacgaaacgccacatacaggtcgagctcgacatggatgctcgctcgatcgcatgtttgacagggatcagcaaagctaggacatggatttcaacaatcggcagcaggccggggcctgcagctgtctagctacctactgctgctgcgtcatccatggccgtgcacagtaaattaacacaatggaaacggagaaaggggaaagggacattttgtatctgcatgcatattatattctgaaatgatatgtacgcgataaattgtcatgtcaaacaataatgcatgcaatttgctaatttttggctggtaggcgttgaagcgggagaatcggcaatttgacaagatcgatcgaagatgatgca

SEQ ID NO: 4464 - DNA, 1954 bp, Zea mays
  misc_feature (1)..(100): optimal_loci_267113_G1, chr8:1329307..1331260, Cluster 27
tcttaaaaaaacccatcaaatttacaagagcaagttccaaaccactgagcaagtttgcatcaaggactacaaaggaaattgacataataaagagagcttcaaccatcctatggtaaccttttattccccatttatgtttttttttatttaggatgtggtgcctatttgatattctgtttgtgcctttttatttagggcttattcagttaggggtggattgtgtctattttatttaggacctggagcctatttgatatcccgtttgtgccttttttatttaatcatctctaatatttcttaatccacctcaaaccaaacaagaccttagggtgtggagactgtatgtgcctaacagtcgggaaagagtccctatcggtgtgtgtaagcttttctttctttttaccttaattaaaatgcatatctcctgccacttctttcacaaggcgagactttttgagacttgctaactaacatgatcatattcaaggattggtcacttaacaacacgattgaactgcaactccaggcccggccctagttcttcacgggacaatggcagctgccctgcagagcagatatcgcgctcatattttccgggcaacctgcacgtcattctccggcggaccattccgtcgcgtcgcacccagcgcatccttgcttgtgttccaagttggatacaacgacagacgatcatcccgcacaccttgatcgggtggggaggaaatcgcgctgctaagaaaacatgggaaatctcttgggcacggcacgcacttgctgatgcagaaccgtctccgggctctgattgatctggcctctttatcctatcctgcagacgttgcttctgccagtgaaaacgcgcacgcaccaaccgcatctgccggattttcttcagacacacactttctactgcatctgtccatagagagacgatgttaaaattcacatttcgaggaaaacaaaaaggtaatgcaggaaaactcccaagtcacagacgagaacgaacaccgcacatgctatctggcacattttctcgcgccagatgctcatttattaaacagctttgaatacagacaacgttgtgttgctgcataattaattaaagtacagaccagttagtactttgtgcattgaacaaaaaagaaccataccagtctcagcctccaatgggtgagtgtctgcaggggattgtggttggggccattgctatgaacaaggtgcgattgaactgctcctgtgatttgaatttgcaggttagctaactaaagactttgttaaccctcacctaacccaaaaaggaaggttcagcggcctcgatttctcaaacacggtgctcctagacctcccaggcaccaagattattaaggagttggggcccttatcactttttttttggcacagctctgaaatctttcatccaccgtccataaaaacgattcactgaaagctcgagtgctaactgcattatgcccaagagctgaaaaatcaaaagcccatacttgctctgtttaaaacctctatagctaatagttaactgatgaaattagatatagagatttcaaacactcccaaccaataataccccatctaattgttagctaactcacgattaacaattagttcattagcttctgtggttactagacaggtttgggctctcgacttggagataatacccagcgtcatgtatgctggtagctatttcttctgatctaatgatctgctctcttagggcaactcatccctccttttatagttcaaggaggggacaattacaaaagctcatctggtagtgtaccagataagattacatatcatatacatattaggacatgtatcaccttaaccaagtctaactaggaccctctgttttatgtttacatataggtttctttcacccattggactctatcttattacatgattattatccttagccacttgatcaccagtttct

SEQ ID NO: 4465 - DNA, 1528 bp, Zea mays
  misc_feature (1)..(100): optimal_loci_268682_G1, chr8:9911425..9912952, Cluster 27
tttgctttaacaattatgattttttatactttatgagttatgtaacttttatttatgatttgacttatttaaattttattttcttaattatgtactcggatgtatttatattttaataaaataacatattttatgttaactaaaagtctgtaaaagaaaagctgattgacactgatgtgggtgtagcttgacaataaaacggtacattggagcgtcgtggtacattagaactgaagatagttgatagaagaataaatagtatggttaatagttcatcgtggtgatagatatgtagaactagcctagtatggttttatcacgtcatcttccataccaccattaaatacatccaaggaagcatatgttgcgtatgtacaacattaagtctatgaaacagtttttcaagtataagggataactaaaaggctacactacacatgatacaacctaagccactggatcataaatgcagttaagattcaacccatatagaaaatcatgtagagacgaacttttggtgaagagaatatctcttgtattttttaattaacacgtagagacatgtcaaagaacacaatattaagtagggttatacaatatcattaggcttccaaaacaggaaagctcaaactgatgtccaatttgtagttggggtgcttggtctgttgctgttggtcagttctagccttctaggtcatgtgtcatgtgacccaacaactgttggtagtagtagaacggacgcgactcattccagccatttatggtttggcactcacccgaccacatcgactttcttcatttgcaactgtacttgaatggattatatgttttttcttcggttttctgatgagcgatggccatcattttccctgcccacatggtcaaagccctgtccacataataaattttaaacgagattgattgatggctgtcttgtggaagtactatttgcatcagcggcatggaaatcttgtccatcctcgtgggtccttgcacaagaaagtgggctttacatgttcctatttttactttagcttttactctatttccctttttttcatgagagaggaaattcctggtttcaaacgcgttgcttagaattaatcatattgttcataagagtatttttactagaactagagtgtcacatgtcacttcatggcgaagcctctatgaacatctcctctaaaactaacaaattcataaaatttcaccactagcacattaaaaaaacgtgttgtgttcgatatgatgattccaccactgggctaaggcctcttaagagtctgtttagatgcataatgataattattagtcaaccaatttttaacttcagctcatctaaacagaagagctaatatgcacaactatgcaaccatacaccagaagtttagagtcatccgattcgcatccaatgcacatcagaggtggatataaagggcatcaaatttattaaacctaattaagcctaaatataatatccataattatattcaaacatttgatatgacacgaaccccttaatata

SEQ ID NO: 4466 - DNA, 1751 bp, Zea mays
  misc_feature (1)..(100): optimal_loci_280655_G1, chr8:91027974..91029724, Cluster 27
aagacgcaaaaatcaacagagagttcatgatagccataggtttcacatcgggggaagaattcatcctcagtatcttgcgattcgtcaccgactcactcagatttcttaggcgcgtcctagattttccagcggttttgaaactacaagataaagatcatgaagcttcgatctcatctcaatgagttcaggtcaatccaatcttatgacatcgactcggacttggacccaacttcgaccttaactcagactcagacccgaattcaactcaaattactgatccgacccaaactcggacttgggctcggacttagactcataagatttacttgaagagcgcttcgtgttcatagccaagtcaatgaaaggacatcaggaggaccatcattctcaccctaaagaagacaatgtaactaggaactaaaggagtcataaagacttgagagtgcatggtagatcagttcatgaccagatttaggtggacttttgtggctaattgatttatacaccatcgacataaaacattgtgtcaaagctaatgtttgaccaaatcacaccatttctacccaaggacaacacgcaagcacataagaacctgaattgcatcaataacatgttagccaatgcggccatgtgtgtcgaggatccagttgcatcatcgtttagccttggccaactcgagctagtggttgaaccaactcggaatgagccaaatctttcatagggaagctagagtcattcacaaactaagtgcccagttcctaccacacacaatcgccataatggggctcggctagggacttggcctacttaggaccgaggtcaaactcttccacatgatgagaaccattgtgccgagttgggccaacatcatcggcaatagaaccaagacaattccaagcatcaagatctgaaatatggtggatatgaagctaaacgtgaagactcaaactatgaccgagtctagcagaatcaggctcatgaaggcctcttagtttctattattaactaattcacaggtcacctgagtagagtcagttggcaaaaagaattttaagcctaatccggttgagtcatatgatggtcctaccaatccatcagtgtggctcaggatctaccagttggatattacagtagtagggggtactcttctgttttggctaactatctacccatatatcttggcactactgtgaggaagtggctattcagtcttcctacaaattctgttaactcatgggaggatttgaaatgacaatctatcaataacttcagtatgttcaaaaggaggatgagtcactacgtaattatattaagaggtggcacaatgtgaaagatgacatatctagcatgcccaaaaaatagatatctatgtcttccgcaagggtctcaggagctatctcggaagcttgtacgatgacaccccaccactcttgcctctctattttaagctgcaaacaaatacgctataagtgaagagatcattcaatgcatgtcctcgtctaaataaagcgaggatagaaaaaaacatgaggatgagttgggtaatgataaggataagagaaaaaatatggatcatcaactcacaacaaatgttgaacataatgagtaccagaaaattatgggagggacatagtgtgtatcacccaaacaactaccataaaactagaaactatttccatcttaagaggttcaccaaggactcaaacaaaaagtataaatcaaaattcccaatgccatttcaagatacgcaa

SEQ ID NO: 4467 - DNA, 1494 bp, Zea mays
  misc_feature (1)..(100): optimal_loci_28113_G1, chr1:171550988..171552481, Cluster 27
tgtggcccgagtgggcctaatcgttagcatgctagcccccatgttctagcccccctaaccgtcaggaccatgacatcccttgtgccctagaacaactgacatgtaaggttcactagctaccctcgcatcttgaggatcctagccattagaaccatggggtccctcatatcctagggcacctaaccgatagggcaccaagacccatcgtatcctcaaccatctagtagatatgtcctctaggtcccacatgcctaagggtccctcatgccccgaaggtccgaagtccccagggctccatgcacccaatatgttagatggataatgccctaggcccccatggccaaggtcacttagcgaagttagaccctaggctccgtacacgtcaagagaggtcatacaccttgggcccataagggtcatacaaatattaggggcctatcaagaaccatacaaggccaaaacatgatccccatttggaggatagttcaaagaattgtaggatacaacgcccaaacaaaaaagtatatgatacaaacacattaaaagcacgaccgatgatgttatatgtgtgctggcatataccctggtcaatttaacacttgagagcattgggagcaaacatacaacgaatgtataacctagatactgcatgtatggattacatgagatgtcaaaaatgtagaacgaccaagataagtgagcaatgtggccatgacataaaagtccatgacaaggacaccgatacatgataatgaaattgtataacccaaacggaagatatctcatcaacaaaccacattaaatgtagtgatacacatactacacctggacaaacatgatacctttagcttcgtacacaaataaagtacaataccttatggcataaggactgacacatcatgatgggtaagaggagtctatgccaactagataggatgactcaagcataatggtatggtgaatgcatgatagcgagagaattaatgcaatgagattgaatagtatgataatatgaagacccaaccccacgaagtgtgctgagcaagcatgctagcatgaacgtagttgttgggtcaggcccatagaaaaatgtgtttctaatgcctcccacccctttggactataaaaggttattgtggagcacacatttaatctaaggcgcatatgactaacacccagctagacatgaaacttcaagacaaaaccctttgctagaggcaagaagcataactaggtggtcatacagtcccttattgaggtactatggcctcataactcgaggattataacagtgtgtgctccaaacatatagaaatgcttacagaaagaggacatagggtggcctgaacctctatagatcatgtgtcattatgcttgagcaactatgacctagtaggtatattgcacaacatcgagactggctccctgttcccctagttattccattcaggcaccttgggtaccctagtgttgttatcatgacaaaagatcttg

SEQ ID NO: 4468 - DNA, 1493 bp, Zea mays
  misc_feature (1)..(100): optimal_loci_281269_G1, chr8:94705685..94707177, Cluster 27
aagcatcaattatacctacttgagtcatcgcatgttgctgttgtatgaaagagtagaagtagtcctattgcgccttctaatgcttgtcatgccgtcttagcccctcgagcagcctagccacctccaagtccttggtgggctatcgagaggaaatgcccgagctacagaacaaagaattcgtcctatgagctctcacctccattgagttagtcatttcattgaaaagtatgtacctacaagtgttttgaaaacacacttagggcatgatcatattaataacacttgaaaaattgataagttattagagataactgcacatgcatgtgttatctctccaccgcttcagagctgtagcatcgaacaattcatggtttgggccacaccaaaccatttcctccccatgtttcacctatacaatatttgtaaacaaagacatccatatattgtgaagttgagctatttatacttttgagccaaaactcaccagcgaatctatggtcgtctggttgcatagctactcgagttataaggtttggtcctctgtagcctgctatgtacacatcaataatgcttggattttgatcaatatcgctgggcttttgactagtgctatgtacacttcaatattgattgagcttctaaatctaaagatattaacgaactaagactattgcatagaatatgaaaaaaattcatcgaactctagaaatataattaattgagaaccataaagattaattatctagattttgcaagtacttgatgccttagcgatgatctagatgatttaaatcaagggtaataactggaattaataaatcaatttagaaacaaaactagacatgcaattaataaaccaaagcgagaggaacaagattaccacattaatcttgcatcaatatcatattaaccatcaagattgtgtgtaaaagtgctatcgtaaagcaccagagagatttcccttgaaatctttaaagctctaaattaatctgtgattttagatctaatctattgctgaactctcttccaaactcgtctctaaaaaaacactggcctctatttataaggagaagagagttcaattttagcccagtcaacctcttactgcgggcgagtgcgtccagcaccgccctagtcctgagtcctcggcctcgccttgctgcaggccagtgtctcaccgcacctgctgggctagccccgtagtataggccacgcacgtcgggcctgctaggctcacaggccggctaccccgcgctaggctcccgtccctaggccaccctatgctagtcgtctgctccttgctggctgggctagatacgccagtgattgagtcagcctggccacctagctgctagctgggcgcctgggccggccgactggtagcttttttttcctttgattcttttagacgtctcaagcatgtcacaccgcatgtaaccgtcaagtacattgaggtttaggccctgtttggcacagctgctgcttgttggaaa

SEQ ID NO: 4469 - DNA, 1792 bp, Zea mays
  misc_feature (1)..(100): optimal_loci_284667_G1, chr8:113019212..113021003, Cluster 27
tatagagaaagactattgtgcattcgagctttttatgtaaaaatcatgtagccaaactaccaaaagtcgtatttctttgaaaaaaatatagtttaatttattatttactctacaatatatcaaataatataaagaagtgaaaagtttagcatttttaatccttcgtattggatagattttcttatttctatatcttgtaagatagaatgaattagaacttggaattttaattattggtagaacaaataatgaagtacacctatagttttttgagatttttttttttacaattttgataatttggttgcccgataattgcacaaaaattttgattgcgctttaatcttccacacagccggcgattgcacgacattttttcacgacttttgataaagtcaagattaattttgataagcactaaaatattaaccagtgcatgttttgtatatataccaattgcagtaatgatagtgctaattaatactttattattacttagtgattattaattaattaagcgttcttatcgatcttatgtagtctcattcatctaacatttatccaattaaaaaagataactactttcatccatcgatctaaataaaaaattacttatcttatacatctaaccaatcaaatctaactaaacaaataatataggtatttgtatcccaaatccttagatggtaattgatagcatatgcgccgcggagacagtggtcgcagcgtcgctgtcctgcggctgctactgatacactgccaaatatattcatgttgccttagctgaggcctggccctggttgggtgtttctttctgacaaaattaatagagccagctctcttagttaaaaaaatatttttatcttaaatttcaggtttaaaattttagctctttttatttaaaccgaagctttagtttattgtaatttatgtagacatatttttgtagttttgttggatatgttctcgaactcgatcaagagaccgagtttagagtgaactcacgccctgatgcacaaaacttcatgtggttgtggcctccgattatatggtactacaataatcgaggaagggaccaacatggaagccaatatttttcccactatttattttgtatttaaatgagttttatgtactagtgaaaaattaagttagaaatgagaaaaatggtaacgctgttgagaacgagatggaatcttcaaagagttgagaactaactagctatagtaacaataacaatcaagtactagtaatgatatgcacatgaatggacacatgcgctgtcaggctggatcgcatgtgccactcattatctaggaggcataggaatacaggattgacggagaaaggacaaaaacgcttggattatggaagggaagctagcaggtgtgctgtcgcggactcgtggcagatgcacctctacacgtctctgctttctctgagtttccgtgtgctatctgctgtgctgggtcatcaaactcgccaaattttatatttgatccaagttcagaacgaacgacaagcagtgcaagtcgatcgatcgatccctacatatttcacgtgaagagttccgtgatccaacaaaatgaacacctcccttcttggaaatagtacaaattaactgttgcttctcgtcacatcttccagtgaatttgtctttgtctgtgtgtgaccaaagttgatgggggacttaaaaaatagagaaactaaaaattagttcttataaatcaaacacccctttaaacttctccatcaactgacagttctcaaataaatgccgtaatatcatgaa

SEQ ID NO: 4470 - DNA, 1831 bp, Zea mays
  misc_feature (1)..(100): optimal_loci_284668_G1, chr8:113021376..113023206, Cluster 27
accttccttgcttgcaatctcacaatcatccatatatgtccccacaagcaaaagcagttgatatatctttcttggcaggaacatgcaaatgagaaacagctaagcaagccgattgggtgacctcaaaaatcgtcgcatcatcttgcagtgaaacgtcagtttgcgagctcacaccatcttgtatatatcaaccttgttcaactactggcggctcttgcgtgcaagtgcaaggcgtatacgtagtggtgtggttcacagacctatgctacctcttgcatgcatgttcttgcatacctggaccaaaagtttgttagccaatgaattggaaactagctagcttaaacactttgttccacttccaccacaaatgcacagtgacaagggaataaaggtcagtgaccagcaaagaagcatatcatatcatatcaaattattagatacatatatgattaagctaagaatcaactttattccttgacaccccaaaagaaccacactgtacaagagggatcgatgatatgcgcgcaagcattatgtaaaactttctgctatatgagttattaccatcatttttgcaaaccttgcgacacaaatcaggatcataatcagcgcggcagaccaaaagaggatcaaaaccatataacacggtatagtgtgatagcaaaaccataacagctactgcaggtactttaccatcgtcgtctagtctagaggatgcatggccaaggctctctgtactgccagttaagcttggaacataccctttcgctttgtgtgggctctctttagagcttttggagctttgatggacagtttagcttcacatgtagtcttactccatctctttggaggcttgcattggtgtgcttgtagtggtctgtaagttggtcccctcatattgcgtggaagcaggactagctagagactagagtaagcattggagaacatgttcttttctttgttctgttctgtcatgcatgtcttggtgtgtctttttcgatggagattctaatcttctgcgtgcgtgcatgccactgttctgccataagcaagctagctttgcttgcttacttactgaagcttttctagctagggttaggctgggtggcaagggatattatgtaggagtaggtagcttttgttcctcgtaaaacagagccgatactgattccagctcgaaactagaggcaataccattactctaaaaaaatatcactattaaactaccattaccaattgctttagtagaattgatataaaatagagtatcaccgttcgtggttttataatcgttttttttaccttaactagaatggacggttaaaatgtacgattagaaataagtgatcttgttgttcctttaaacgcacaagtgcatacacacacctccggccccgccgcacacgtacaggggtgccaagaacatgcgtctcccagcaaggggagaaaagccaccgctatcaagggtcaagccccgaatgaaaaccttgcacgccatgcatgcaggcatggctccgagtggggcatccggttcctgcttgtagagaacaaattgcataattaagagagaagacagcgcacagctggttgggagatatatttaatactaataaggagttggtatttttcggttgctagtctggggcagccaatcgaataaactgtgtcccacggcgtgacctgtatgcatgcagatgcagcttcgtcccgctggacttaattaagctcacatggaacaatagttcattcatgatttgatttgatcgaccaaaaaggattctaaggcctacttcagtagattactcaaggtttacccatatgcactgttttg

SEQ ID NO: 4471 - DNA, 2136 bp, Zea mays
  misc_feature (1)..(100): optimal_loci_285865_G1, chr8:119750598..119752733, Cluster 27
aagagagaagtggatcactctggggaaggagacatgagagatgaagatgaagtctatcatcaagatccgtgggaacaacagaagaaaagcctggacagcaatggggacaatgaatagaagggtcccattcaagtggaaggaggtgaagaacataaagagatcccgatcaaaagagaggtatctcacaaactcttgcctgacagagcttcttgtgatttctgccatcttaagaattactttacgagagaatgtcgtcatcgattccatgtgaaacatgtggggcgatgatcatattgttttcaactgcaaaaaatgcctcccttggaatctaggccttgaactatgtgttgctcaggtagaggatcaaagttttttctatatcgaagaaacgatagacaatagaatgattggggagagatcgagcactgctatgatttctatggtacagggatctgtagatgaaaaacaaattgaacaagagtttgttaatttgctttggaagaatgtttggaggtggtctagtatatatattggataaaataatatctaatgagattccctgaccctaagatgattagtgaaccgagatatttcatacccttggggatgaggaccgttaaagctcaaattacaattggtccttggtcacctactgttagtgctaaaagttgtcttcaaagagggtggttcagaattaggggaatccccgttgagcagagatccattaaaactattgctaaagttggaagacttgtgagaaaggtggttgaaattgatgaaaaaccaggctgtgaaatgaatttgtaagggtaagaattgcctgtagagatgtatgtgttgttcctagtgtggtggaaagctctttaagcctattcatatatgacttttatttcgaaagaaaaattcaggatgaagaagccaatgataaccttgagactaatattagagtggggggtatggaacaaaaatccaacaagaaagcaaagtttgaaggtaatccttggaatgaagggagaaataaagggaaatgacaatctaggatcaactttaagcagcaaggggaaaaagagtggacaatagtcttaggatgtggtcatacttcatcttataaaaggaatgatgagacatacacgcccacaaagaaagcaggggcaaaagtgtgatgactatggaaaaaagacatgaaatagagaaagttcaaatcacaaacaatgaagaagatgaagagagtgatttgattggggatgagtttctttatactggtatttgcatgggggatcttggcaaaaataagagtttggacattggaaagaaaacataagaggagaaatgcaaatacccattaatgtagaaagctacttctaaaaaagtattgtggccattgaagaaattcaaactaatgacactatggatgggagtgatagattggaagctctggctggaacacaagaaagttccatatttagtggtttacaagaagctgaaagcctggatggagaaaatattaaaaaggatggggatatagataataagaaagaggaaaggaacgagagcagagctgctcctctgggattgaaagaaggttgagtgagaggctcaagaaagatgctggcgtcaggatcgaggagaaaacagaatactcgttgctaaaagaaatcttgaaggtattaattgtacctctaagagctattttaatactttttcttgcaatgatattgctagcatagccaataaaattggaattaagatagatgaaaacacatttgagaatgctgacttgagtaaagaaatggagatggctagactttgtttggctcaaaagaaaaagaaactggaaaatgatccaatgaaagggaaaaacatgatgaaaataaagatgattttgatggggataaaagatggacctagagtgaagagtctgaatcagacaacttcattgtggtgcagtccaggaaaaagagaaaagaaaaaagaattaatgtttaaatgtctcctatcaccaaagggcaaattagttttgacccaaaaaagaaagacaaaagaggcaatgccaaaaacccttacaccaaaagtaaatatgcaaatgaacctaaaaataaagattccccgttgaatgggatgttttggaattatagg

SEQ ID NO: 4472 - DNA, 2499 bp, Zea mays
  misc_feature (1)..(100): optimal_loci_291317_G1, chr8:149461313..149463811, Cluster 27
tgataaggagggtgacgatagagacaatatcctccatttaatgacagacatgatcgagatgaagtccccctcgagcattcgttgctgccttcggaacctacatccacatgattcaaagattagcatatgattagtcataaccaagtagaacatgatcgaaatctagttggaccttctccccaacaatttattcatatcttgctacggtggtagttgcttgtagtcgtaactagctagagcttgtagttgtaactaatttagttacttgtttttgtagctctaattgttcttactaaaagtatactttggtgcttgtgattagaactagaaaacaaagctgctagaattgcctgggaggtttgcttggctaaaactagagctagtgaaagtagaggctattaggatttgttattttacaaatcccccttgcactagtgttgtgaattttgcaggaaactttatataggatattcacccacctccctctagccatttagatcctttcaaccatgcttaatctataagcccactactatagtccaagctttgatgaaatgagaatagatcacttcataagaggagtgaaacccatgcaagaaataaccaaactaaacaaggtagttaactaagaaattaagcttatatcaaaggtctaagtatactactaaaggtaggaacacttgaatggagtacttgagtaaataagaaagtttgtattcaaataagggaagtcttactagataggaaaggtataaggtctatattaccttctgaagactacttttaaactttgagcaaagcttaactaaactctacctcccattactagcctaactacaacaaaggtgaactaaactagtttccttgggtgatcttccttttcacttgaagacgattgagctatggcacaaacacgcttatttattgtgtgtaggggcaggggtacttgtaggagtaagtgaagaagtggcggagacatggtggggttagttgacctatggagaggttgatcgaccacttagatccaccatccttcaatccaattgctcatataactccttgatggaggttgataattattccaatggtaattggcttctgatcacatgtgcaaagctccatgtgggtcctctaatccttctattgatatgtttcaaccataggatgaatcgaccttgcactaatgattgcattggtcccaaagtgtggttcttctgaatggagtggatcagtgacatgggtgaggtggggccaggttaggttaaataaaagaatacatttgtaaccatattaattgaaaacataatatcactatgatgttggttgcaccctaactttggtgcaatgttgatggtcaacaatggtatttagtgaccatcaacaataactaaacaattcaatgagtggtaatgactcacttgcatgagaaacaccctctttgtaaagacactccaatgcccctatttgaaatctctcatgtgtccaaactcactatgaccaaacttcaatgctaacatgtttggttctactagaaggtaaggacatttttgttgtttctactattggttatgtcacttctaaaagctctaatggaagtaaaaataatccactgagctccttttctcaaacattttcaaattactaactccaacatgtctcccatagaatgaccattacctttagcatcgaattaggatttcacaaacatcttaagttttctacttgataatgcatcacctttcaatcttaatgaatatgcaaagttagaacacttaattgacactagataaatgcatttacgtatttaatttgtccctatttatattgtgattatctaccctataaatccagccatattaacttctctactgacctcatggctagtgaaaggcaaagccctatgcatatacctttggcttcactttgtcttctactcctttgcttctcatccttgcttccatatctccatcttattgagatcttgcatcacatgatcatgccatcactaccatgacctacatgtagctccgagtcttacttgtggactatacttaaccattcatttcacatgaaatcattagtccacaaaaacccaaatgacactttcacatttatagctagatttctttggatggcccaagtgcaaaagatgcatagccatgcacgccatacactcaaagccaaatatgcattctagtgggtgcaaatgcacccacaaccaaaagaaaatttagaggtaatcattagatattgacattatctgcacctcctcccaacaccatgcacccatcaagtcagccaacttgtgcctattacagataacatgctctagactctatatgcatggtagtgaggatgtagaagcttgacacgtgcctgaatgctaggtacaagctaacaaactcatttgtagatctaccatgacctacttggggtcctcacctcactcttgcctttttaacaagaatgcaaggttgttttaacttgtaggtttcacca

SEQ ID NO: 4473 - DNA, 1409 bp, Zea mays
  misc_feature (1)..(100): optimal_loci_291359_G1, chr8:149602183..149603591, Cluster 27
cgttcggcacatcaacatcactaccgcttccagtccgatcttcaaagagcacgtgccgactgaaagctacggttgaatatttcgcctctcactctcctccagcgaactcgcctgcagcgtgagggtgagggctggccaccatgtatggggcatgtgctgtttgtttattacttgttttttagtttatctaggcctataactcgtggtttcagagcaccgcacctggccatcatgctctgtcacgtcaagtcacacgtacaatttgagtcgtgatttgttaaacgaagtatgtcgtacgagtatatatcagctagcagattattacgtgcccgtgccattcaattgtaggagtttattcattcccaactggtatccacttgccatttcttcatctgcatgcatgggcagcggatagatatgcatacggaactagtgttgtcgtttcgtttcgttttttgcgtcacagtgcatcaaagcacatttcctctttaattaagttcgaaccaagaaaaggaggcctttttaagatcgaaccaagaaaatcagaagcaaattaatcaacaagccgacttatgttgcgaccgattctcctactacatacatacacataccacgatgttgtgattgatcaggaaaattaagactggtgttcattcagtcaattcaagcatcaggtgcggcctgtcacacacacgtcgtctgagcttctagagatagttgtttcagaagagcggcaacaatcgtgcacggcggtctacgtctccagcttctagtagtttagatttatacattgacatttctccgtggatgtggaaagcccgcactgctcgattgctgtgtcttaatttttctactacaattgtatgtccccggcccgttcctctatagatgccattcgtttcctcatgcgttgaagctgcctagatgacttggataaccccccacccccaacgtgaggtcatcgtgatatctccagtgacgaatcagagatcatgcatgacagcatggtagctagcttaaactatcacgcacgtactcttcctgacagcacagtggcagtacgtgtactgccgtactttgtcacttgtaatgcgcttcttctttttccttatttctctatctatctatctatctaatatataaagcatcaattttaatataaaaaaaataaaacattgcataatagaggtttgaacattggtggttggattcacatttacactcacctaaccaatagaattgtttgaacatatatatttttgtttttattaaaagaaagtctactcatataatatacactactgtacaaaaatggaaggagcaaatgggcggcgccacacacgttcctgtcctagtaagacgcacagatgcgtgtattacctgcgttatttaaccatgtggcatgtgag

SEQ ID NO: 4474 - DNA, 1980 bp, Zea mays
  misc_feature (1)..(100): optimal_loci_292585_G1, chr8:155987550..155989529, Cluster 27
atgatgggctccaccagatccatgctaggagatgagcgatgggaactaactcctctataggtgcagagacctcgcaaggttgagagcaaaccagatccctttctggtggcttcttcccacctcatacgaccttatcctcgggtgtggtagtgtttctagtgtggcaacctcgactctactccatcctccttcatcgacatatatacctattccatctcatatttgtccttttattgtttcgccttgaccttggtgctcctcaccacaaatacaaggtctcgtatgatacccaacataagacacaaatccaaggcctagtgcgatgtccaacacaaaggtacgcaaaattgcaaataattgtttgttgtgatctatggatcacaaagaatgggctagagtttacactttttttgagatgaataaatgttgttatgcattggtctggagtattatctaagaattgtataataacttgtatagaccaataagtttcatattgatgtgttattttagtacatgttggttgttgagtccgtttgttatgtgagagtaatctatttgaacatcatgtgaagactagcgtattttggaactagtacaagcctagaataaagttgaaatcaaaaatgtattgcaaatagaagatgtgaatgctatcatacttgatgtttctaagagtcatggttttatggtatacatttaatgttgcaaacataaatttgcagaaataagttgtcctaaagggaaaatgtagagcatgagaaggtttagttatcactagtaaaagttggcccaagatattcattagattcctcaatacggtagaagtgctatataaattctatgccatatagaatttgtatattttgataaatttaaggatagaattagattaccaaaggaggttgaataagatacaatatttttttacacaaagacaacaatggcttgcttcctaaatcttttcccaatcctcgaaaacataaaaactctcaaatgacatgctcacaagccaacatgtggttggatgctcttggtgcgcccgacaaatatagataagcactcagaatgaccagaaataagttcggggaaaaactctccaaaatgcaaaacttgagctctttacttcaatggaaataaaaatgcctaaaccaaaaatacacaacaaccaactagtgattggatgatttagacaatttcttagagtataagcaaactcaagaatataaacaaatcgcaaaacggacacctataagaccaaaagtgctcgaaacactgagtgcttaggttgtttaaacgagccgaatgcaggctccaaaacgcaaagatgatccaaacaaactctatttgaactaaattttttggatacaccttcacaaggaagtttcaaaggtgtccaaaagattgagctctaaaagatttgaacttcaatctcagattaaaaatatatgaatccaaatcaaggttttctcaaatatggtaaattggttagatttccattgaatcagcccaaaccagttggtagcaatgatcctaggaggtccttgcacgtttttgtctagcccaaatgtcctctaagaactcaggtttaaaagatcaatcaaaagataaaaaaaagtgtttgggaagaaaacccaagacaaaaacttcatgcaatcaaagatacataagagttgacttcagttcactatgaaccaccaaggttagggccatggttcccgaatatcaaaacacagatggaattttttttgctaaaacatctacagatctccctaacaagaggaatagaagctacatagatgtctagttgtggtagccctccttttttatttatagagggttttatataccctttagatatttagagctaaaccatttagctaaggatataatgatctaagtctcaatccaatgatttgatggtcatgctcccttcacggatttaattttccttgacgtgacgtaaccttcatgaaggct

SEQ ID NO: 4475 - DNA, 1572 bp, Zea mays
  misc_feature (1)..(100): optimal_loci_303519_G1, chr9:34637752..34639323, Cluster 27
gttctactaggcaaggggcatttcattaggcatcgacaacaaaagattgaactctagagatacttatctaggcaagatggagatgagcttctctctcccctgatctttttcgctagtgatatccctctgcttacatctcttctcccatcatggctcttccctctctggatttcagctctagtattggtttgcaagctcccatttggcggtgtttggtctctccattatcttttcaaatgttcccaggcttaaggagttcttcctagttgcttcttttggatgttgcaagcttcaccttaatgccaactctattggcttgatgttacaagcctcccttggcggcataattatcgggtttaatgtctacatgattggagagtgtgtctttagattctcgatttcctccaagttggttggattcttccttgtcaaccttcaaagtatcacatgtgccgactatctgattttattccacctttgaagtgatagaggtcctaattgggttaaagaatacataaattttcttgaagaagaatatcgttcttggtcttttgtctctagtctacatcgtcctccgccttctactaatgtacgtcatgccccttttatgagaaaagtcctacccttgattagtcctccaccttgcatcatttgtagaggctatcaattgtagacctattattataggagctaattgtgtgcctttgggccaaaaagtgtttggggatttgtcaaatgggccacctttgtttgcttctcttgatcagtggaagatcttggtctttgatcgattggttttccatatgaaaaagcttcagagtaattaatcctaagggattccatcttctcaaggatctggtttgatctgggcaagatttagcctacgcgtagcctaggcagggcttctcctaaagtggttggtgctcacagatttctttggattttgcactctagcaggatacatggggaaaacttgatggtcggcctacagactttcaaaatttcaaatgttgtgtccattgtctttgctcaggccacgacaagcagatctgtagcggccctatcgttgtcatagatgcatgagtctaggacacatttatgcttactactctttgcaagaaactgtcgaactattttgttcaaccaggaatgctggattatgctacatggttttcccctagattactggtcccatgagcacattcaaaatgccatcgccactttcgtgagattgcttcattaggataatgacagaagattcctaggaatgattatcatcaaggctcgggtgacggttttccaagacatcccacaattcactattctttcagtctccaatcatttcagtggaagatcatagactattcagtgtgaagttctccagcaaaacatgttaatcgaacttccagcagatgaggacctaatccctcccgagaacctagatggccatgaacttccttttcattttatggccttggacaactagtggaactgtcacctttcaatctcaatttattactggtggatggtaatgtagagaatgtcgagcatgataacttgctcaattgggat

SEQ ID NO: 4476 - DNA, 1478 bp, Zea mays
  misc_feature (1)..(100): optimal_loci_320058_G1, chr9:133801668..133803145, Cluster 27
ctatattagtggcttcgcatgactttccaaagacatgtcccttctcgatgaaactttgtaagtcctgaggcttcatatagtcttcatagacaaaattttaagtaccatttcttcattgacataatttttgatcatagacaaaggtgatcaagtgacttcaatcttcatgtgaatttccaaagatatgatagacaaattgtttgtccatgcaaggggttattttttatcaattcgtaaatccttattggtgaccagtctttacagatgaggcttcacttatggctaagactacattagtggcttcatgtgactttccaaatatttgaccattattgtcgatgaaactttgtaagtcctaaggcttcctatagagtcttcgttggcaaactttcgtaactcccgagtatttatcaacaaatcttctgttggtagtatgaaggtgatcgagtgacttcaatgtttgtatgatctttatgttcatctactagaacgatatttactctttggaagtatttttttgtttcttgttgatttccatattccatgttgttctttctagtgattgttaaaattctgcatccacttggtattattgtgttgacatttgctattggatgcgtggaagatttattgtcttgattggtttgatgattgtttgatgttgaggcttcttgctgaggcaactagaaactagatcattgaaaggttattggtctccattgattttgcatgagttgaatgtgatcataactgaatgggggtgatgggtttgaatgagttgttgtgtttttgctgtaatagaagggatagtacaatgggtgaggcgaagcctgatcctgaatgacatgattgactattattgattgatatgttggttttgtttcctcttatacttgtccaatgcttttttggacacattggtgtggtcaactcctttcccatgcatgacatagaacatatccttaggtcttagtggcttgtgatcgctatttgcctatttcgtccacctctttgtcctatgtgattttatctccggtgaatgttctgtcattatgttgacttctttattgaagatttctttcaacagattctacattatcattgtctatgtggtttatttgatgaaatgaagaagcgagtcttggctccaaaccagctggtttgggttgactgtggtcatgtttgattggagctcaagtgcttgtttcttgtttgacttgtttcctaagtattgtgtattatttgaagaatttttgcctgacttcatagagttcaaagacaattttagtggctctctagcgaattgggatgcacatcatcccatttgaagtcccttaattgcgactgtgatgaccatgttgtctcatgtgttgggtactaacgatttgattgaaataactttttaaaaatgttgagttggagattttcttgggttgttgtttgtagttgaagagatctactattgttagctatattgg

SEQ ID NO: 4477 - DNA, 2395 bp, Zea mays
  misc_feature (1)..(100): optimal_loci_320524_G1, chr9:135813972..135816366, Cluster 27
agaatcggatcgaaactcagccctcttagacggatcggattcgaatacggacagataatatccgtaccatttatatctctatatatcatatttgcattcttttatggatggagaaagtacaaaatatgagtagatcgatcatactctctataaaaataacttttgcaacggtatctgtactagtcaaactttttaaggttggtaaaatagtagcaatatttatatctctaataaattcattttaaaaaataaatttaatagtatatatattaatactacaaagctaaaaagaattaattcgtcaaaaaaaataaaaataaaaaacgacagacggaaccctctctgtttggtaccaattaaaatcgatggaaagtcacatgttctgctgcctcgctcgcgagtacacgtccttttcaaccttctgcgcaaacacgtacgtatatggatggagaaattaacaaccgctgctttacgcctttgcctcttcctctgaatcagacagagtggtccagtccactggtccttgctagatttatgtgctcttgtgcagcagctactagcggttattgttgttgtacagcctttactacctcttgcatggttgttgttgtatatgtatgtacccccttttctcatgtgaaaaatcataaatttatgttgtagggcaagaaacgatgatcttgatcagagaaataaaggctgaaaatgttaagtttagtttgagatcattcacagaggggggaaaacaaattaggaggagtgaattgaagttctggtggtgccgctggttgcccacagtgtcgtctgccccactactaatagctgttttaatactgttgcaaccactagtagagtatgcgcatggttccgaatcacacaggtcacagtgatgcagagtcgcaggtgcaggcatcctagggtgacagttcactaagtccaattaattaataaatggcatcggcaacggcaagatactgaccatgccaatagagtctggatgtgtaaccacactttattcagcaagtcagattggagcgcatgtatttgtataggctttgtgcggctgtagacttgtagtgtactcggtatttgtgctccatgctgacgtagtagtgaaaaaaaagggggtgtgtttctaggctgtgaaatggccaataggagcaggaggaacggtatctatctcaatgtgcatgcatgcatgaccagttaaaaagaagtgatggtcagatataagatagtttaatgacagtgtaatctccatagtactatatcttctttacgcccaagctagcaatggatcatttcgtttggacgagggcgtcgaatattacctgtcgcacaagttggagctggatgatttattaacatatacacatatattagaaaatgaagctgatcggcatccttgtgacgtatgtgcttgggtacggttagatggatacatagctgatcttcttgcctggtactggtagccagtacaagtaccccggcgaggggtttctttaaggctctggcctctggtgcacaggtacaggtacgtacctaaactacgggctaaaagaatttgagagtgcagggcatgcatgcatgcatggtccacagtgtacgtttaattaagggcatgcatcatgacagtgcgggtacctgctcgcctatttaatttgtgataattagtctgtccgagatgatgcgtacattgtggactgaaacactgactctgcatggctgtgtattgtggttccatggaagcatattattgtcctattgtacgtggatcgagactcgtacgtcgtcagctgccaaggtggcgtcggatatatagtattccctttatttcgtactactactactataaagttgccattgtagtttttgtcaatacccagatccagatatttatgtgataataatcatattctagatgactagatattcatattagttttatgttttcaaataattcatcatgaggaaaatatccggtgtacatatataatctgcacattatatatttggctagtaaattatatatgtacaccggaaaatatccggtgtacatatataatttacccagatccaaagatttaaactttgaaatctttggctagtaacttattcaataacttttagttattatagcacaaacttgatacaggtagatttgtaattaaatgcactatcccattatcataaatttgtaagtataaaaacagtgtaatatagaatacataaatgatcaaaatataaaagagaatagaggggagtaatgctggttagacattactctttccgccactcaataaattagttgcatgagttgtctgaagttaacctctctaagtttgactgaatatgaagaaaaaaagaggtaaaacgctttagcaatgagcactaa

SEQ ID NO: 4478 - DNA, 1469 bp, Zea mays
  misc_feature (1)..(100): optimal_loci_32137_G1, chr1:197393129..197394597, Cluster 27
cttttaatcacttcccatttgagaacatttaaggacctttttaaaaaaatacaaattttaaaatcactaaccttaaaatgatctgcaccaaaattatatgaatttttaaaaaccagttttatactagtggtacgtgattggtaacctatatatagcagtagtaggcagtaatataataaggtaactgcgcgcatggtgaagcattgctagcgactgactttcaagttgtctcctgatgaggaatccagggtggctccagtgtgccgggggccatgcatgcagaggtcgatcgtgtgcatgctcctgaattatcagcaccccctttcctgtcgctgagagggatagcttacttgaaaggtacatttacttttaatctttctaatggcagcagcgagagccttgtatgtacttgtggatgcaattatgcgaataattcaacaaacaacaaggacactggttctttttatttttagataaggtgcatgcatgtgagccagcatgcacgcttcacgccgacagctgcattgttcactgagagcgaactgtttgtcgttttttgtcctgcattattcgtacagtcatttcggttgaggtgatagaatcatttggattatttttttaattagagactgctattagtttccttttagaattagaatgaacaattcgatttctggtccaaacttttaaccagaagtagtgtgatttgcttggaaaataaaacaatgtatgcaatttcaatacgcagaacaatgtttttttatttgaaattatgaaacttgcgcataactgtgtttttctttgctgattaaggtcaagccaaaagttaagatgattccctctagtcaacaaaaaggagctcaaatgctaatgctaaattaacaatgcacattctatttatttagaaaagttaaatacaatgcataacaaaattcatttttttcatttttttacaaaaaaatattgcttaaaaacatattttatttacaaacatatttgtaactgtataatatggagttcaataaaaatgcatccgttcttgaaagaggagagagaggggcgggggtatgtttagagtcaaaattaaagtatttttaagatggtgaaattccccaatgtggccctattgttctctcattgcttatatctaacatcgggtttctgtaggatcttcaagtataagaatatgcaatcaaaggagggatgaatgattgcggaaacttaaaagtaattatatcacctccttctaattataaaaccaattcattccacttttctaaatctggatagaatacgttttcattaatacagtactgactaaaatccgtaactccaatcgactttaattttttatagattaaactagatacaattacataactaactcaactaaaatcacattgatgagactcttggatctagagatataaaggaaacaagaatgttatgatagagtatgatgaaaatta

SEQ ID NO: 4479 - DNA, 1546 bp, Zea mays
  misc_feature (1)..(100): optimal_loci_321905_G1, chr9:142915913..142917458, Cluster 27
ttgaaatgatttgctaatgggtggtaccacgcgacaaacactagacgaaatggagacgagatacttgaatcgttgtatgcgctttgtgagccaagcgctacgtgaaagttggaactaaatacactaccgacctgacctactcgaggtggggccctgagtaaccccgagacgaccacaccctcgccaccctccaggaccagacctggcagggtttattttatatttactttggctatttttttaaaaaaaatcatagtaaatcacaaaaatataaaaattgccttttaaacttcacatgagtagaacaacttagaatataggcccccatggccctaagacactccaaccatagagtgctcttcgacttagttctcctaactaattggagacccctaaaggcccctggctgagataattaacgaggttgggttctagggaccctatggcccccctattattttttgccctatgcctcatataattactgcactcaggtcatgaggctccctagggcccgtgcctttagagaagataaaggagttcctagttcaactaaacaaggaagaaataccaaagtatttagctcgcccctaccccaagggttgcacggccattgaaggtatggcgtcatgttgaagaaaagactagtgagaagagagctacatgggagaaaagtgaggggggattgggtataatcataccagaaaaatgtgaagaaagcaagacctctagaaaaatcctgcaagacattaagtggatttactgggaaaatactagaggaaaacatggagatagatcctttggagaatgaggaggatggtgacagagttaactatgatgataatgaggatgatttgcttagttctcaagaggcagatgatgattttgctaaaaaagtgggaggcctgatgtaagattctcaggggagtgagaatgttcaaaaggatgagggtggtttaaatgatggcttccaggtagcaaaaggcaaaaaaacgggtagcaggcagaggagtgaggaggagttcgagactagaggcgtatgaagatgttaaagtagctgacatggcgatctccagggcaaaggcaaaggatgtatttattcacaatggtaaatcatacaaccctttcttgttatgaatacaaatgattgtactttgattgaaattgctacaactttaaacgtagaactaggtagtcatgacaaggaaataatagaaagcgttagcatgattaagtccctagaagaggctaggcctagcttattgcatcagacagtgaatgtaaaaaacaatcaggatgaacaactctcacacaacaaggatcttctggtccttatagaggatgatgatatgaaggagctgctggacaactgttctgataaggacagtcctagatttataccgaacaaaaccaacagaggaaaacggatgcttaagtataaaatttaaggcaaaaagaaaaaaaaatagcctccaaactgtgagatatacatctaataatgtgagggatagcgtcatgggttcttccttccctatagggtttcctc

SEQ ID NO: 4480 - DNA, 1438 bp, Zea mays
  misc_feature (1)..(100): optimal_loci_323714_G1, chr9:151790100..151791537, Cluster 27
aagttttcaaattagccctaaaccactgagttgggtgcaataaaatcggtgcacgtaggagattaaaccgtacttgtgcatatcagtgtggtgttgttaccactgacacctgaatttcgcgaatgcgtgctgcatgttctctcgtcttgagtttcctctgctgccattttcctgtgcccgttttctgggaaccttgtgcacacattttgctattgaggcaccatttattattgttgttattattggcttctgcagttcactgttcacctttacagtgtagccgtgccaaatcgatgtcacaagagaaaacgtgatccgtcatttgcactctgaatgacacttatatagtcacctaaaacactgttttatataaattgtactatttacatagttgaatttgaatattagtacaaggattagtagactactggagataagcttgcagagggaaattaaaatatctcggagcacgcatctaaaaatgcatctggggtttctactcaacggcagcttagctggaacgcggaagatgctggcaagtgacaaatccaacggtagagtggtcgggtagggccacgagacacatgttctgctgacgatgaacggtgagggaagcaggccaggtcaacccattgtgcttgcgagttgcaacaacagaaaaagtgaaaaaaaccaagaccatctcgatcgaatggttttgaatgggcacaagtgtgtgcttcaccttcacgatatttcgttcctactttttgaaattcagtaatatattgtacggctgccaatagattccagcattttgcattgtttttgttggcgcagacggaagccaaacggcgattcgctctcgctaagagaagtatcgattgcataagaaacaaagagagcaaagcttgcttggcttcctccactgaacttcttgttccaattccagtccaaaagggtacgtagacatgtagtggactatctatctatcttctgctccctgcttgcagcttgcgttcgttcctctgaacttttctggctccgaactgtcaaagagtcgtcgaaatctaaaacaaaaggccgtgcactgcagctggaaaattactggagctgggaataatccacgattgtttactagctctattccaaattataaaacattttagttttttggacatattattttcattatatatctagacatgttatatatttaaacgtgtaacagaaaactgtagatctataaagaaataaaatatcttatagtttagaacagagaaaacatatagtaaattttaactatttagagtaccgttgttacggttacggcaatcagagtttcacacgtctcttcatttcatgtctgctcacatgcaagcatgattagtgcccttagctgtcgcactctggttaggcatgaaaaccgatgggatcggtatgaataatccttctccta

SEQ ID NO: 4481 - DNA, 1670 bp, Zea mays
  misc_feature (1)..(100): optimal_loci_323982_G1, chr9:152988435..152990104, Cluster 27
caacacatattatgtgtgttgctcggagaattacggatgaattagaataaaaattagactaaaatacctatatcaagaaataaattgtaagcgtaacccacgtgttgctgcaagacttatggatgaattaaaacataattagactaaatcacttatatcaagaaataaactataaacatatcccgcgtgttgctgcaaagaattacagattaattataatgaaattagactaaattacttatatgaagaaataaactattctaaattaatggcagtgccacctagcatactaatgacaataagtaaatacatgtgatagtaggttgttgaggtggactgcttgtatatcgagaaagagtgactaatgggtttaggattataagatatagagattaaaggaaggctggtctagggtagctccaaagaaaaagtttagaaagagaagaaaacgattaatcctttttgtaatataagatgtttgaacccaattgtcttactaagtctattggttttgtttttaagccagtggtggttttatggctttctttaagaaggaaaacaatataacaaagttataagttcttggcaaggtcctatcattacaggtggtgattgtaacacggttatgtgtactgctaataagagtaatggggtgattaaccataaatgacttaagctttttaatgatggcattaatagatgaaccttgatcaagtacctactaggactaggatacccacaacaggaatcgtggagatccccgtcggccaaaattatccctatcagttttttgcctggttgatgggaatgaggtacctacttagactaataatcaggtcgacttcattatggctagaattgatagggttttagtctctacttcttggtaagctacttttcccctcgctaggatgaaagctatagatagattaccatgtgaccataatcctctatttagttgattctagtgataatgctttatatttcaagagaaggtttaggtttgagaaagcggtggttggagcaagattcctttaggagtgttgtggagaaagcctaggaggtcccttgcaatgttaacaatagtttagatatatggcaatttagagttagaatttttaggagattggctagaggttgggcctctaattatgtggcaaccattaacaagactaaggttcacgttgcaaatgagtatagtagattggaggtcaaaatcctatgtttggttttggtaattgagaaaagtagtggtataaaatttggctaagtgtgtcattaagctaggttagatccacaccaatatggagagcaatgcttggagatagatgaaggctgatcaatccacttggagcaagttctcacttgaaaaaagagaaaatgaaatctaaatgtgtgaaggccaaagtataaaaaaaggattttgttttattggtaaagatgcaataaagtgtgcgatcgagtttggaatagatactcatactaatagggtagctctaattagcaaacacgactctctaatgccactaggtgttgatctatgttgaattctgacaaaccccaaactaagggaacatctagggcacaatgacgatacagatgtgaaacaacgtctcttgaatgtcttgtcaatcgttccctcacccccatttgggtggggtatttatagg

SEQ ID NO: 4482 - DNA, 1444 bp, Zea mays
  misc_feature (1)..(100): optimal_loci_33618_G1, chr1:205711794..205713237, Cluster 27
tatgtgtgcggtgtgcctcaaactgcaccctttttttatttttcgaaaccggtggatgtggattgttgacaataaagaagcctgctactagatatggtgcactaaaatacaaagtttttgcgtggaaaaaaagaatagaggaaactgcgtcgtcgagattgaagcgatgtcttgacatcttgtgataatttatgctataatatctatcaggcagcaacctcgaagttggtgtatatacttgtatatggatatgatggtgcattcacagccatgccgttgccgtgcccccggccgtctgatgtccatgcatatagagtctcccatgcatgaataatgcttgctggcctggcagctgccgaccgatgcaaatctttgtccgatacacgctagcccggccggccatgcatgttcccttgcatgtctgatcatctccatcttggttgcatacctgtacaaatatatatccctagctagagaaggaactggatgcgtacgtccatcaattcaagtccaacgagacttcgagtttgatcgaactgatgaccagctacccacaatcatgaaaagttatatctccatcctacaatatatagctaccgttatggtatttatactaatcaaactttactaaatttatctacattttataaaaaaaatatttagaacatttagaccagtaaataaatttattgtaaaaataaatccaaaattctatctaataataaatattaatagtgccttatatatatttagttaaatttaaaataattgacttctcaataaacaagaacatggaatggagagagtatctattattcaatctacttcctttatcccataataaataataaatgtacatctcaattatcgaagagtcattttttaaaaaaatattcttaaatttaattgaatatatacataaaaatactaatacccttgtttcgtaataatcatcatcaaatagatcgtggaatgcactttgataatatacttattcggagatataattattgatatgttttcatataactagttaattgttaaaaaatgtcttcccaacaagcataatgcgtgtttattttaggacggataagtactctaaaaaagactctaggcatatataaaatacactacttctatcaaagaaaggaaaaaaaatcctacgtatagttttggttaacatatctaaattaagtttagccaaatataaaggtaaaaaatattgtgacaccaaattagtatttatcttatgataattaaatttaatgatacttgtatgatattataaataaaataaaatattttagtttggtgttgtgctacaattatatgtatattttttttgtagacggaggacactggccggtttggttgtaatcttaaggggctaaaaattgctaaaccttttatccacatttccccaaggttagacgcttaaattgta

SEQ ID NO: 4483 - DNA, 1835 bp, Zea mays
  misc_feature (1)..(100): optimal_loci_338612_G1, chr10:85504871..85506705, Cluster 27
ggtgctatagatatatgggcagtgtgtcccctggcgtccacttctgcctcgtgcgtacggagtacatgagataagaatacgattattggtctgtatgatgctgtgtatacacatacatgggatgcatgataaaacaagttcatcatcaccgccggtcgtccataccgataaaaacagcacggattctctcctgatgccagcgtatagtaaaccaaactgtccaatcacgctagctagctgcactaaactagctagtgaacatgcatatggcctatatagtcttagatccttaattgatataaataaaatccgggccgaagccgttcgtgtcaccggcggccgctcccggccggtcgatcgaccggatcaaagagctcattgtttttgaatttaaatctgatgagtaccacgtaagcatgcatcgttttcgaatttttcagcacgcagctgtgtgggccaaattaattaacgctttgaatttaatctgtcatctgggcatacagttggcaattggtatatgcggcgggggggggaggggggggggggggggacaatgcaagttgaagatccgcccgcattttatgacggtcgcacaggccacagcagactgcagcgatcgacgaacggtgctgacatttcgttggtagtatacgagatctatatatgacacgctccatgttgctatcgtgtatggctgttctttgaattgaaccgtgatcaacttgaagtgtcctcaaccatttgattgggtttgtttccacgtacgttcatttcaagcagcagcatcttcttcttcttcttcttctttaagatcaaagactcaaccgaactttactagacacagcgtacgtttaggtttagacccccgatcctcactcactgaggttaccagtttacattagcgcgaaagttttttttttcttttggataaagagcgctttattgaacataaaaaaacacaaaagtaacactgggtagggtttagtgccttagacccagcaactcgacaccctcagctctacgaccaatgaccagccagtactgacagatcacaagccaaatttcatcaattcatttacaactaacaacaagaaagtgtattagatgctgtctagaaccttacctcattatcctagccataataaaaaaacgaaaaactgagagttcactagaggcaacacaccggctttggttttaggctgatttaatttagcacactaaggactaaatttaattaaggccgggtccgttccgttttcacggaatcggtgcatatagaactattactagccgaattgattgtctaatttatataagattttatcggctggaacgattcctagtctattcctgtagagcactatatttcctcaccttaaacagatgaccttttaatttttcggaacaactcttaagctcgaaactcctaaacgtgtaagacgtttttcatgctgtattcagtgtgaaccgatgtctcttctcttctctgaagaggcccgaagccaaaaacatcaattccgttatctagaaagaatgtgtgtgacttcgataaacaagcatatatcacacaaagttaatgatttttttttaaaatctgtacgatatgcatgttcatcaaatgtatctatttggtccaaaaagaaaaacccccactccagattacagtactagcagcgaccagcatcttaggtagttgtactttcacatcaaaagcacacaacagttgacaaaggggggccatgcattgaacttttggtgcgggttagtttctctcaaaggtgctcttaaatgtgaagagatgggcttgacataaacatgtttagacttccaagcta

SEQ ID NO: 4484 - DNA, 1443 bp, Zea mays
  misc_feature (1)..(100): optimal_loci_338876_G1, chr10:86972217..86973659, Cluster 27
gctatatatggtactggactactgggattagctacatatgcaaatcatgtttgaaaaaactgaggatgcactgccgtgctttctgagttgacattaggacttgtttggcaggattatattcccctcaatcctttcaaattcccgtgcaaccaaacaacccttaatggacagaaacatattatatataaatatcatctcagaagcctatggcaaaccggcgactttacataatagcggtcagaaaaagtttttttatgtctataaatcatctacttagaggtaggaacaaattgcttattagacgcagacgatattttcaatcgatatatccaagaaatcggtttctagaagcagtcgttaccgctggattctaaaatcgtctttttagaaattgtaaagcatccaaaaagtagcactttttaaatctaggacagccccgtccccatgcaaggaacaaggcatgtggtttttttgcttgcagcttcgctatatatatgtctttatcggactttatttcaaaaaagttatgaattagtttgtgaccacgccacctatgttttgaggtgagccacaatatcgacatctaaaaaatcgatttctagaaggttagtgttttaaattgtcattttccgtttctaggggatgtcataccaaccgttcatagaaatatcatttctttagaaatagaggatatttttagggacagtcgaaaacatttatctctcttcagagacgacccatctctggatcatttataaatgcagttcttgatgagccgttaattactggaaaaataaatggtgtgcctataaaaatcatttctattgtggtattaatttacatattagattacctcttactcacatgtagccaagatgcatatagtaaaaacaataatccctagatgtggctatataataatcttcaggggaacttcaagaaaaggtatattttttgtgtgtgtgttttgaattttaacattttgcattgtaaaatatgctacatcttacgatttttcttcagaggaaatttccaggacctagtcatctaaacgcgaaatgggtgggcacgcacataggttagagaaaacagctagcctcctccatgattgcaagtcaatgtggatgttacttgattccacacaccaccacaagatttttgtcatgcatgattgatgagaagtcatatgtacgtagctactgttaaccgcacgggcgacattctgcagcaacatcgtttgtgttcaatgcagtgcagataattaagatagcagactgtttcagtcaaattaaacatgtcgatggggagaggttggagacaataattattgagtgaactacctacttagctaggttatattttcttcaagaagagaagtttatttctcgtaactttctttcgatcgggttgtcaacttgagaacggccggacatgctaactaaa

SEQ ID NO: 4485 - DNA, 3650 bp, Zea mays
  misc_feature (1)..(100): optimal_loci_342209_G1, chr10:105895859..105899508, Cluster 27
atattatgggtggggttgacacatctcgtgggttgttctctaattgatttagatttgttgtcaatggaaaacccatgccatgcaaaaaatatatccaactctttactgaaatggtcaagtgttggtgtagatgttgccaaagctctacaaagtggtggatcaggatgtggctttggataccaagtctattaatactagatctagaacaagattagtaggtgttatagggggcttagaggggaggaacaaattaggggctactaggagaggaggggattaggatttgccctagattattcttgcttaatcccaataggtacatcaccccgtatagggaggacccaacctaatcaacttgacttccatgtaaatctaacttctagacccttactaatattattattcagtgatgcctaattcacctattttaggctcctattggaccttcttagccccaacaagtccctagcccgctatggctatttaggcttgtgaccggcacccactttgttatgaatgaaagatagagaacacaattaaataagatatatcaacttagctatggaaataatatagtttaatgaattgataatgatactttaagaatctaaggacttcggttaaaaatgtgaaattttattaagtgcatgtgcattaaatgggtttaagatattttttggtttattatcctaaaaatcccattgctttcatgtctcatacactactactaaaacaatttgagagacatgctagtttattaacataaatttacacaaaaacgttatgtctcctagaatacctaatgattttttgtaggtggttgttttatttacaaagatactcactagttgtccatctctcttacaaagaaggccgaacaagaccttatcactagtccaatcgacttcacccagtctacctccaaacttcattctcatgaatgaagggtttgccgaaggccgcaaggtcaacgaaggagacttcgctctggggtggtagactattaaaaaccatggctatggatgtcgccctttcgctgagaactatgaacaccatcgtggggtcttcattctatgtgacatatagtaggaaaactccgctagtggcatctaacaccaagatgctattggaggacaaggatgtacctaaaggcccgatcaactagcgggtgagcccgaaagttccaaggacttcaacctcatcactcgagcaataggccaagtccctgatgggggctacgaggacttatccccctttggagaggtggcgaatgccaaagctatggtggcaccatggctccccaacttaatagagggcccaactcttgtaacaatttagtccaaacactactgtgtgtatgtaaatgggtttatgtaataatatgcatataattattcctaatgacactaatgtagggcatattcctaagatgtaacaggtatttaggggcaagcccataattttaggggggttgcccttaggtcaccctataaataccctcatcccaatagagtgtgggaatggttgacaagacatttgtcttactattttgctcttgttttccctttgttcaggtcccgcttgttagaagccaacatgagttgctttattttaggacacaaccttgaattattttctcttaaaattggtgtataaagatgggcccgttaagaggtctacttctgaaaataggctgttgagggcaaagccaaacctcctaagaggtaatttgtgacaagcccattatcccacctcttgcccaatcctagattataaaaactttacaggtgtccttcatttctatctctttctctatttgcacactctttctgaacattctcccattcccctcaaagctcgcatggccaccctaaggaaaggttgtgctcctcaatgacagtggttcgacgacctagagtgcattttgcatagttgggttgctatggatcttacatagcggcctatttgatggcgatgtgcagttctggtggaggcaacatatttagtggagtatggtggaaatccaatggcactactcctttatgtgtacaaatctaatggtgtgatgcttctcagtggtggatccatatcgatggtgagtggatccacattaagcatcttctaagggcacaaacttctatggttccaatgagacctactctaacaggttagcaattttggaggtgggctcagtagcgggattgaatttgactcggaggtggatcttgcagccactttcgttaatctcatttggccatcttcgaagtcccttagtgtagtagagagatccatatataattccttatagaacaattgctccatttaaaatcattgtctactttgcctttgttttgggtcaaacttctatagcctcgactattcttagtgaagagttttattgctttatttccaaaaatgacatgtgaaatatgtaatgaaccatccatgaacctattattctcaatgcatagtttgacgttattctcgttcatacgttaattccataattcatttggagttccaaaccaagccaagacagtttaatctccatgaaatttagttgttctccttttccataaaaatgttttcatataaaaacacctatataccacacattatagagatgaaacttgaataaaactctcactcgacgttaacaacgccaaattagttttgttaaattgttcatttactttgatgacattggcttaatttaaacttgtagatggtaaaattgttttctaacaacatattgaatttaagtgaagtttgactaaacacaaaactaaaaaataattttgaacaaagacaatataaagctagtctttgtgggttttacaacagttccataatttaatgcgcttacatgataccatgtaaatgaagaaagtgatgataaagttttataggatgaaataagttttatagggataaaacttattcacattgtttgcaacacatgtgagtcttagaaactgagacatgaaacacatactaagactaatctaataattaataaacaatatgatcagctccttaaaactttgcatctcatttgaccatgttctgaggatgtaactcattgtctcccttattcatttaaagagttattttaatttttggggccattaaatagttttcatataggtactcacctgatttagtacatatatgaattatttgggccattaacttgaccctgttttgcatcttaattacaattttcgttctcccaatgattcttaggtgtaacacgattgcactacttccacagggccaggcttactgcaggccaacataggctatgccctataggctatgcccctccccctgctttatatgattattctctactgatcttgtttcgcatgacttcatagatttaaaagtattcctgaattttctttgtaatctagtggcatttgatgcaatgccctgtttctattttagccctattatttagttttaaatgatatagttcacatatatttatttgatattgactaaacctgcatcatttaaaacatcaaagtaatttcattattttttataaaatattttcatagtaaatttatctgaacttgaggatattaattcatttttatggtcttggtggaacttcaaaaagttaactacatatagaatggggc

SEQ ID NO: 4486 - DNA, 1601 bp, Zea mays
  misc_feature (1)..(100): optimal_loci_34501_G1, chr1:209996376..209997976, Cluster 27
aacatgttctgaagctgcttctagattataaatcggccattcttttgttttcaatacaacgggatcgatcgtatccctcgctcctggagctgtacttgatgatggttttgttgtttcacagatctggttcgtttggtgcgttgggttatagtgtcaacgtggaagtgataaatacatagcatcttcttataatatctgccttcctgggcatctcctttcagatttatcgacatttttgctcttcaagtggacatggtggttcttctaggaaatataataatgccttttgtctctgtagttgtgattacctccctacttgatgtatatatacctggagcagcgcggtggtgttccaagagtgttgtcatatatagtgcactttgtcttacacgtgaataattttgtcaaagaaaaaggaaaacagcttacacgtgaataacgaggataacgagccaagtgcattttgtctttttttaaatgacataattttatttactatagtctctttagattatttaataactaattttaaatcaagcttaagaagccgagttgaacttaatagtcattcaaaaataagtttttattctaaagaacagcaaattcgactgaaggaaccttaaaacaagccatcgagtcagctcaattaacaagtcatctagccatatatattctaaccgaaagtagagctgctaagatgtcagctttacgacgatagcagctgccacacaaactactccctcactccattagtaaggttcggcacagaaaatgtgttggctaatttttttctgaagtttaactagttacataagaatattaacaatatttatatctcgaaataatttttttatgaaaaatgttcaatgatctatttaatgatactaattatatattagaaatattagagttgtcgtagtaagattctagtttgacttatgctagagcttagcatgccggtaagcacccggtgctaaaaataataatttattctattctattctattctataaagagaaagttacgtgacgaagaagatgagattgttttgttcacacaaggggccccaacttagcgtggaaagtaagttcatacgctggaactatttaatccagatcaacactagtgacatgtgccgcatgcccagtttggcaatttcttaatacacacgcacgcacgcgctgcgtcttctcttattggaaggacggtgcgcgatggaggtggggcagagttgcagacgatgctgacaggctaaactatcgtggagatcaaagatgcaggcaacgtggggtagccatagggtgaaaaaaaatgataagtggaggttcaagatgcaatataattggaggttgaagcaatctaacgggtgccaaattttctgtcgaaagccccaacactcggaaaaagggaaaaaacacagtccacaacaaaacgttagtgttggcgctcttttcggccaatcgcctaacacaccctggatcccgctcgtaggaagtgagggcctaaggtgctttctacgtgagcgcggaccgtccgcactaggtggttgtctagattgcttacttcctactagtcggaccatccacgatttacaatcttac

SEQ ID NO: 4487 - DNA, 1486 bp, Zea mays
  misc_feature (1)..(100): optimal_loci_348258_G1, chr10:139297032..139298517, Cluster 27
cccgagtgatgggtattattttggttggtctatggttctcatgctcttggttatggattttattttgattttaaaagattgaagactgggttaggggtggactactttccaagtaaaatttggagttgataaactcttataataagtttagaactttgttttccctttaacagtaccatatatggaggtgtgaactagtagcatgacctagataagtataatgattagtaagtttagtgtggtacacactatgtgtcttttagtctacgtggcatacaacccctattttttattgaaaatgattgttcttgatctaataatgttgctttgttatgttcttttcaaaattttggcaggtctcgaacaaactccctatgcttgtttgagctagagtaactctccttaaatatggagtcttgggtgccgctagaggagctcgatcgaaggaaactcctcatgaatttccttgtcttttttgacatcctaattgataaaataagagtcggtattagaaaagctaacaaagtgaaatatggtacgcgcaaattaccaacataattgaaaagtgtaaatattattacttgccaactatcatcaaaatgaagatcaatttgtctggtagcgaccgtttggttcgctgtccaatttatcatattttatctgacttttttttagtttttcattttagcctactaagatacaagttgtagtgcggttatccgacaaccaaacagagggggagtagctaggttgagggaaagagagttaatgtgtatagatagaatatctatggaatgggccttgataaaccatcttatcaaaacaaaggtatgctcgtcctgatactgcaaggttaggtcaggtacgggactggtcactgggttgtggcatgaccttggaaccgggcccatctaaccatccgtgatgaaaacgtatgcactgtgggtttatagaacaacttattatgacaggcgaagtagagcacgaccgcggtcaactcaattactagtcgagaccatctgcactgcaccgttacgacaggcgaagtagacggctgaatccgtggatccattctagtcacactctaacgaacaaaatgccacccacacaccaattctattttaccttatattatctggagtcggtcttcatggaatggattctccatcggttagcacaaatttgatccctacgcactggtagttttttttaatgaacaaaccccaccatggatcgatgacattggttggtggagcgacgggggcacaagcccgcagcgcccgacagcaaggtccaagtttcaacgccgcgtcctcaactgtcaccttcgtgacctcaccacacctccggtccctcaccgtctccactgccgaatactatatatatttattaagcaatattttatgtttcctgagaagagtcgaccactcggcccgtcccgcgggcaggcggaagaatatatgtgaagcgaataaacactgccagc

SEQ ID NO: 4488 - DNA, 1909 bp, Zea mays
  misc_feature (1)..(100): optimal_loci_35554_G1, chr1:215196779..215198687, Cluster 27
caaggttaagccgggtcctttagttagggttaaattgattatcaataattttaattttagagaaatgttaagcacattttttgtaaaaaaacaaataaccggccaaaatcggttaaccacaatacatattattctataggagataatgcaactatataattatgttggaaagcacctaacaagaaatggaacatacaaagaggaaaagaaacaaataatgcttctaacacataaaatctcaaggacatacatgttgatatgcaaataggcatgatttgtgtttaatattgaaggaccatgacgcctaacaaagaggatgaattaggtgatctattttacaaactaagctctacaaattttgcctaatcacaatctgtacaatacataaactatctatgtgaaactacagttttgattaaatgtgttgatatctttactgcaaagagttatgtcacgtaggttctaaatctattaactagcgtaacagctaagatgtacaatataaaaatccatgacgacaattggaaatgagggcatggaagggaggctaaacatggataaaacataaacattgttcaaacatatatcacacatagacataactcatatatgttgttatttgaacaaacattagaacttggtttctttgaatgttgcattgtcaatgacatatgttggttggttcgtacaaactacgtactagctttaagttcactacctaccactagacattaaacctagttaatccctttggactggttgttgtcacagttcatcctccatccatcgcataattattgcatagtatttgctaggatggtagaggcaaccacaacatgcatcattctaacaacttcgtcttcacttgtgatgcgtacataaggggatgtagggctatggtttctaataacttcactgcattatatggacaccttatcaattcaatctacaagtttgaggatctactcaaatatatcttggctatgaggagtggtgccgctagcttggcttggtttcaacacaatctttcgaatctcagcagcgtgatcttccatctccttgtcaacccattttagggtttcatacaaagtggtacacatcacatttgttgccttgcaattcactaataatttaggttcttatcaactaaaatgattcaaactaaggccactacctagtttaagaaaaaaccatatagatttatgcaggactggtagcccaatacaagcttggacaaaattttagatttgagtagttaaacaaggaagacaacaaagactttagtaatggatggtatcaaaatatctatgcggatttcttctgtagaagcaggcattagtttggaagcaaccttaacaatttgccagtactgacaatttttttaacaatagccatgaagaactagaataaatgctacaactcaagacaacaggggaaagtacaacacccaaaatgttcccatcaattcatcttatccatcacgatccaacaaactggaaatgtacttcggttgacacatgcacatagttatggtaagctgttcctttcacctccttcatactctatgaattagcgtgaattctatgaatcattaaataattcatatagtattagttattactatgaacattgtgtgaaatcatttatttttagctactgatatatatgtagttcgaaaacatgattgcgtaaagcataactacctggagtggttacttaaacaatctacaaattgctagaaccctaaacccctatagaataaacatagagagattcattcatgatggagtaagtaggagtagtttactggacatcatgtaaaccctataaacggtcaaatcgatcctgatctactcttattccctaacaatacccttgtgtacgagtgcttaccttcgacactcggaga

SEQ ID NO: 4489 - DNA, 1453 bp, Zea mays
  misc_feature (1)..(100): optimal_loci_37244_G1, chr1:224363481..224364933, Cluster 27
gtcgatcaagtggtgtgcgacttgatcagactcggtttgttttttattggcatagctcactagcatccagtacacgtcgtcactgtacttgctccaactcctcgcctacgacaccttgaatgactacaagagtatgatcgtagcctgcaccttgcaattcttacattgttttccgctttccatacgttgttgtgtgtctcggtgtatacctgttggttccatgggttttccatggtgtgttgtgtggctttcaacaaaagctagaccatggggtttctggtctaaagaatatcgagtatgaactcagaaattttaccttgaactaaggccatttggtaggtgatggagttctattggctagatcacacattttagagaatgttgttgatgactcaaattttaatttttatttctggtcaacaaactgtgaacacgtcacatgtcacatagtcatgttagcgaacagtggttgagttattgagatgaattcgccttttatcaactgatatgagcttaactgttcacaaataagggtatgacgttatgaacatatttgtgcgtgtaggaatatatcctctcgtgcactccacttataatttctagaattttctgcttctttggtctaccattgctaccaacaatcatattatttagtagttaatggctaaatttagcttaattattggtactgttgtataacaagatatgcacattgtcgtgtttgctaatgtatgtttatgcaagtgtaggtaattctggatcccttccagcattgttgcctaaccaggtctgaaagctaaagcaactcagggtgctaactctggcagagtcaactaattaagatgcaaattctgaaactttgacgaaacctataatatttggaacaagcatctataccataacaatcacacaaagctatgattattattagccatcacttgcagttccaggcatgtcaaatggtaggtactcatcttgcatgtttgttatatatgttttgtaatcctcctctttgtttcagaatatgcctaaatgttcagtataacatagtttcatttaataatattttagatatattcaaattttggaatgtttgttggaacctgagagacgtattatcttcaaagtaccatggattgatgatagagatgaaacacatgtcaatagaggtttttgtgtgcaattaggtaagtccatgcaaggtggtcttcgctgtcactcattcatgagcttaagtgtagcaaagtttctgtcttttgaacatgtaataatatacttgtctaaaattcactttcatgatacaccatgctagctatttgtttattccttgtttatgagaaagacagttacataggttgaagtaccactctaggtgaacgatttaagtgcatcagtgatgctaatagcttacggctttccttagtcacatctaattttgatgtcatggacgttt

SEQ ID NO: 4490 - DNA, 1536 bp, Zea mays
  misc_feature (1)..(100): optimal_loci_38115_G1, chr1:228634017..228635552, Cluster 27
ctacatctaactatatatggcatgtacaccaccatactgctgaaacaatgagagaatagaggtgcgctatgaataatgaatctaactatatacagcatggttttaaataccgaacgagtaatctgcatataaattttaacatttaccatatctgtatccgaatatagagtccagttcctgatacgcatatgtgatggatatcaatattcgacacatgactccgaattttataaagaaactatatattctcctcggaatattcgttggtatctgctccgatttcaatttcatctctagtaataactatcaggtatagctctagagcgcatcgatcggctaccaagcattgcagttgcgggcatattattattaaagatatgcatgttgaaggtagtgggctagtggctcccgctctctgtttgaaacctctagaactaatactaaaatttagttgttagactccatacaatctcagctaatatcatctaatatcctagctaattgttagctacctcacgactaacaattagctctgtgggttccaaataagacctcgtcctgaaatagggaccctgctggccgcagtgaagggtaagttgaggcttgtcattacagagagcatcctttaggctatctccaacaatttattcatactcatccctatatttaaattgtattctacgaacaatacaatctataatgcaaaaatgttttagatgaccatgtgtaaactaatggtgacggtcttagagaagccatagaaaatctatacctcgctcatatggagtgcaagaagaagacacgtgacaagagcgtggtcaagatgacatcaaccaagtcaaggagatggtgtcgttgaacttggtggagaccgtacatgaatcaatattagggatgataaagatggcatcacttgtcactcctctgagctgtgtggagagtttgttggttttctccttaaaataaaccaaatatagggggtttgggcctcaaaatcatagaccgaggtttgaccattttgggtcttaaaactggggtgttaagtctatgaatgcatatgaaaggatgaagatatccaagaggaaaaaatgtgtgaattaggctaatctaatttttttgcaacaattaaatcatatcgaacaacccacttcatcccttgtgtctaagagtatttttatcctatcataaaagtcttgcaccctattgaaggctacatgtgtacattttgctaactgagataattaattctattattgttactctagtgctgtgaatgagctagcttaagtccatatccaagattgagttaaaatgacaaccatagaaaaaaatggtgatgatcataaatgacaaacaagtgttcaacacgaaaaggagaaaagaaaaataaaaaggctcaaagcaaaggtacacataggccattttgtttttcagtcaaagtgcaatagtgtgcaagatcatatttaagatagatagtcatactataaagagaacaagctcaaaatgtttatttgagtgccaccacatgaattgact

SEQ ID NO: 4491 - DNA, 1498 bp, Zea mays
  misc_feature (1)..(100): optimal_loci_40071_G1, chr1:238732456..238733953, Cluster 27
atcgagagttgtgttaatttgattgactaaagtttagaccatcttaaggttccttacatctttgttgttgaagatggtgagtgacctaacaagatatacacttggatacacccaaaaatgacaggttttcatatttttactaaggaatcttatttcctcttgcagaggacaaagattacaacaactcacatacccttgtgtgcttgctagttacattttttcacttaggaataaaattttaagagaatgaacacaatgatccaaagatcttcgacttgatcaagaatgggataactctcacaaagctctctaaagccataaagacaaggtcacaaatcttggaatcactctctaatcaatattaagctttctataatctcacagtcacaaagagagagagagaaagagagagagagatagaagttcctaacagaataaaaaaactaaaaaattgttggccccagcaattcctattgatatttagggcagccggtaaaaaataggtaatggtaaattttagccaattcactcaactattggtacagtggatggaagttagcagaataaagctgctagcatgcactgtaacttccattggtcgtattagtagccgattgaaattagccaattcacgtcggctattgacaaagtggacgaaagttagcagaataaagccgctagctcgcactgtaacttcgatcagccatgttagtagccgatttttgtcagcttaggcagtcaagaaaattagctactaacatggtcaatagaagttagtggaataaagtcatcctcctcccattgtcgctcatacaaatcactcaccaacacacacgaccaggtggccattggttgctggcacagccgcataggcgatacaatgttgctaccagcccccaccgcttagtcgtcgtcgagctgcttggtccttgccacccatctctcgctgcccaaccaccaaagtgccactactgctgccgtggacctaccatggaattgtcgcattgtcgtcatgccacctccatgtcgagctctcccacccaagccaccgccctacccttgccttgctacaatgcatatcgtcggtcgggctgtgtcactccacaccccgcactcgcacctgttaaatctttttactaacaaggtaacacatgctcttcattctttacattacatgcatataaatgtttaattcccatcgatcatccaatgtagtttatgcatgaaggatggcagaggttatgcatcaataactctttcttatggttagaacataattataggcgagcatcgttgatggatatataatggttgaaataagagtggggatcatttattgacaatgcctttagttttttagcaactacaatgggtattgatgtattgtcgcaactataaatctaaggacaaaaggaagaatgaaactacacctttgtacctatggtttcatgaaaccaagctacacgatggctattgaagattttgtttcatgtatatg

SEQ ID NO: 4492 - DNA, 1659 bp, Zea mays
  misc_feature (1)..(100): optimal_loci_42331_G1, chr1:249527981..249529639, Cluster 27
aagcgggtttagtgtattaattagagacatgtaatttaggatctaataagttttataaggcatgattacaattgttaatcccaatggagatttgttggaaacttgtgcaggagtaaccctcaatcactttcaattcaaaggcttcgaactcaaatcattggaggcttgttatatctattcttttgttcagggaagtcctactataaagagagtgcaaaactctcaccgccgttggtgcttaagtgctcaacaaactcatctaaaataaaactaaaatacactcaagcggagcactacacactttgtttagtgtttggaatgtcacccatgtcgaaagttctaaccccatgttagaagtttcgacgtgcgccaaactcctaggtgaagccaaatgttcctctgagtctagcaagttggaagttcggactctatgttggatgttttgtcccgcgtcaactccttctgtcctagtccacaatcttcaagtgtctttgaagcttcgaagttttagagttagaagttttaagaaatttttgtaactttagacatccgtagtaatagttaaaattgaccttagtacaaatatcttctcctctctcctatcggggacgcgccaatcatttgaccaaccttgtctgatgcttctcttgagcattcaagtcttctctctatcccccctctttgcttccatgatctagatctagaacaaggtgagaaagagtgagaaaaggacaagaaaacttcatctctatctttgaacacttgagttcttcatctaaccaatgtgcttacacatgttactcttagactttttccctagcctgggcgtcttcataaagtgtaatatttgttctttctagacagacacggacattatactagtagtcctgcccccaactccacaattgttagatgtgtatataaacttttcattccttttgtttgatacttccgagttttgtcttgcatgcctgtgaccaaggctgatcatatcctgaacataccaactttaccttgcacacacaacggcgcaatgcgttgccgccgagcttgtaccacggagatcacgtcggctccgtcgaagagcgccgccacctcgaggccccagccgctagctcatctgctcctggtgactggtgcacaggtaactatagctccacatggatggaagacgagaatggcgagcggcgccgtacgtggcgtggccctgggttcgttcgttcgatgccgtggctggacctggacactgcggtccggggcacatcgatcagcttagccagcaaccagaggactcatacgtgtcccgggcggcagttccacgccacttgcttggacgtattagctgcccccgcttggagctttgcgcctacacgggcagtggacactggcccgtgatggccggttacgttgagtgaacatgcaggaaccaagcgcctggccactagctctctagctcaacaacacgcgagcaactgtgtgtggactcctcctgtcacagtattactgttactctattagggcatcatttatttaatatcccgtttcttgagagatatagatgttaaatgaaaaatatacaagactagtttttcgtgaagattatttatatctatacacgactctttatacatactgtctatgcatttatgatgtgattaa

SEQ ID NO: 4493 - DNA, 2379 bp, Zea mays
  misc_feature (1)..(100): optimal_loci_42970_G1, chr1:253262982..253265360, Cluster 27
ggatgaaagatttcttcagcgactagctcatctctatggatctcactcgatatgctagatggagggagaaaactaataaggatgaaaataaatgaagtgtaggagatatcagatccattggattagcgtccatttttttagtctggttttttagacggttgggtctcactcgatatgctagatggatctcactcgatatgagaccggttttcttagtccatcaatccaagtttaagtgttcgtccttcaccactccttgtttggcacataccctcttgaccttcatctttgatgttgaccatcgtttttgtgttgtagatctacgcatcacaaaccaagagacatattgcacacatcataagtcgcgataaggttaatccacaaactcaatcaaaaccgatcattttctcgcaatcacacatctgtcttgaatcccatgaaccaatatcaaccacatatatatccggatactcacctttctcttttaatactaccttcgtcaatacaacagcagttctaatggaacgcgccacccttgaatgcctggacaaccatgaagaagtagctactagttaatccttcaataactgctaccaggtcaattcggttcaatttttacaataccgatatgacatcaaagtcacaccacaccaccatcgccccggccgtcggcatcgctgttaattaaacaaacattccgatagcgagcggcgaatctaaagctggattttccatccattggcgatcgccatctgatgaaacggatggcctacgcagagtagtttatgatggatctgggaattcttataccggattgtcaccgtcaggggtgctaaactactgctgttgtctctacccagcctgggccatgccccattctcatccgttggtttggtccttggttttacaaagggagcatatacctgaagaatatgtgatagaataattcaggtacttagctgtagtgctgctgcctctagttgccgatcgatagctacgtgatcgatgattgtgttgggacttgggacccccgatagtaggtataggatgatgattgctaacctgaatttaagcgcccagatttctactgcattgtttcttgaagtactccagtgttttggacagggatgaacatgaggcctgcgtagagagacggcaagagtctgtgtggacgagggcacccagagcatgttcttcagtaataattgcggcactgccactgcattgcgaatctcctcagccatttgaacattttgtttttgcaaaactaggcatgtcatatacagagtatatcacatcttggtggcacaagatcttccactggtttcagaacggatgaataaattattgtttcatttcatttgttgatcccaccccacatgcaacagatcatacgagagagagagaaaaaaaaacagaattggatgccgtctgttaattaaaacttatataattttctatacacacgcacacacacagacaagcctgacactgaaaagatctcactcccgaaatattctccaaagattattagcagaagcacatatgcgtgccgctgtcgctgtatagtgccgccctttgaactagaaaacacgtaataatgcaatcctacgccagcagatttttccattcaggcaatgtcaggctgttcgctcgatccattctctgacaagaggctatctcccttctgcttgggaacctccaacgaaacatttcaacatgttcgttggggactcttgctgctgctgctggcaactttggaagcgtcgaaatgctgtgatcttcacaaacgaggtcagaaagggagattgaactgtgcccgtaaaggacacggacgtagctatcgtttggcagggtgcagttttggattcggcaagttaaggccaaacaaacactgcaccattcctcctcctactgtaatttctactgtcaaaacatgaatcgcagcgggccgcagccgaggggccaaaacagatacaaattcaggtgggtgaaaatccacccaaataatgcaaatcctaaatatatataccaagaagctgcagtgacgttcataaataggaaagccaacagctcaaaccccctttggcttttgccgcaggaggctgcagagatcctgttcgtgtacagtacaggtgtttgattggggggagaggatgtgttcctttctcgctagtggctcctcggggatcaaatcatcaagtctgtttcttgttccacctccactggctaaaatttgtttgtgtcacagtctcgccattttctgatcttataaacatctcgaagaattatttaatagagaagttgcaataattaggcatggaaggcaattcagtaaacgcatgtgctgagtttagagaaacaaacccgagctacata

SEQ ID NO: 4494 - DNA, 2255 bp, Zea mays
  misc_feature (1)..(100): optimal_loci_44370_G1, chr1:260510089..260512343, Cluster 27
cgtactgcgcgtggggcaaagctttgccctgaaggcacatcgtctcaactcaaagatgaggtcgagctcgtttgacttgctgtccaatatacgtatgagtagtcgcccacgcatgcaaggctccccgatacctttcggtcttccattgacgtcccgccgtgtaccatcgctctggcccacgatctcggatcggacgacgcatctgcaattgcaaccaacgagagtgcgcgcgagatcgtctcctccctccgattccatgcgtgcgtgcacttcctctctacgctagctcagcgaggaccacgagtagatgggacggtcctcctcctccctcctctcatccgattcattattccgctctggcacgcgccttccatcatctgcagacatgatcgacagaggagaggagggcggagcaacgtgctagctagcttattctatcacagatatatgcatgcatggttggtacgtagcatcatgtatatacgagcattttttttactttagattttttttctagtttgtggccatagaaaagataatataattcttgtatgctatcaaataaagatattatatacatattatagttatcaaagagatttataactttctagtttaatgtttttttttatttcaggtcgctaagatgcttcaaaagataatatgaactttacatataaatgcatgtggtcttagaaaaataatagtgatttatacgatgtcaaataagacactttacatataaaaggtgtagctcttaataagatctataaatttatagttttgagtttattcatttaatattgttaagctaattaaaaaataacataaactaattaaaatggtataaactttcgatcgctaccataataaccatgtacaaccatttgtcatcgtagaaaaaataatatttttcttgtatgacgatgttaaatgaagatattttataaataaaattcatagttctcagcaacatatataagcgaaaattatagttcccaataagatctacaattttatagttttcacttttacatttaaaggttgcttacaaatttataactttcagctaactacgtactatatattcaaataatggcggacgacgttcctaataagatctacaattttaattttgcttacaaatggcggaccttcttctagaagggatatcttgtgggctatttgataatgctagcgctagctaagcaagcagcagcaagctaaggaccaaacctagctagctaactactatactattcaaaacaaataatgcgtcgttgttgtcaccactcatcaccggccaggacaggggccggccggggagcttagtggacactagtgtgtgttgtccgtgctcaacgcccactgagagtacgtgctagagtcacatcgatggatctcactaaatatttgagttggttgcattgtgtccgtgcttactgcgtagggtagcaccggggctgccactagtgccgggtccatgcgtaacaaacagtacggctggagaaaatttatagaccgaccatcatttcgtgtagagagaaagtcttgccgctcatagtcatctctcactatagctaggtgtacagtggagttcaactcaagatttcaaagtcagctggtactaactttatcatcctttttttgggtggaaaattcatgtagtatagacggccacagaggagtcataatgcacttccaaatttaatttgttatatcaccctgcggggcgtattcaattcggctatctctatcagtcactttgtcccagattacaaagccagtttcagcagaagttttagctaagttttatttatatttaatactgcgacaatatcaacagaccaagttaaatttatagagctactaatatttattatatatatatatatatatatatagaataaaaagaatcgtcgttggattactatagaatatttttataataaatttattttgaagatgtaaatgtttatcctattttctatcaatccattcgttcgtgatttttatcgctatggttgcatgttgttatagttaccgtataaatcagtttgctgtttcataccacaccaccataaagctacacacaagcgcaccctacaaacataatcattttttttaaatagtccaaacatagaggttcacttatttatcggacgagattaccttcatctatggtaagatctacctctatctatcagagtatgttcgttttaatctcaattcatatgaatgagacagaattgagt

SEQ ID NO: 4495 - DNA, 2227 bp, Zea mays
  misc_feature (1)..(100): optimal_loci_44635_G1, chr1:262142880..262145106, Cluster 27
tattttaagctttcaatttacaaatcgaaagcaggatttaatcattttgtcctttctttctgcttctccgtaaacttttggggactggttagagctatgttgggtatattacatggacacagaagttaagaagagttatcttggagctataacagtcttgccaatttttcacctatcattttcctgccgtaaatggaagaaagcagctgtaaattatcttgcatttggaattttggatacctgcatcttgcaccagagtagtcttggtggaaaatacaactgcttgtgtttatacccttatgtcttgaatactggcttatgagcattgaaaaacttatacccatcttcttgcatttaatgacatatgctactcttctcatattagggtggacatttctctggcatttataggaaagtgcagctaaagccattgaaatggataaaagttccaaagcgtaatggtgatggtgaagaggaacgaccgattgaagccctgatgattctgaaatatggtggtgtgctcacccatgctgggagaaaacaggttgcctcataatttttacttcaacttttcacattttcaaattttaaaatgttgagtatttgttgggactctttatttctatgatcaagttaaaataaattttgatgttcaatgtagaagtagacagttataaataacagaagaacaagatgccaagggacctattgcccttgtcatatgttcctttacaatggtttctttgcagagtaccttagacatggttagcaattagcatatgctattcagggtcagcttgtagagcactagatcatacatatggaaatggatgtcaacagctttactgctttagtagattctatgtcacaggctaagagactacactctctgatttggaggatgtcactgttgaagggtgctctcggtgccagatccgagggttgttggtgagggcctcaggggctgtggtcaggccagagacacttgcccatggtggcgtaggggagggagattagccagcagtgatagtagtgcctaaatgacagtttttttccgtcttcccatgctgtaccaatcagtaattccttgtggtggcgtgggggtgcatggctagccaacacttgtatagtacctaaccaattaaccatgataggtttttccttctttccatgccataccagttaccaatcagtattttttttgtagataccagatgtgcaggcaaacattgtagtatactgtatcatagtgatccagataactgacacttacatcatgccatattgccacttgcattttgttcgacttgagcaaattttctgtttattgtgtttgttgctgtcaaagcctgcacaatccattgaatcgaggggacaatttagatatattaacagtgcatagatccaggaattactgaattagactgttcatcaattgtcatttctgttattttcggaatatcttatgtgcagtggtctactttcttaatttggctgcaacaaaacaaatgcattacatttgtaatcaacatatatctactgtaatgattctttttatatgttctcattcaggcagaggagctgggaagatttttcagaaataacatatatccaggttgttcacatccttgctgcctatcatcttgtgaaagaagtaaaacagtagaactttaacgatttttttactacaatcttgtgcttaccttatctccatgggagattgctttctcaagggaaacttgtgctccgaactccggagaaactgactttggagctacttgggtcccaccccccttaaacttgaaaagtgccgtgtcgggtttctcatcttaaacatggtgtcacttaggtccttgtacttgtgttaattgtgtattttgtcaatgtggcaagaggtttggatataattgcatggcatatataagtgatggatgtgacatcttttagtcattggagattacacacggcttgtgatggcccaaaactgacagaaggaacatgataattccaatttcgctttagatctttacagacttatgaaaatctctatcacctaatgttaaagtccagggattccatatttagggacctttagtttatgtaaacagcttttagaatctcacattttcccccaattttgcatctattagaagtctgttccccttccagtgttgcttgaactcaaggattatatataagttgcttgtgatttcacttcaacttcaaa

SEQ ID NO: 4496 - DNA, 1990 bp, Zea mays
  misc_feature (1)..(100): optimal_loci_45338_G1, chr1:265889938..265891927, Cluster 27
acatctgattattagtgattgatgtgcgtgtaaactgcactacgtacgtactggatcacttcttcgttacaaaatcagaatggctagcatcacatatagtagtgaaatagtaagccttcctgacatttatcctttgcaatgaatagccataggagctagttgtaccaatagaatcgattgtgaaagctcaaagtatagtattgtagatcaaatcgatcgatgacatttgcagcgaggcgtctgcggaagcctgatcaatagtttgataaacagcgatttccatgttgtaaaacagtttaacgcagtccggcaggcaagcagagacagacgtagctgctagccgtctagctaggaagatttcacggcgcctttcaaatcctaagcacaccggccggagaggtgcgctggacgatgcatacgcatgcatgtgtgattcgctcgcagtcgcagatcgcagcttcaaatcttgactccactatagatggtaaactttgcgttgacgcgggcggtgggcctgaattcgacagctgcttaaccctagctagctgtgcactgtccacgcagcaaggtcaggtcacgggtgcagctctagaggagtgtgagaatatgcataggctttgactcgaagcatgttcagttaaatcaaaacttctgcggtttattgaatatgtgtcattataaatgttatgtttccggcatatatcatcgtattcacgatattaaaagcgtgccattatagttttatagatctccattgctatcttcaggaactcaagcagactctatataaatatcatctcacgtcacacattttatttcaaacttcacattatgaataaaatagtattttacacgatcatatgcacgctctactagaaacggactcaagatataccactcacttcgccacaatacacgatcactgccaaaccatatatcacagtgattgtctggagccgacaatgtttgtttttaccagtccctaaatctgagatctagaaaatgttattcaccatgtagtaaagacaatgtgtcactgctagtttaaactacaatccaaaagtgacactattaggtcaagctataacccatcaatgatatgtcactactggcttgtggcttaagctagcagcaacgtaaacatatcactattggattatttattcacccacaatattctttatagttgaatccacctaaccactaattgattggttctccacatttagatccaccttacgacctctgattatataaaacatgtggctgaatgccagacacataagatcccttgtgcgttgcttgcagttgaaaaccaatatagtatgtaatgcaagctcattgtttcaccaattgtagtctcagaatgtgtcgttccatgtgggaaaaggccctcaacacatacaccttccatattcctatcaaaatggtgcacagaaggtgctagaagattattcatgaatatgatgaggacatgccaaagacatggcacactagcagcaatatagtgcatgtgtgccccagttggctgttagttgacgttaagccagcgagattagctcattactgcttgcgggcctagtggctcctccggtcccttgggcatgctagccctttcactttcgaggctccactcgggtgaggtggttacatcaggtcgaagggcacgtgcgagctgcacaagcacaggaccccgaaattaatttatgggatctctattttttattttggccattattagtcggttacaaaggaataagtagatgtcatgactcaagaacactggtgctgctttgtgctctttctcacgtcgattagaataagattataccaaagtatctaaccatttcccgtcatctaattttggattggatgaatcacggacacagaacaaactagcgaactctaggattgactcttcctggcttgcttctaggcccgtcgagtgagtgaaagtatgacttagctatattatacatataaattttta

SEQ ID NO: 4497 - DNA, 1414 bp, Zea mays
  misc_feature (1)..(100): optimal_loci_45372_G1, chr1:266084457..266085870, Cluster 27
taaatataatattagtcccatcggatatgtaaatatgaaatttcgataaaagattgaaataaaataaaaaaacaaggagacgaggtgccggaggtggtagggggagggggcgcagaatcgctacgcctacacgttttggtgcagaggctaggagcacggtagcacgctgtgaaagtgcacggctgcatgcctcgattcacgcctttgtcctttgagagttgagatgcaatatatcatgcaatgcaagcggacgccggatatgccttttggagatatgtcaaagccgtactagattaacgaagtgtgaggttcctgtgcactaataatactcccagtctcacattataacttattcttatttttttaccatcaaaacatcttaaatttgatcaaatttgtatactaaattaataaaatatattacattctttattaattatgttttcatagtatatctgatcaatgtcgtaaatatttaaaattatctctatagttttggctcttaaacttgaggtatttctttattagtttcagttaaacttgaggtgctttggctcttaaaaaatgatcaattaaaacaaaggggggcatgaagtttcatccggttgttgaggtatttctttcggaaagaaggaatcacatacatgatttgggttgtctcagcaccataacattaatcttatgatctctagtatatttgggaatctgattgacctttttttctattttattcactacaacaacctcgttaagatatttaagattagcaaagtgccggttttctttttgcctctctctctctctatcagactacaagattacttggaacgaatcattagagaccctgatccattccctgctataccaatagcaaagtcccgagaagcttgcacgcgtgggtcgtgagtcggctctctttggcaatcgcgagcttatcgctagcttaggcagaagaactaagctctcgaaggcattgtttatcttcggctgctcttatttacgctaaggagcgcctgcatattgctttctggctactgctgttatctcgtgtttgcagcggctgcagctgcaaacaattgctttctccagctcatcctccgttagcacaccgtattgtactcagggctaagctgagagctcctgcctactcaatcatcatttaggacatcatcaactactcgtaattaagtttaggtggaataaaaactcgtcgtagttcaatagccaggtgtaagaagcgcagtgcacgtagcatagataattcaggacgaggaccgacggggacggggccctgcctttccccggccggccgtacgggcacaccaggcacggggggcccttcctgccatccgggccccgcgccccataagccgctgcagggagcgcgcccccaccgggccagcgcgcgcacgtt

SEQ ID NO: 4498 - DNA, 1958 bp, Zea mays
  misc_feature (1)..(100): optimal_loci_45724_G1, chr1:267915738..267917695, Cluster 27
taatgacgatgccatcggctccccttcctctgctacatctttctggttggttggttgtggttggttgatttgggacagggggttcctggtgatacttttagcattactttttcagttaaggtgcacttgttctctcggatcagtgccattgttgctcatgacgactctgtttcagtatatgaacgtttggtatctataacatgataatttgccatgcctagaatactgaattgctataccattatatgaagtttactgttactgacataaggagcttggcaaaaaaaaatgtttagaatattttggtccatgcgtgacaccagttgtctgttcacaataagcatacatatactatttactgcaaagcttagtttatggacattgtgtactttatgtgaagcttagttttggtccatatgaagatgttaggattgaacagtctgtgcttttgcagtgatctagattaggaggatctctagcatgaaatttatggcaggttttagttgtagaatttattgagattatggatggagatggacccagcagcggacttttggggcggggctgatatttttggcctcatactatatcgtgcattctgaaggaatcatgtaactactactgatcatcgttttttaagaaaaagattcttcaattaacaatttatattaagatatatgtttagagtctggactgcagtgaaatacgcctagccgcctaatacagccaggcagttttgtacaaaatcatgtagtgtttaggcctttgagcactccaagaggtaacaccttacacctgtcagctgtgcttttgattttgtgcaccttttcagggttggagaacagaaataatacctcgtgccagtggtgctatgtttctgtgtttgtttacctgtgggtaggatagagtgggtagacgacccactggacctgatattctggtttagtttatcactgtacaaacaaaacacctccctgtttcaaaacggttcaaatgtcgtaaaaggctcgtgctttgggccgagtttgtcgcacccagattgaattataagacctggagccgcaatgtggtcctcctctgctgtgttgagcgtgggatgtgtgtcgtgttctgttttcacggggacccgttttcacgtgcacgcctcgggcgttggccgttgcgcgtccgaaaccaggccagaaaggttcttgctttctgctcctccagctcggcgtgaacagccccagaatcagggtagagagcttttgaggccctgtactgatttgccagactggacgtgctcttcaatcttttcgtgcaacaatgaggctgacttgtctctgtatctctcgcaacttgccttacactgtgtcgtgcaatttggatgcttcgtctgaagaggtctatgggtgagatgagaaggtcccgcttgttttcttattaaacatgttacgaagattccatgagttcaaatcttcacttgctgcacgcttcctaccatatattcatatgtgatttatataccacctgctcgcgacgcctcatgcatgggacaagagccaatatattatgcttgccgtcggcattatactgattacctcatattcacactgttgtctgttgttcggcttaaaaatatcatcaccaatggaatccacgctaatgttttccttttttgtttttgcattgcaaggattgtgatgattgatgctgaattttttattcctcagcgtacagaacagcatcacgctatcaggtatggacaaaaggtagcgaaatatatacgctatgcactagcatatttatcatgttcaaccaaaaaaatactgtatgagtagagggtcatgaatcattactatatgatgcacgacacatcgaaagaagagcgcgtcgacatacgccctcatgtaacagcaacaacacattcgtccgtgttcgtcaagctagttgttgattgacactgtaacaacaacaac

SEQ ID NO: 4499 - DNA, 1591 bp, Zea mays
  misc_feature (1)..(100): optimal_loci_46100_G1, chr1:270110971..270112561, Cluster 27
  modified_base (284)..(284): a, c, g, or t
  misc_feature (284)..(383): n is a, c, g, or t
  modified_base (285)..(285): a, c, g, or t
  modified_base (286)..(286): a, c, g, or t
  modified_base (287)..(287): a, c, g, or t
  modified_base (288)..(288): a, c, g, or t
  modified_base (289)..(289): a, c, g, or t
  modified_base (290)..(290): a, c, g, or t
  modified_base (291)..(291): a, c, g, or t
  modified_base (292)..(292): a, c, g, or t
  modified_base (293)..(293): a, c, g, or t
  modified_base (294)..(294): a, c, g, or t
  modified_base (295)..(295): a, c, g, or t
  modified_base (296)..(296): a, c, g, or t
  modified_base (297)..(297): a, c, g, or t
  modified_base (298)..(298): a, c, g, or t
  modified_base (299)..(299): a, c, g, or t
  modified_base (300)..(300): a, c, g, or t
  modified_base (301)..(301): a, c, g, or t
  modified_base (302)..(302): a, c, g, or t
  modified_base (303)..(303): a, c, g, or t
  modified_base (304)..(304): a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
aaatttttttaaataacttatattgtagaacaaggggagtaagatataacttttggcaaattaacaataatgtcattgaaaaccaaatcattatgggttttctaaagaccccaggtaacataatataggagaaacaatttactcctgcataccccccccccccccccccccccaaataaacacatttcttaacacactgtttttaaaatgcacctaaatgactaagctaacctactctttctaatcaaactatcttcaaaaaaaacaaaaataacaaggccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccccacacacacacacttcttaacacactgttttaaaaggcacctaaatgactaggctaacctacactttctaacatactatcttcgaaaacaactaaataactaggccaacatgtctaatctaaactacctcgaacacatgttgttagaattttgtgatctagttttcataagttcatatagagaaaacttaacagatctcaaaagttttaatacttgtgttcttgctgggaatttgacaacaggtaaacacatccctcgacaattcagaattaactaacaaccatctgttagagcttgtattaatcaaagcaacaaaagtgacagaaggatgaattaattgactcaaatgcgatgagtctgactttggccccaatgcttcattagtgaagggaaggtgcacgtgcacgtgtgaaacacttaatttttgaagcttcaatggaaagaactacgacccccaagccatcaagcaaagaagtcaaagaaagctagacgcatgcatggacatgctcgtgaagactgaccgtcaatagagcgcaacaaaaagacttttaatcttatattttaagggtagtaaattctttttacataaattttgaagatggagatccctataaatacccctgaaggggtactgttcatggacatgagaaattgtatccaatacaatttatttctctactctgtgtttcagttcatccacaccctaacatctagcgtccaacatttatgtgtgcttgttaaaatcacctatgataaacaaacaaaatagctagacccataacatcacctactatcacaaacataacatctagaccaatgaagaagacaagaccaggtgtaaatgaaaataacaactttgataataatgaaaaccaagactaagctcaaacaaaccaaaatcaagatgaagcagaagaacaaagacttgaaaatagcaaaaccacttataaatcaaagagacagaactcgaagaccgtcagaaaagagaaagggaatatcattaaagcaaagaatcgaaaaagccaaagccactctttgacgattaaatgatgaaatttacaacattatccaagatgacatactcgatgataacttaggctctacagcaaaagcttcgcaaaaaaagcttacaacaatcattcaactccactgattcaacttccccgttatcaaaaacttgcggatggtgtagtggcc

SEQ ID NO: 4500 - DNA, 1691 bp, Zea mays
  misc_feature (1)..(100): optimal_loci_46714_G1, chr1:273339632..273341322, Cluster 27
atcgagcggctcctccctttggagccttcaccattgaacaacttgcccatgtgcccttgacaaagcttatattaaacatattgatatttatgactctaattaaattctgtacaataaaaatattttttacaattagtttaatgatacttattttatatcataaatattaacattttatatagctttgctcaacatcaaagtgtttggtctccaaaaaaggcattcgcctttttatagatggtggaagcactatttagttgctaaaatctaaatacaccaacaaattgtctactactaactaaaaagtggaaataaactacacaatttagtcaatagattattagttgccacattttttagtctattagaacaacttactaagtactacctctatttaaataacaaatttagagatattattggttaaactgcttaaaagtttcatcaaaatgtatatatatgaaaaataaatggcaatcagctataatgatgcttatctgataccaaatatatttatagtttgtacatacagttagttaaacttcagatatgttaatttcgtacaagtgcatgatcttaaagatgaaggtagtaaatatgattcggccaatataatactagggaaaaaaactagtactgagtggttcactttcctcgccaacagctaataaactaatctctgggggcacacatcttatttttgataagtcaacttttcatgtttgaaaaacatactacataacaaatattattaagttaatgccaaagtattatttctatattaaatattatatacatcttctttgccgaaataaacgtctctatggtattcttatatgtcaactttcttaagtttaactagattgatgtgaaatattagtaatatctacattctaaataaattttattacaaacatatatttaatatactataaatatcaatattttatatatatcttgctaaagtttaaaattgttcagcacatcgtcaagcgcatttattgcggcgcagtacagtactgatattagtacaatactttttatataaaaatctagtgaaatgggagagtaggtgctgtatgcattgaacgccatgtgatgtgacaactgacaataaatgccggtagggcttttatatggccatcattgatactggtattcggactggacggccgggtgcagacactgagagcctggtgaccacgttttaattggagcgtgtgaccattgcgcttgcgcagcgcagggaaggaagactggagacacgtccaggtgtatgatgctgatggacttttaacgccattccggttcatttgtgtgtcataaacaaatgaagctagctagctacatttaaagccagttccgggtggcgccaagccaaagcgggcatcattatccagaggactagaggagggtggccctgtcgtgagcctgactggctgatgagtgcctgaccggctgacctgaccctgactgaaaaaagttactagcacgagaggaggaggactggaggaggagggtggaccagagctagctagctctgctctctgaactgcgctatctctgcactgccgctggaccactggctgcactgcatgcgtaggaggacatgagctgacgggggcaatggtatggcacgcagcaggtgcagactggggcgcggccagagacggcagtgtgtgggtgaatgc

SEQ ID NO: 4501 - DNA, 1527 bp, Zea mays
  misc_feature (1)..(100): optimal_loci_49154_G1, chr1:285053198..285054724, Cluster 27
gaaaaacaaaaataacactgtttttgggaacgggaggaatcaggaggcttcattgaagaacattgacactgagtgcgtagacagggccgagtgaaagggtctctctagtaggaccgacatgtccaaactcgagatgaatgtgacaaattcagggcctagtagctataacgtatggagaaagtaaagaagatgctcgtagactattgttctgttgtggtttagaccaatcttgtccaaggatcatggctgtcgtggttgtctgccttggtttcaaccagcaggactgtcgggtgcacaagcataattctcattaaatttgaagtaggctcacctcccatttttgtttcttgccaataaaatcatctggattttgttttaatttggctcattatcattttaatttatgttgatagtttgatgcacacccagcaaaatataatgttcatatactcttgtcaacagacttattgtcgttggatcttcatatatgccatttaattattgtcttattattatatttacactaaattctatggtctcaacataaatagggatacatgtacgcaatttatttttgttgttatttatgcttgttctatatctccacacaccaccagcaccaccacatgtgtgggggttattttattatatttatgtttgtcctgtatcttcagcttacctctactttattttgggcttgatttggtaattcttaatgcagcgggtggaaccagattaaggacatcaagatggcattattaatatgggcttgtgtatgctaacgacaaatcagagatcccactttgaacttcccttacaccattgactcaaagcaccacaactccacaatgatatcagctttcaatccttggcgtcgccctccctcctaaggctgcaaatggtgtgcgcggctatatgtagctgctgcgcaaggacagattggtagcaacctagcagatgcccggtgtcttcaccattttcatctaacatgagcatccccctgtgatctcttcttgatccttttttcccatctcttaccctcacaagtctgcactaccgtacgttcgctgaatatataaaatcaggaggagcaagaagagaccataggtacagagttgtcatcaatccagctgatcgagccactaacaagtagtgtaaaggagtaaaatgttctcagaactaggatcctgtggcatggattcatggtgcatcactcacgttgatagctagtgcagagaaactgcttccatgttaaatacgggtagagggattcaccaggagtgagggatgcaatagtagcaagtaaattaagcaaggacaaaatgggactcccctgctttacttgaaaaaaaatatgaggactactagttaatgcgagaatgcgttgagttccacgtccatgacactagcgttccattgacatctcataaagtagcttctctgttaagtcgatccgctgtccaatgaagataccagcacaacacttctagtgctttattcttccattattgctggagcatttggaac

SEQ ID NO: 4502 - DNA, 1477 bp, Zea mays
  misc_feature (1)..(100): optimal_loci_49374_G1, chr1:286433342..286434818, Cluster 27
tgctagcttgtatgcacttatactgcctgagtacatgaacctcatccattcaaatgtatgaggtccatatctgctgaacatatattacactcgtaatctacataaccacatgtaagaacgattcgattttttaatgaaaattgtataaagtgagatgacattagttgtgcttctaaatatttagaaaacaaacaaaaaataaatcactgataaagtaaacaaaaaaggcggtatacttctgatcatagaaaaaaaactgaaacgaggaacccaattagcggaggcccataggaaccagatgacagccagaaggtcctcaacaacaacaattgaggaggctatggtggcaagaacaccaaatcaagctgactcctttacagatttatgccaatagatagccaaatagctggaaaaaaagagatattgaggtatctagggatgactcaactagcgggtttggttgacgaagaaagctgctaaggggggaagaagacccaaccaactgaaccgaagtaacagcggaaaaacccccaaacctacaataaagaagatgaaaaaaacacaccaatgcagctcagaaatccaatctccaaccaagaaaatcgaaggtaaaggctataatgtccatgaatcatttggcatcagtccataaacaagacactaaaatactaactgtagaggtcgagtaagatctctttatgcaattctccatgtgtaccttcagtcacctatattatgggttctggtctgatgtatggaagtggaacaagaatatttatatgcaaagctatctatatttcagactgaattagacgcgcacatatcttgcagctgttgtctgattgcaatgtaagagaagttcttctattatattcttctattatatttattgttctaaaaaatgcaaacctagagcactattgctgtaaaaggtggtaggtacgttcttttgtactaagttaattacaggtattgctcttctaaaaaaatgcagaaatgacatttcatgctatatcgaaccgaaaatagaccatcactgattaaaaattggttttacccgtatcttaagtctaaatatttcaatatcatcaatcaattctgaacatatatatgaatattgctgcccatgtcaggcctgattattttttctccgaatatttctcaaatctgaatatttcgggcagcaaggtcgtgacaataaagtctatttattgtgtggagaaaaaatagggaagttttggtctcataaaacaacagtgtgcacttgctttagacgacaatgaatgtgtaagtaggagctgttacaatcacagcctccactttcaataaaaaatgtccaataaaacagtaataccactaccacatatagggtctccatatggcactaagcagaatgaattactaggaggggagtctctataagacaatgggtgctcatggatttggtgtttgtggggtcgggcacgacagtgatgat

SEQ ID NO: 4503 - DNA, 1780 bp, Zea mays
  misc_feature (1)..(100): optimal_loci_50542_G1, chr1:293609087..293610866, Cluster 27
aaggttccacaaagtgagacatttagtattaaagcgaaactcccactataaccaacgtcaagggagagctagttggtcctcctactcaaaaacaactgagtgtgtaatcttcagctctgcttccatcagttcaaacgctacaaataggatgtagggaattatgcttatatgccttaattcaacaagccttgggggctatttagcaggtctctctaggagtgattctcctcctcccaagctaaacaactagatctcacacaaattcaggtggggagcacacaagaatcacttctccattcacatgagtatgaaataacgataaccatgagtatgtattcgaaaaatgcaatatcatgctaattagaaaataagtagaatgaaaaccattatattagtttgtctccctccaaaacatggagggagaggtcaaatctaacaaattaaatgtgttgccattatgttattctttcagagttgcgataagtttccaatactcacaatactttcttccatggcttgttattgcatgttcttttgcatggttggctagaagatgcaagggcttgagacatcaaatggcatcacctattgctattgcatgttcttctgtatggttggctagaagatgaaagggcttgagacatcaaatgacatcaaggacaatgtaggtatgagacatagcatgattatgtcttgtctagaactcgctacaagtgatggaaagcccttcatgacaaaggcatgttagccacacgatgtgttgactaccttaccgggcggcagatattttatttatgatgtagcctaatggaatgcaagatcttgaactctggattcaaaagtaatagatccttggtttccagttagaaaaattatcgattattagttcttagtatcattttcctccattgagcaatgtaaggcgtatttagaatgtgctcactaaaatatttttttgcaacatgaattctcttccatcatattgtcattttacaaaaacaacatcctcttataagtatacaatctattgtacatggaacatacatataactagacaaatgccccgcttattattgcaaaactcttttagaaataaagttattgcatgtataagttaaacccccatgttcttggatcagttcctaccaaaattaggtaagacgataaaagagtctaataaaaaactaatataattagatagaattataaggtgatggaacaactagcaaatatggatgtcttgttatctggtaaatttcctatatattgaaaatagtaattacacttagtcaaggtgacgtggatatggtgcattaaaatgtttaaaattagtgggatggcgtgacatttagtaaaaatgatgtggatggttggtgggagatggcattgatgacttagatgttgagatagaaagattctaatgtttagtgggacaatatggtttttagtaaaaattgatgtggatagtgggtggaagatggcgtgaatgacttacatgttaagataaaaagctagtaggatttatgtttataagagatgtagatatggatatatagacatagatatagatataactaatttatgataaaaagtagtaaagtatgactttttcaatccaaaatacacattacactaatggacaactggattacatgataggatattgcacgcaaagaaaaggaggtgaattgtttttctatttgtgttttagcaaacatactattgttagaaagtaagtattcttatgcacccccataattctaaccttagcgtgttctaa

SEQ ID NO: 4504 - DNA, 1635 bp, Zea mays
  misc_feature (1)..(100): optimal_loci_53950_G1, chr2:11548160..11549794, Cluster 27
ccggcatggacccactaggtatggcatgtctaggcctgattagtgtattcccaatgaataatatcatacatattaatgagatgtcatatatgatttttttgctgatgtggcaagatatttaattggagggagagaaaaaactatatcttaaggctattgctagtatattgtatcttatcatgacacccaaaactgacatggcatataaaattgcataagaatataagatacaactatcacaatgcacgagcatcatctgacctggtcggtgccacctaatttggcataatctccccttcacccaagtccccctacaatacgacacagatatgtacgcgaaatgcatgcaaaaggaacacatggatatgctccagctagagctagctagagctaggcatattattatgagagacagagagtagcatctaggaggacagatttgcaaagcacatcgtcgtctcttgcttcttcatcaagacaggcgaccgacttgtgtttgtttccaggactcaaaaagatgtgtgtcgtcagtcacacactccacaacatcgatcacactaataagcatgcacccatggtggattcaatcataaaaaaggctgaacggcctcatgcatgcttggtgtgaggccagcttgctcctttgtaatgtttgttcagtacaaattaacacgctgagctcataataatagccgccatctctcgctcttttgctttgggaaaaaacataaagacaatatgagctagcacgcagggcatatgtacagcactacagcttcctattttacatccaaataaagaacgaatcactcgagcatatatagcgccattttcttttttctttttttttaaaaaaaagaatccgaatgttgtagtgcgctacatactaaacaaaaaataaagtcgagcctaattaatggtatagcaactcatgtacgtctagtatgccgcagtgcgcctgtgtgccacatcacgctttgtaatgattcaaaaaggaaatagaactatcaaccgtggttgtaataacgtaaaccatgcatgccgtttattcaaaatggaaaataaaacaacgtacaaaaaaaacaagtaatgattagcgtgctggaacgtcgtacgtaaaatacactgccctcatgattccaggcagccacgataatcatgcaaaaccgacaagtatacacacatgacacagaagcgccaccagcagtacgtacgttggagcttaatctgatctccttgtccgttgagaacctcaccaccctaagtgatccctgaccaagcgtgaatcgagctactttactactgtctgacagcacatttggatgaggatgagccatgagcaaaagcaacatgtcgacgcgatggtatcatgctactactccagttggaacaaatcgggcctaaaacctcggaatacgctaacgactaacgtgattgccagagttccaaacttgctttcacgctgtcatgcatgatgcatcgcatccatagctacgacaggtgactgggcccactcactccagtcactgcacggcaggagtcctcgactcctcatagtggacgcaggtaggtgtactccgtacgtgatgctgcacgcctgtacgcatattgctcggctcctgtctcgctacccac

SEQ ID NO: 4505 - DNA, 1650 bp, Zea mays
  misc_feature (1)..(100): optimal_loci_55916_G1, chr2:22041723..22043372, Cluster 27
ttatcatttgctttcgcaccggccagaatcactccatcacgtgatcagaaagccgagcataagaacgaaggaatagagctctatcaaacatgtaataagagatcaagagccgagctaagaatgaggatgagggatagagctctatcaaacatacatacaggtctaaaaggctaccacaagtccttcggtgagctatactactacaacttttggtatttatatctttcaaatatatttttgtatttcaggcactgacggagaaaagtactaaagctagaccggcaacgtatcagcatcatatccaacctgatctattggtgtacccgtacaaccaaaatacaatggagctgattgaatgtatgcccgctcgtgctcaggctctcgggagggcggccagatacacacgatttagacgtatcgatgagtgcaggcaaaataacttatctctttgtgtagcccacgtctatcacacgtaaataaccaaacataattttagataaattcaatgtatgtggtggtctagaatgaaacgatacgatcaaccaatcaaacataatataaaggtgagcggactttaaaaatattctttttcaaaacaactctctaacctcgctctagatattttttaaaaagatccttccacctctatgttatgtcttggactcatggttgtacggttccaccaacagatactattgcgtttgatatgttgctattatatttttagaaagaatggagtattatttactgaagggagggagtactgaggtgagggagatctgcagtttccctcttaattctcaacgtacgggtacactgtcgacgcatctcagtaccaatctcagtaccacgttaatgttcctgccgactgcgttttcttgagtactcctccgttttaggctatctgagtgcaaattaccactattcacaatctagttaacaagattctttactctatatcataatcaaatatcatatattgtattcattttaatctcaaattattaaacttatatatgtatacatttatctaataatacaaagtcaatcaacttttgggccgcgaaaaggacaggtagcggagaaacgctttatatggtgtactactactattctcgccgaaccatccaacgaaaagtaccgtagaacgctacagtatttgttctctctatctgctttaggggaagttttatgtatagcgttgtgcataaccttaaaacaaaattctaacacatgttctaaaataattgcaactctagatataagacaatataattgtattcttaattttccccataacataatgattatatttttattagtatgtatagtttttattaatattagtcttcgttaaaactttagaggtgtatgtgtatttaccttttgagatagagagctaggatttttttaaggccagagttggccgtgccgacgccacaggcccgagggctcacgtgaacaactgtaggtacgaaagaaagtataaacaaaaacgactgcccgagcaaacttgagtagattcatgaacgattgcttcagtcgcgtgcacgattcaatctatcgccttattcgggatcgatgattcaccatgatctgtccaaatccgacctctggttcctcgtagcgaaattccaggcatgcagtagg

SEQ ID NO: 4506 - DNA, 2499 bp, Zea mays
  misc_feature (1)..(100): optimal_loci_56241_G1, chr2:24009027..24011525, Cluster 27
catgtcatagaagtccacacgataaaaccatccatgttcattatcggcagataactactgttgtttgtgtaggatcgctattggagatgggttgtgaaccctgaaggttgcagtatgtggtcggctttgtctgttggcactagtcatccacgacgatctgcacgagaggaagagatagcggagcagctgagaaccacacaaacatctcttaaatctttggtgcaacaagtttctcaaatgcatacacaacagatgatgcaaacactatggatgcaagaggtatatttttgacaatttctctttttcatatctttaagtttattttaactgaagaaatgatgattaatctattttgtagatgtgcggtggaatcgttcctcaagtcggcatgcctccttttgcgtcgtcgcctatcatccaacagccgtcacagccaagaggtgcatcacaggcaaaattgtttctgtttcattcaatataaggattaaaattgtaataaaaaattttatgccgcaacagggtgctgcctcagaagggcaagagcagcagatgcagcggacagctccacaaggtcctttcccgcctccttctcagctagaaacacatatgtagtggatagctacgcggggtgctttcccgactcctcagctaggcacatcgatgtagagtagtggactgctccacagagtgctttttcgtcatcttctcagccagggacagctcactggccgttcggaccgacgcagtggggcgttggaccgcaagggttttgtcggtgttcgacctccagtccaacagcagcactgccacacccatccctagaggaggtatgctactttagtttgaacaaattagagcctaaactgatattttcaactaactttgtaacatatcttgtattttgtagagtttaacttctcgtcatgttacacctcataccccgagcgagaccactctcacattagtgggagtggctacgtgttacacgacactttaacttctttgatcatttgctttacttatttcgtttgctcgattggactagtaatgattatgtgattgtgaacttgtatttggtttaaacttggattaaagccaaacgaacagtctatttgatttaaacttgtatgatatgattgtgaacttgtaggttggcatgtgtgaaattctgtgataattgtgcactaagaatctgttttaacctgatttggaggcttcccaattggggaggcagaaaaaacaaaaaacataaaaaaggttaataaattcgtcgatgatggacaaatttatgaacatcgtggcttaaattcgtcagtggctagcggatttatgcgcacacatggcatcaaaccggtaggctatggtgcagccacgtagcgcttaaactcgtgagtggccgatgaatataatgcaaatttgtcggttagcgacgagtttacttgacacgtgtcatagagccaccaccggttggcgtcgccacgtggcatgtaagttcatcggctgagccgacaaatttaagataaagtcgtcgatctagtcgacgattgacgaatttaacttaaattcgtttgttcctggtccacgaattttattgttgcactaaacgttctcctatttttttcattgggttttaagagtttttttcacggcatattagtatacacaacttttaatttttctcacagactttttgaagtaagtttacatatgacacaactgtccaagggagagtgttacaattcaaatccaaatctgccgaatcgctcgaatggccagttgtagtagtagttaaggaggagacttgggtatgaatccaccatcatcccacggctatcttcaggaaacttgaccacaagttcctctctcccctgtataaaattatgtaaaccatgtgattaataaaatcaaagattcattttgtcttcatttacaccctaacatggcaggccgccggattcgatcgctggcagcccaacagatccagtcgcctgtccaccaggtgaggagccggatcaacaggggagcaggccagaacgacgaatgagagccaactgatatttcaacccggatccacacacggatttgtaacaacatccggaaaggatcctctgttttgatagacctatacgtactcctatgatacgcgtgcacaaaatttcttttataagcctatctcgagcagactcctatgatagacctataagtatcttcattcatattttaaattttaaaagctgcaacagggcatgcgaagagtggctaatgttctagttccatgacagatgatcagatcccctccatcaaatcatacacggaacttagattagcctttgcagtttccagtcttgcatacatgctgttaacttccagaacatacaaataagtaatccatatgcaactcagcgtcatcacaattgactgattagagagagcatattagtgaccctaaggactgattcggtgaccagggaattggagaggatccatggggaggaatcc

SEQ ID NO: 4507 - DNA, 1829 bp, Zea mays
  misc_feature (1)..(100): optimal_loci_57380_G1, chr2:30560029..30561857, Cluster 27
accaaatgtttaactgatgtagtagcttccaaatgtgtataccaaagtttaacgcttgttttgtgctcaccaaatcggctccagaccgaagctaaacacaggcgtgctcaaggtagctccaaccacgaccactgtactgatgcttggttactaaatctagaaggaaaaccctattcatttgctaatttcttatggaactttttttattccacggtgcttttcattatcactcattttcagcagactgatcaccaacatgcgtatcggtacccatttttattttattttttttaaaaaaaaacatcacggcattcctgcatagtctacaaactcaacaggtcggtgaagtaagcactacgacattggtacaacaggtttgcaacctccatttttttttgtttaaaaaaactctattattctgtccattactgcagtttcagtgcaggccctgacatttgcgacgtgttctacctatcttctagtccgctcgagaaataggcatgtatggtgctctatttcagtaaaaaaaggatgagtgttggttctattaattataacaggtgtcacctgaatatcatggatttccgaaagcacagaaagtggcagcagcacagagagtctaggggtggcacatgtcccatctgaaatgccaccacttccgcaatttgccaaggatgatcaccatttccagacgaccagaccccaacagcaacgaaaaagtgaagtgtcatcacggaccaacacattgacatttgacaatagatcactgaaggaaaaaatggcgatgagagaagaaaggagcgacgagagatagcttcgccggcctccagacaaaaccaatcctcgccgttcatcctgtcacctccgaccggcacgtcgtcgacgggctttctggcgctgcagacctgcagatgggcgcttgttttgtgctcaccacaccaaatcggctccagacgaaagctgtcgaggaaagaacacatgcgtgctcaaggtagctccaaccacgatcgctgtcctgatgcttggttactaaatctagaaggaaaaacctattagtttgttaatttcttatggaacttttttttattccacggtgcttttcattatcactcgttttcagcagactggtcaacaacatgcgtatcggtacccatttttttattttttattttttttaaaaaaacatctgcgagtatatagtagtagtgcttttaattacgtggagtctgattggaagtgctgttttccaatggacaggcaggcacgcggggcaaactcgctatgtttttttcttttctcttttctaacgtctgcagtggaggtggagcctgcccgagaaagtagaaggcctggctaatcgaagcgtggcggcgcaattatttgatttgattaggacgcacacatgcatgatggtgggatgggatgaagctatggtggtaggtatacatgatgacacaacaatgagaaactcttgaccaccgtaagctagaaatacttttagacacaagatgtagaagtaatcgacatgttaatgcatggacgtaatttgtgcaaaacaagagagagatgatccaattcaaccgctgttttagcagcgagttgcattctcattgatgtgtccatacggtttggattacattttgcaaccattctataatttgcaccggatggatcggagctcactttttccgttcagaatcaaattgtgagggacaatcgccttttgtccttgagtgtgactgccacttgctctacatgtacatatatatggatgagtgtgatctgtctcgtgtgtgtagttctgcattttctgcagtacacgcagacga

SEQ ID NO: 4508 - DNA, 1527 bp, Zea mays
  misc_feature (1)..(100): optimal_loci_5792_G1, chr1:29551320..29552846, Cluster 27
ttatccaaacgtaccagaaattgttagtcatttagaaaaaaaaactgttgggaaaaagaattagtcttgtagtgacgatggagccaacatttacctataaattttacatcaaatgtcacctaataattaccagcccgtgcagcagtattagtctgatatggtgtagtagtattggttaaaccaatttttatgcccgtcgaaatacctgccgtagcaaagactgccttcgcgtgttgtttcccctcctacaatatatagcatcttgcattgacatcagactattaattctcaaccaccatacaagacgtcgcagcacggccattttagtgcaccctacaaattaatacgatggcatacagctatatacacacacacacacacacaccattttttatagcggtgatatattgccatacacgtacgtctagctgactgacacgtacgtgtccaagatgatttgcaccatgatcaagatgaatgtggacggcgcaccaccaaatccgatcgatcgatcatcagattcggattcttttcacatgatcattggtgctccaggctaggacaagagtacgtggttgtatcgagtgcgctgtacatgtaagtcttggggccagcatccttcaacacacaacatgagatgccggcctttttatagttcttccatgcacggcgagatagcgatgcttcatgccctgcagcactggccctcccttcccccatattacctggcctctgcatgcgccctctttgacaccaagaggggcatggcgaccgtacgtagacggcaagaggaggacacacaccagctatggcggtagaggggttgtggctcattgcaccgtgtggtccccacaaataaaccaacataattgggtttctcttttgtaggttgcttggggcacttgccacctgggttgttcccctcacttttgacaataacgttgatgtggccagctactatacatatttgctcccattaattttaatttctcgtggagatttcttgacaaaacctagctttgctatatatacatacatactactagacggtgaacgataataatggtcatgatctctgatgaggctgatgggctcaatgatcagcttgcgatctaccaaccgccccccatttaactgcactgtactattgttggttagttgtccaatgacaatcctaaaaccggccgtgcaaaaaggatccgatcgatgatgttcactgccaaccacaatatatataatctgtctttcaaatgccacatgcatggactcttcagatcaatgtgttagctcgcgtcacgtttaataaaaacacaatcccaactatagatgctttttcatgcgaaaaaatagtggattaagaccctatttattatttagagcttttaggctgcttcgtcgtctcagcgtaaaaaatcataagctaaaacaaatagataaccttttggtttagcttccgaaaagctagaagctcagaaaaacttagtttatatgaaaagctaaaaaaagttttgttgttttgtgagcatt

SEQ ID NO: 4509 - DNA, 1776 bp, Zea mays
  misc_feature (1)..(100): optimal_loci_5793_G1, chr1:29553171..29554946, Cluster 27
tagcttttttggatttagaaagctaataacatcatttaaaagttatatatcatccgcttctcaaaattaaaagtccaataccaatctttcagaaaagctctaaaagctcaaacaaatagaccctaacagagacatgtgtccttgaacgagggccagagacggtttagcgtttgctcaccctccatgaggcgacgtagcctttagcctatatcctgtacatcggatcgtgctaaaaatgtgtgacgatgattcatgagcttgccgagatcgagtcgataagttaaattatctgactagactagttagcatacgtttcgttgtgtagtgatgtagttggaagttgggagagacgtgttccatgcgctctcatttttgcgtgctctagtgctattgccgtagttgagtacgaagcaaaccacctgtagatggagaaaacgttctaaaccaagaggccgatttaagggtatgattttgttacaagtcaattcggggcgctatgcaagaaactatagcgctaaaaaacatgcgatctactttctccatttcaaatcataattaagttcttttgaatttttctatatagataaatagcaaaagctacccatctaaaagttaaaacaatttacaattcaaaatgaaatgatccgagagtacatgtgtagccaacaacaacatacaatacattcaaacatctaaccatataatcatgaaaaaaatcatcttccctagattttcctctaagtttctgattagatccactagctaaacttagtcgataaagtttagctgctagagactaaaatgtacacaatctctttagctattttaatcttgctaaacctgtctaaagtgtgagtattgatgaaattacctaacgtctacctataccaggtgtgccccaaaacaccctggaagacccactctaagacaaaggcaccatctaacgtggcctcgatcaggacagctctcaaccaggttgggccccaaccaaagctcccttgacctggtcaccctaacctgatcagacccaacagaggtaacccctacttggttacctcgactaggttggccccgaccaaaattcacaatacatgattccccgaccacaggttggctccgacctcagtcatcctagtaaaccctaacatggtcaccctaatctgatcgatcctgacctcaaatgccttaagtagcctcgatgtagtcacctcgaccaagatgacgccaaactcagttgccatgatctaggtcagcctaggccatagactcctaataagactccatgtatcggaggtgccatgaacctttgtgaaaatctaacacatttatgatccctctgaccatttagtgcacacttttgactaaggcatgcgcttggtgaaggtaattacagtaggaaggactctgaggacgacacctctatccaaccactccactctccgaaggacaacaaagacatgcagactatgacgagcctcaccataggtgaaaggcagtcatacaccccagagaagacataaataaaaggagtgaactatgaggtaaaccacccatacagctccccatggatgcacctcatatggcctcgatcgcccttctatacggaccaattacccctggtccggtcaaaccagagatgacatgacctaggggttagacgccagggatgatgggccttcaagagcgtaggagacaactagggacagattcagaaaaaattatgagggactgaattaaaccactgtagtataggagcctcttttacattgtatgtgt

SEQ ID NO: 4510 - DNA, 1561 bp, Zea mays
  misc_feature (1)..(100): optimal_loci_62911_G1, chr2:61834417..61835977, Cluster 27
gaaaacagttcttttaatttatgcatcatggggagccgtttttcactctcctactagaatgagtccaagcttaactggctctctttcatacaccatagcaaatagctggcgcgctaaacattgcaagtactaatgtatttgtgtgcctctcagggttcaccgtctcgattcctctcgtttcctccctgtttaccagtcctcttggcgggatcgagaaaccggcgaaaaccggacagattttgttgtttccgaacggtttggcaattcaaattagaaaaatcagatgtcgttagaaaccacctataccgagcgggttttcggtggattcacaccgaaaaactgtataccgaacgattttcaataacaagtctacaattcattaacttttttgacactaaaatatgatttttttaacaataaatatatttctagactctttgtacactctaattttaatatatatttttctgaagtatttacaatattttcgaaaaatccaaccacgattcgatgcctctatggcccgagaatgagaaaaattggtgaaaaccgccggattgcctctaacagtaaattttctttccaaaaagtgtcactaattaacaaccattggataataacttaataaggccctcctccgtgcaggcggtatatgttttatgttaataatggcggtatgtgttctttgccattgccaagtggttaggtgcaactaattgtgtgttcgtcccatgaaacagtcggattccttgtcgtcggagccagccatgatatcgaatcagttcattatacgtcctgatagctgacttttcggttaatgaaccaagacgaaagtatcatgcacataaaaactgcacagggtcaacatcgcaacagcaattattggagctaaacaattagcctcagcacatttttaactatcgtgcaggtactattcctactctgacttgctgtgtggtctcttacaggagatgagttatttcaacttgccaacatcaggaaccttattggcaactgatagctagagagatatagtttcgtagcaattattggctatagtacagagatccaagtcagaagaagcactttgttcttgggttaacatgctactcagtatgattaccgcatagaaaactgaatgatttattgacaataattatcactactatagaaaaaaaaaatgtctgtgatctaagacatacgcacgtcgcaagtcaggtaatgcatttttttgaggtgctgctaggatttcaacctaggatgtagggtctcacacgttctcttcttataccactcaactatattgctatttatgactagaaaaaatgttttcctataattttaacactggaagagtcttaggcatctattaagctgtctataacaaatcatgtaaaataaacgatttacattgtagattactatgtttataaagtgaagtttaaaatatatgataagatagaaaatgtgataggatagctgctccaggtaaccttagtaacaaaaactagtactaaaggagtcatttagtattgatttttgtcactaagggtacctttag

SEQ ID NO: 4511 - DNA, 1803 bp, Zea mays
  misc_feature (1)..(100): optimal_loci_62916_G1, chr2:61846832..61848634, Cluster 27
tagtaacgacaccacgctctaaccatggcaacaccttttgcaagctttttagccatctgttgccagagtagcgaagatttggcactctctggtagaagaatcaggacatgccacacaagaaaacccatggacagacattgttgtcgtcagtcttccttttttttctctctccattattcatggtcagctttggtatacttcttgctactataggtataggcatccgctagtttcccgacttatctttcacggagtcgtgcacaactgttgtggatatgatatggtataaatttatttccatctcgtgccgcttttactctcagtgctcgagaagacttcacacagctgaaatgtgtattgcagaagatgatggtattgtttgaaacttacgtatttttatgtttaacttaatttagaaaatagttgagatgtcgtgcttacttaaacaattttaattatcaagttcacctaaacctaaacaactaatactcaatcaaactgagacctcctagaagcagataaagtccaaacacattagcactactcaactagagcaaaactacacaagctaaactactatagaggtaaacaacttgactaaacaagttaagcaaacctactcggctacacgagctttcaagcacgagagaacaactactttactagaatttaagctacaatttatttgatttaattaaataaaatatggtctacacccatattaaatttaattggcatcaggtggcaggtgtcgctcagcctttttttttacaagggtgtcgcttaactgattgtagtagtgacttgtttttgacgtgaaacctaaaataggtgcatgattattatacggcatgaaagatgcattgacttgcaaatgtatggtgctgggctacaatgacacttacactacagtgctttagaccacctcgtggaaggttcaaattagtttttcgcccagccgcccttagttgtggcagcggaattgaaaaataacaatatttttcgttacaaaatataaaaccttcaattattatgtctgacttcgagcatacaactatcaggataacgatggatatggtttctttcttgtgacgctcagaattaaatagcagcaatcattggctgttgttttcttttttaaaaaaaaatgaatgagtcagaggcttcaaggtcagaggcacaaactactctctcaaggtcaactctcagcggcagcgttggtttcctaaaagcagctttattaaaacactgttctaaaataattaacagtttagatgtaaaaatgtagtagaagtaaaaaaagacgttttatataaaaaatttaaaaggagacagatagagacgcattgaaaaaaatcaaaagatgtaggaaaagaaaaaatgaattaaaaatgtgcatgatagttgttttagtataaaatttaaaacctgcaacactaactgttttggaactaatgaagcagtcagatttacagtgcgtgcatccgtgcagagcatctgtacgatcgatccactccacgaaaccgagttcttatcttatactattagtttaagccattatgttcttttgcaaacgtagcatctgtcaccttcacaagattaatactggggatctaggataaactgggccatccaagaaacgctttgcgcgcaaagaattctaatcaaggaagctacggtgacacattgcatgaatctagcacccggccggccggccgattcctattttccttacaaatgatctcaccaagttacatctacttgtgagacttttctactcagttgacaaatttctattccaac

SEQ ID NO: 4512 - DNA, 2150 bp, Zea mays
  misc_feature (1)..(100): optimal_loci_63432_G1, chr2:64937982..64940131, Cluster 27
tcctgagtaagatgcgagtgaaagagagttgtgtccaccaccaatcgcctcctgcttctatatttggtggaagttgaatgccagtggctggtgggcatgtgatgcatggaccagaaggagatgaatagtgaagcctgcgtcgctttcgtggcggtcctcgctgcacatgattggaaccggtcccccttggcatgcttccttggagccatcacagcggccagcgcagcgcatgcatgattccatcaaccaaaggggcgggcaggggacggggggaaagccaaccccggattggaaaatatgcgtggcatctatctatctatgctgatggcggatcgtcccacatttagacatcacttgttcactgagtccaccgccacgacttctcttcgatgctatcacgagaggggttggtttcgcaagataaactgcttcggatccgacaaaatttatcaattggtgcgttcgataaaaaaacaattcgctgccataaatggcatgcattttctattaacctagtcagagtttcaaagaaacggcatgcattttggaatggatggaattctgacctatatgcttagttaccattgttttccccttaacccagtatggatcaaactgttctcaacgacgccctagaaaaaattcaggtgaaaaaaatggaacgctatgtttccaacgcagcctacaagatgcgtgttggtgtaggttaaagttaaccgaatcgccaacagcctatctatccccccggcggccgggcttgttgcctttaagggcatcatggccgagattttctacatgagcatattcgatatggttccgtcctccattttcaccggattgggtgcggctgagtgctcatggcaacgagacgaccaaacattctctcgttccgggaatatcacgagggcaggcagtaccgatgaaagtagcgtgtactgtgcttacctttccatgctcccttcccctgtgagctgagtttttttttggagctctgcgcctgattggctaaggcgcgtcagaaacagaatcttttgatcttttttttagagttcttggaggggaataaaagcaaccctttatgccctgcctaggcccagccgccagaggaggctgctgtggatccatactaggatctcccttagggcttaggttagttgcaaatgcgccattatcttaatgcctagggtagctctccacaaagatgccactttcccatggttttcttcttcccatctccttttactatttcgcactcttttgacatcacggaccgagagctacgggtgcgcccaaaacacacacacacacacatggtaccaagtatctcaaccgtttaaatggtgtcattagatcaggttagacagagatgaagacaggttccagaaaacttagcgaaattaaatgatgagttcacactaggtgttcacctagtgtatgtacaacccagaggtcctgggggttttatgtacaagcgacagctaagagtggcacaactctaagtttttagatcacaaatatagttaaaagacaatatgtatggagacgagtgtagaacaagccattcgtgaagagactatctcttgtattttttttcacttaaccttttaaagactcctcaaaagaccctatattaagggggtgcttgggattgctctaacttcagaaaatttgttcgagttggtacatcaggtcgttatgtgctctagaaaattgtggagctagggttgtgaacctttaaatgacattcagataaatcattttatttatcgtttttattgaaaatatttgtttaaactgtttaaatttatattataaagtaaaactccaagctggaatccaaacattatctaaataggttgtacatgtccttctatgatgcaataatgacaatcaaatcttgagaagacctttcatttggtatttataatcgataacaacgatggccagaaagacgagggggacgggtgtcaactgtcatgggacggagagttgcttcggtgaaggatccattatattttggtgttaaagtaaaaaatttattgcagacatatttagtagagacagtatatttgtctgatctgtgagtagggaggtaaatggtatagacattttctgtcctactcgaattcgatccatctatgagagctgaa

SEQ ID NO: 4513 - DNA, 2225 bp, Zea mays
  misc_feature (1)..(100): optimal_loci_6602_G1, chr1:33840038..33842262, Cluster 27
aaccatatgagtaatctgcttaatatggtctaagccagttgtgctgttgtgcaaagcgcaccatagaaatgtatttagttgtatacaatagcatgctacatcatccattaacagggagtggtagacctactttttatttgtataggggtgccatagtaaaaatttagattggggattaattactaaattagtaaaaaatgaagatgggattactatggattgaggattgctcgaggagtgaggagacggagcacgccgtgagcaggacgccgattgccacaaagaagagggcggaggcggcacaaatgtagtcgtcgccggcgtaggacaccacaaatcacgcgttcgtggcgaccctcttcatgaggacgtccacgatgaaggcaacatagtgacatacacgcagctgcagctggcacaacatccctaggatgctgagttcatctaggttgtgaaactcggcctggtagcgaagcttacgaagctgacgaacctcaagcggcgatacacaagaacttaaccatcgcctccccacgggtagctccacactttcgggcctatgagatcacgacacaaaagttggatgtgcagctccgtgcgtgggacgtagaagcgggcatgcacgcaccaccggaggagacaaagggatatcgaggtctttgatggactggcttagggtgtgtcatggcctaactagacccctgtaggcccaccttaatagaaattatgataagtaaatgtaagtagcataattttatttcaaatcctctgatttcccaatggcatcccggtgcaaaacatagtgaaaaaacattaagtggtagtatgtatatatgtacacataatataatgatgaataaatagtgtataggatatataatatttattttgaaagtattattcttttagtgttatttaaaataagatcttcagtgttttttttgtatgaaaccttatcccggattttacaaattgggaggcacggtgcaaaacatagtgaaaaaacattaagtggtagtatgtatatatgtacacataataatataacgatgaataaatattgtataagatatataatctttattttgaataagtctttcaaatttttaatctaatgattgtaatgcactacacgtaaataagaaatcaattttttttttgataatgttaatattgtttaaatcttcttataagtaaagaaatagcttgattagaaatgagaagaacagatcgatttctacatccgcacgatcctaggccatgttttaacgttttaactaatattttatgcaaaatagtttttttttaatttgtattacatatattgctataaattttggggccctaggattttggggtcgtatgcccgtacgaggctattactggtggcagtttgaagacccacagcatcgcatgcttctcctgccttgccaatactgcggcaaggtagcatggcgctggaaggggctctgctagctccgaccgacgggcggcaccgcttggatcggcccgagcgcgtccgcatgcgttgcgtgtatttgggggttacgtttacgcactgcttcaatctggtttcgagatgacgcgtctccgaggacgaactgctgtgatggataaagcctggctggcatgcgatgtcccccgagtttggacttgggctattcggtgacctgttttcatgacaaggaggctggtgggatgcagagctactacactccaggtgtatcaactgctgcgatgtgtggtcgtcgctagttttggttgcagttgcaggtgactgaagaagcaacgccgcacaggcacagccatcgagcatcgacatagcgcatgcatgcatgcatgcatccatcggtgccgaccgtatattcggcggcatatgtgcgcgcgcgccgctcgcttcgcttggcctggcggctggcccgcatgatgaactccattttttttctttctccttaacaaaacaaaaggaaaaattctcttgcgcgtgttctggacaagagaaatacgaaatatccatcggagcctcctgcctagtgtgcagctttgcatcgaactttcgagtgcgctccggtcctgttgacggattctgatctcgttcacaccgctttgacaaggctccaaagatgcatatgacgcgatcgaggaatgacgaacgaagaaggctcacgcaggcctagctgcaaccacctgtgtagtatagtacgctgtacgcagcaagctgcatc

SEQ ID NO: 4514 - DNA, 1430 bp, Zea mays
  misc_feature (1)..(100): optimal_loci_6665_G1, chr1:34292664..34294093, Cluster 27
gaccactgtctcccccatcgacatctccaagtaggtgctttggtggtggtgccatacgttcaaaaggtcttccaatgttcccacttccttgaaaatatttgaaagtataagaggaacaacaaggcctggtccagagctagaaatacacctttccaaaaggattatggtcatttgaggttgatgccacaaaaacataatggaacaaggaacaccatggcctcactccaacaaaagcctcacaaagatggacaaagtggagaggacaaggacaacattgggcataaggtgcccaattggaagaccatagtggtcaagaatacaatggaaaaagtgagagagagggaagtgaactctgactgtaagatgatgatgatagaatatggtgtactcatcaacctcctcctatgggagacataatggaaaggttgcaagatgaatgttacccgagagcggtggtgggacctacctaagtatctctcataccttgtctaaccatttatcatttagaacacacgctcgtgggagatggtcaaggatggaatgatccaccttcacgcacggataagattgtagtgggcatctcatgcatgggaaagaggagaaagatgactaggaaaagaagagactaggtcactacatgttcacatgaaaagagtaaggcatcgtgtagagccatattttaagactccccctctctctacccactaggcatagtaaccaagcattgcataacctgcataaaaaggtgagccatgcaacataatgggagtatgggagtaaccacccaaccacttaggtgattacattgagaatcacatcatacgagataaaatacatgtatcatatgaccttgggtcccgagatttttcttaggaatcgcaagagtgttcctaattatctcctcattcagaaaacatagataaataagtttcctctgacataatgatgagcctcttggtccaagagttgttatctactgccaaagggaacaaaccaagatgtctctaaaaccaatgcttcgacttctaggttggagttcataatgactgacagttgtcactccatggtgcaatcataaggatcaaatacgaaacccaaaagataagctaaatcatactattagtctactctgccatgatggtcgcttctcccaaactagtttaatcctcctcttacatttggtagcccctagggctcagctaccataatgtccaatggctcctcagtgtaacctaagaccgagcattcttaggatttgttccataaggcaaataattgaaaaattggggttcgcttgcagtaacactcaaactgttgccctaagtgactctatcagcgccgagtgaaggccatacccttggctgccaccaatacacatgtaaggatctcggatagggtgaatcactttgaaaaccaccataatgggacca

SEQ ID NO: 4515 - DNA, 1551 bp, Zea mays
  misc_feature (1)..(100): optimal_loci_6908_G1, chr1:35595791..35597341, Cluster 27
gatttctataaatttactttattttttactataataagtatattattatcgtatattaagagtagtaattcacaaatatgtatatgtacatgccgtttacttactatacgttttctagattaaattgaatataaaactgactaaattcctgatagtgtcacatatcatacgctgcaccgttgctagtgtggcgaactgtggtacgactccggcctcgtcttgtctgcctcatcctagcttccgttccgtctggggtctgaacttggccgaagtaaacgacctcggagtaaaaaggacggcgagttgttattagggcggtggaaaatggtggccgcgacgtacgagagcaggacacaccgcaaagcactcgtgccgcgtcaggtcaggtcaggtcagaggaggaaaaaaaaaagaaagtggcatgtgaattgtggcacgcccacatggccggagtctgcagaaagtggaaggacacgaaagaattgtagcagaagaaggtgaaaatgaccacaggaccggagtgcgacttcgtgccttcattctctgtgcctaggcaattacttgccgtataatattatatgtgtatgttgacgtggatttggctatccaggccactgcgcttttgggatgcttcttttgtatcgaaggctctctcttcttttacacacgtaaataaaacggggtaacagctctcttaacgctgacatttcgaacgaaatttgtgaaaatcggtaattccggcggtggccaaaatatttctaaaaccgaaattaaaaacccccggtcacaaacacataaatataccagctttgaaaaaaaaaagagtagacggtttctgatttagttaaacagaaaaaatagacatctaactttgggctggagaggactcaaatcaagatagttagatggacagctcgtacttattatctttcccgtcggcacttgtgtctcttttcatggcaatcctgtgatgcaactgctactctcaccaaggtagtacttgaatttcaagaggccgcatattatcataaaccaaacacgccagcacacacctggttcgctgattgagaatacaggtgtcagtgtgctacgataattgattgcactaggagaaattgaacgctctgactttctgatctcttatctgactatacatacactcgctcgatctcactactcactagtcaaaagcatgcctcgtagtgatcacggatcagtggctactggctaatgcctatgtatctatcccgtccatcacgttgacctgtccgaaactagctgcgatggtgactaaagacatgtctgcacgtctctcgattgttaaatttaatataggcacattttatattttatttaaataaattaaataattttagacacatgttaaaggcttcggacgccttaagggccttcagcgttcgggtcattaggctgtcttcagcaggttatctatcgtatctcatatattatcttctattttaaactttattatatgaatatattgcaaaacagtgttttgcacacccaaaaacagaatctactacagtggcg

SEQ ID NO: 4516 - DNA, 1524 bp, Zea mays
  misc_feature (1)..(100): optimal_loci_79826_G1, chr2:170207958..170209481, Cluster 27
agcggccatgagcctcagctagcgggcgtgatagtggccaagctcatgacatccatggaaccacatgcattgagaggtcacaatgaggaggaaaagggggaataaagaaataaaacgttaattttgtgtcatgagttgtaatggtgggtaatttttcctagctccgccaactcaagtttggacgatcaccacttgagatgctccaccgatttggttaatctggtgctagatccatggatttggtggagcagatccaccaatggagttagtggagttacatatgttgggtaaattttttaatccaaatctagtttagatgaatctagagctagcagagttgtccgaagtaggcccttagagcccccaaatccttcgacccctctaaccctcattcttgcgggctctagagggagtttatgctcaaccatttctagcattggtcccatgtgtcactttagattcaccccttgtatcgctcctcaatgcccatcctaggcccaataattcctcccaacaacacccgacgcgacttcctccccaaacactgctcccaagctttgcggttccacaatagtttaatcccaatcaatgtcccatcatgcctctccatcattcctgctagatctggcctcctccattctaggcaagtcctactcatcgatgcccctttttcctattctaatggctactctcaatgtggctttcttgccttcctatgtaatggcttctattgtgcatgatctcttcctccttatggctggcgacacgacttatctcgatgccttaagaagactcttctagtgtggcttctatatatgcatgttttccctatcccatgtgttcataccttagtcgatagagcttggggaaagaaatttgagaatgaaaaatgtatcttgcatctcattcttagttgaaatggatttgagggttacttcttgagcagaagtaaaaaagattgagctctaaaatacaaggagcctctaaatacaaaacaatggcacaaatttgagggttcctactagagtttaacttaggaggggataaatacctagactattggttgagatagttaagtagagaaaaaggtttgttatagcaattcccctcatgctccactctgcctcacgcctaacaaacacacccttgatgtcgaggtttcaatccctagagagtgacctcccactcctacttcctaagtcacttaagtaataagatcattcatatcgatctgttaccaccaatgactaattttattcagacgttgacatgtcgtgtcaagtcgatacaatacaatacatgacgtgtatatgctcgacgatgtaaaatgttgtcgtttttaacatacaataatagacggatgatggcatctgttaccaccattgactaattttattcagacgtttcaagtaatggtggaactcatttgtggattgattcgtttgttcgaactgacgttggagcaccccgtctatttatgaaatacattagcctccctccccaagtgacaccatacacaaattc

SEQ ID NO: 4517 - DNA, 2032 bp, Zea mays
  misc_feature (1)..(100): optimal_loci_83671_G1, chr2:191011811..191013842, Cluster 27
cgggtatcccggcgtccggatcggcgtcaccacgtgagaacggcgggggtggccgactggccgggcccgggttgggttaagaggattttgttattctgaaatcggcggcagtcatccagacacgtcacatggctgtggcatccatatacgaaaatatctaattatgatattcgtataagttaaagtagtttagatttggttaaatttatagtgaataggttaacatttggatttccgactagatttatggtgaaaaaaatatatttatttatggaggctcaagtgcccaaataaaatgacgcatttcctacggaggtttgttttcacagaatttgagctccgtcctaaatacagaggaggaggaaatgatcttgagctatctgaatgtcgtgggcagaaaggaatagcactgaatctgcagctcagggctatgtgatcagggatggtggtggcgtgctatatgtcatcttgtgcatccatccaatttgaagcttcatcctagaaacggacgctctcttgatcaaacgagcgcactcctcacaaggcttagcgtacgtatggcaattgttttgggtttttttttcttttttactcgtacaaaatgtatacagagttgttcatgatgggttgccaactcaccttggatacgagtgtgtaaaaggatctgagttctcgttgtgctcacttgcggaatacattagtgtaactgttcctgatgatctatcagcacatacacagtggagtatttctgagtcgtgagcggtgccggtggcagccctgacgatgactaattccgcaagcaggtcttttgtttttttttttctttcaggcgacaagcaagaggtcaagaagaattgcgaatgtggcaagctcagctctgtttacttgtcgctacattttgacaatagtgttccgaagtcgtaccttatgacgttttgtttgtcttttagggcaatgccatttatctttcttaactcatggttagaaacagataatttcaatatacaaatattatctgcctaccacatctcttcattttttttatgtagacatggttttctaccaagaaactattctctcgtccttatttatacactagtttgggctctatcatttcaaatagtcatgttaatcttgccctgaaccattatttaaccttgatatgaagttgtataaaaaatgtatattagcatctacaagtctaaataaatatatcatctaaatatatttcatgaagaagtcaatgtgactactttggtgttatatatcatctacgactaaattaaacaaaaatgatttaagacaaaaaaaacacacaaatgaagttagtagcattaaatctcgctcgctatgtttctatctgcgtggccgagtctaacgttttactccctatggtctcaagtaaatcaacttgtagtcttaagaattatacaccttgtgtttgatatgatcttgtgaaatcttatttgatgaaacattatatcaaaataaaattggttttgtaaagtgattaatatgatatggaatgttgtgcatatgtgctaatatatggttttgatattaatgtaacatactcataagattgatgttgtatggattgatcttgattcaagctgtggacttgcgttcatattcattgcatggttttgcgaaagtgtaggtggtgcttgaatcaaaacatggtcgatgtcgactgaaactaggttttcggactaagtttatgatggaactaatattttataggttgaagatgccgtgtggaacatttttcattaaacaccgacatatatgaagattagttgtgttgaagtcttgcatgaaatagtttaaagaaaaaaaggggaaaacaaaaaatcgataaaaggggggaaaaagagccagctcccagctagcagctagttggccacggtggcccagccgactagcgctggcctaggcggggcgcgggccatgcggctggttagacggcccacccggcagcccgcaggcagcacggcctggctgtctggctgttgattcatatatacaagtg

SEQ ID NO: 4518 - DNA, 2721 bp, Zea mays
  misc_feature (1)..(100): optimal_loci_89054_G1, chr2:222316888..222319608, Cluster 27
tctatgtatgaaatcgcgacggacttattctttagcttacaaatttgtataccatctacattcttagtttttctctttctacacggcagacacacgtttcttgatcaaacatttagttcaggctttagtttaaattatggtggttcttgatcatagttttaaatatcgcgctaaagtttactatagttttttcatagggtctaccactatgttgttgataattgtttcgctattctctttagtgatattttacctttgctaaacactgctatttgatttagccaaaactaatcgaggtagacatgcattatttattctattttactataacatatgccttacctattaataaataatgtaataaattacaataaacattaaactgttgaatatggaatgttgatagtatcaccgagtacgattgatatgattgttaagtaatgcacatggaaatatattcccctatatcttatatatgtacttaagtatttgtgttcataaatcatgtattattaaaaatttcatgcacaattgataaagaattttcacactttctatacaaccactaaatacatagctttgattatagcccgctatagcttttggagaagatcactgctaaatatgagagcctgctaattaaaacattgctcttgaaacaacccttgtgtcgtgaagtcatgaccatagattatacataagtttttatgttatcagttggtaggattttcctcaatatattaagttcaaactcttatgcatatcatactttttatttaaggctatcacatctagattttattggtcataaactacaatgttaataattacaatggtataaaaaataattgagtgagcaccatgtctctcaagtttgtactagagtttgaagtgaattataggaaggaccaatgataatgcactaaccttaagaatgttttaatgtttaagcctaaaaatattgtctagtgccaaaaaatggaaaccaaggtgccattaacctccttcacttttgaacatacaagttttttgatgtaaaacgctttaagtgcagtagtatttcctataataataaagtggccacagattatactatcaacaaagatatgccataatttcttctacaaaaaaaatgtaatttatacacctaaattaaaaaaaacttacccaaattatggtcatgtatattaacacaacattaaataaagtaatagcataattaatttgtatatgcatgtgtcacttaggaagatttttcatatatgattacgaaagcatacaaacatacttttacagctcacgcacgcatgcataaaaatatacttaatttatgcatactaatttatacaagtgggtactttagaaactcatacatgcgtaatttatggttatttatttttttctatatcatcatatgttctaaatttagttgcagacttgagggaataatatagtttattggttaataatgaaaaaatatataatttagatgaaaattctagtgattattaaaataatctatcataatggcagaactggcaatttatatggaaattaaggggttactttggattatgctttagaatggtagaactgaatatgtaattttgatgcaaattttaggcttactttatattgtttctcataattaaaaacatgggtaatatcttagaaaatatattatatccaattggatattattatcagcagtgacgatgggagtctatcctactgatattcctaggaattcctaacttttatcttttctctaatgtgtcctatgagtattatttttggagggtccgtttagatatgaaattagaaatactaagatatataaatgaaaggacaaacaacaaaaaacgcctccctagtggcacagaaaaaaaaaacatatgtgcatgccatctttaatcttcctcgatgcacattattccatcaatctgaatagttactgaatgtatcagcacggaacatgacaatgtcttctatatcttctaaatacgcaaacaaggaaaaatatagccttgaataacagtttccttaggggctaatcatcatggacacgctatagaagcggatgctcgaaaaaaggattcctttcgggggtaaacaaaagagaagaaaacaaataaaagttatacgctgaatctacaaagttcctgtgacttctgaagtataactcaagcaagcacattacagcctagctgtagggcacaagctttggccagaattttgctcttgtcttgatggctttgcaaaccatagagccgacagggtttatatatgagtagtggaataagagtaaatttggcatctaggattagtttggtgctgaatacacattagctcagtcttaccaatgatagtacatcgtctatattgacgagtttacttgtgtttagtgcacgccaaacaaaaagataacttactttttaggggcatttatgattataaccctcactagtcttgaaattgtgattttatcccttgttttttcaactttatacttttacccttcgttttaaaaacgaagcgccgtcataccattgcagttaactgtgttaaatctgacgcgaaaagacaaaaacgtctatgtaatttattgtgattttacccctggttatactatgtactagtcagatgcacatatattgctacgatatcatacaagtagaatttgtttaataaaacacaaaaattatgtattctgttagttag

SEQ ID NO: 4519 - DNA, 1583 bp, Zea mays
  misc_feature (1)..(100): optimal_loci_92643_G1, chr3:2894257..2895839, Cluster 27
tccccaaaaaagaatcaaccccaacctaatatcccgactaggtggaacctaaccaaactcaaccttggtaagccctaactgactccccaaccaaagacgagcctagcaagattggaccaaactatgataggccccaccaaattccccccaatcggagtcgtcccaaccaagagaaatatgttcatgacccaaattgccaattaggtcagatgtgaccccaaaaacatcagaaatagtcatttcggtcgctctgtctcgacctcgagtatgtctagacaagttagttcagacaatacatccctgatagaactcaacaaccccagagaagtgtaagatcgaaggaaggggtggtgcatttataactctctaaccactcggtgcatgcctctaaccgagacggacaacacctggaaaatagctaggtaccatgcagataactccagactcactcctatctgattgcctcgaaaatacaagggaagggaagacaggctataacgagatgtataaggcaaaagatctagaggaaatcgttcgtacgctcctcaacatactctgtagggccttggacatcttcagaactcaaccacccacatgcccaagtttactcaaagatggtgaagcaaacatatttatcatggcacaccttaggaaggtatcggtaggacaagcacccaaaggttgggttgacacatcccatctaaagcgtacatgtcataacaagcctctcactcctctgatatataaaaaggatccatttgttttgctcgcctctattcttctcaaactctagtttagtggtatgtacatgtactttaattttattagaaaacaaagcaaatgtcgattattttcttttagctaggagtaaagctgacttatgtaagataaaatgtaaaagttttcttaatccaaccgaagcatgacactagtcagggatggaatggagcacaacactagaacatatacatttcacaacattagtcaacgtggtgaccatcacgatgaagaccataccaaattgatctagctttagaataataatcctatgtataaaaatataaacttaattatgaattacgttggaaatcatggcacaatttggcaggttagtatgttgcttataaaaaaactacaaaaaatatcaaatgcatatatgattatcacaaagtcaattgtctatagaagaaattaaatttataattaggtcacaagaaaaagttatttggttttttcttaaaaaacacaagtctacatgattccaaatatgtgcatatatttcaggtatatatatacacacacacactatattgtaagagtgaaaaatctcaaaaggttttcgaattcgaagttactctaccaatatatacacacacaatgcaattagctactaaatttataattaggtcacaagaaaaatctcaaaaggtttttgaacatatatatgtaccaccatgttaacaccatgtcgcataaaaaccattgcaccctaagttaaagcccagtattattgaaaagtgtgcttgtgatagttatattaggggttaaaagtgaacgatttcgtagttgaacgtcatcacaat

SEQ ID NO: 4520 - DNA, 1731 bp, Zea mays
  misc_feature (1)..(100): optimal_loci_94574_G1, chr3:12612679..12614409, Cluster 27
agctactgacgctagatcctaggaaagaatcctgaaaagctaggctacactattaatatgatttgggaggagagctagtttctgtcgttgagcgtggactcgagggggtttcacggctcctcgctctcgagcgtttgttggtcaaggttgtttagtgtttgcagtctttggtgagtttcttttctttatcttcgtctgtctatctatgtaatagggttgtgtggtgttatttgggctctatagtcttttttttttcttagagtgaaatatactctctgttcttaaatttttttggctgtgtcaattcagttctacataaacttttaaagtatgtattttaaagactcgatatctgtccgagtctctattacatctaatggattgctatggtccacatatcaaccgttgaggaaggaggaagaaggtttaacaaaccacgacaactaatatatgggtccacaacaatctattagaatataatagagagccgaacagaaattgtgttcttaaaagacatgcttaaaaaaattatggactggattaatataactaaacaggtttaagggccgaaattgtatttaattttttaaatataatgatacacaaatatccagtgtattcaagaaaagaaaagaaaagtacaggaagatggtttgaagtggtgtgtaaactttagctatctcgaaaaccaattagaccagaagtgagctaaagtggtttacagtttttatttctagctatagccaaacgataatttgccctcacacgtcatcttcttttgcaggagaccggtacaaaaccccccgtcggcgaacatcatcaccttcgtctcagtgtcaaatcgccaaccaccgttgtgcacccatctcgtgccacctctctctcgcctctcccctcgtccccgttgcgagcaccatatacgccatacaccacaagtagtgtggcctcgttcatacatccgccactttccacctctatgcaacggtgtctatgtgatatacatcatgcgcaccgacgtttggggattaagcaaaaaaagttctttttgttaaattaggattaaactaccaatgaaacagacctatggtataaagtttaggacatgtttatatcccatgtgttaaactttagcaacatggatctaaacagacccatattctttaacttaccgaactaaattttactaattttagatcgtagaatccaaacggacccttgaggactatatgttctttttttttcctgatcatagggcgtatcattgtctgattattgatgctttttcatgattgaatggtccttttctcgccgtcttttccccacataccatcatatacatatacaaatgatatatagcacgcgcagctgcacatacaataatctctaaaattatacacccgggaaaagcatcacaaacttttcgaaaggcatgcgaggagtaaaaaaaaaaaaaccaaagcactaccaccttgataacataccatatacgtactcctaaacatggaaagaagaatcaacccaaatggcttgctttgtctgtcccctgtggcggttctctacacggttttcaaatatattacaagataacaacgtgtgcaaatgatggcctgcgcttgcaaagcagatatgctcctctttttttggtgtgtgtgcgtgttagcttgttttctctgctttattccggtattaggtagagatgcaagatgttgtgctcggtttcgtgagtccccc

SEQ ID NO: 4521 - DNA, 2178 bp, Zea mays
  misc_feature (1)..(100): optimal_loci_94688_G1, chr3:13086688..13088865, Cluster 27
ataatcataaaacatttttatagtgtatgaaacgtcaacatgcaatttatgatccaataaatttaaagccacaatcttagactaatttaaatttaaaccataccacttgcatggctaaccctaaaacttaaataaatagaataagacatgtccacatgaatggcacattaagccatgtccttaccatacaacatgatagcactatttttggaaacaaaaataaaaacctatcgactaggcactttggaataaggtcaatcctagtaataaccaaataacatcaatcacacaaaaactccaatcaagattatcaacatctatgttggagaacccactaagggttaatctcccttgaatgccaagtctaatgcatcaccccattagtagcctagagtagtttgccaatgtgcctcatacatggttatagtcggtggtcttagtaccacattaagtgtttaaagggggtgagggtcaacttataatccttattgctctaaatatagcacctttgtgttaaacccttttacaaaaaggtgaagacaaaagtgtaagagaggtgttgcatgtatatgggtctatttcatatgaggagttgagctgtaagaagattttggacacatggtgttagagatggtatcagaatatcaatcttcaatgcatgtgaatgtgttgtactcttaggttgatgtggaggggtaagaattatatatgtttaccaataggtggttctggcatttgcttcatatgtggtaagttgttgagtgcgtcaaccctaaaatggggtgaatgtaataccccaacccattagtaccttgtagtagttggcccacgtgtgcttatagttggtgggtttattgccacctcaaaagttctataaggtgaggtccaatttataaccttgtcacttcaaatgtatcatgtttgggttaacccttttacacgaagaaaggatgaatgcaacccattctacgtgaggagccgggctatttagcagattttgaatgtgggatgttacatcaaggatcaagcttcaaaactattgttgccatttttacacactatgaagattttaattcacaattgcatgcattcaggggtggaactagagggtagtctgggtagaccccgactatcctgtaatttggtctaaaacaaactgctactcagtgttaatcctaaagaaacaaatctatggaacctaatttaatgaattaaatgcatcatgagatattttgtttaatttctgctttgtattgaattgatggaaactaatatatgtggtaccgaataatatacaatattgcatgtcaatttttttgtcttctgatccgaggtttaaatcctaggtccgccactcgtacatttgaccctgtgaatatttttagaatatcataagtttttttctagaaagcaagtcagtactatagataaataaataagggaaacctttactatcttaattactatcctaactatgaacaagggtatgccacataagagcatgactatggtgacattaagggcattcatatgatacatgagttgtatagtgagctaggagagcaatgatatacgtacaactccaaaatagctttgtctagagttagaaagttaacaaggatgtaataactatatttgaagactatgaatatactacatcatggatgcaacataaaacttgtttggtttgaagaataggggtagaagaagacaaaccatgtgtgtatgaagatatccaaacattgtagaatacaaagattggacatggttgtcaccatatgctacctaccatggctatccatgggatgtgttgtctctcaattgaactctcaagtacctcactatgcaaaggatcccctcacactccaaatgggttgcttaaactattcaaatgggcaagagcgcaagcatggctagttggtggtgtattcatacccccaaccagccaagtaggcattaccgtaactctaggcaaaaatcttgactgtcagactgttcgaagcccaagcatcagaccaaatctcatggtctggcgagacacaacaaaaacatatacttcttatgttagaactagccattgagttactacaccgagtgtatggtttgtcacccactgtcgaaccaatctaacgctcgtaacctctctagttgcctaacataccatgttagaccgttact

SEQ ID NO: 4522 - DNA, 2457 bp, Zea mays
  misc_feature (1)..(100): optimal_loci_95651_G1, chr3:18637305..18639761, Cluster 27
taatatctgaacctaaccaataagcatataattcttcctcttgtggggaactttcccactgaaccattctcctcaattaattcataagctgcacttcacttgggaatataggttatgcgtaagccttctgacaatgcatgatgactgcatgcatgccctctaccacactcacaggtagatgagtaaagcagtattaagaaggacttggttgctaggctttccccgtagtgagacaaggctacatacatcttgatcttgtatagaagaagaaaagaaaatccggcccctacagtgtctatacaaacaactgtatatatctgctggtccaatccaaatttgattatcctcacatatataatcctctatctcttcctggacaattcacggttacaccaagctgtagctgggttcaatataatgcattattcttccgtctttcatcatagatcaaatagtaaaatttcggtcactcctttgtctaaattttggtacggatgcatgttacaacactgtatcaacctcggtaacattgcaaaagaaggatgtatatatatggcttgattggtactcagatctgcaggacatttgtcctgctactcgcaaaatctaggacttttgattattttatagagcctagctacactgcaaaaggaaaaggaagcgcaagcacttgtcattaagatagacctaaagatgcttaagcctcgcagctgctgaaagcatagctgctagaaaggcggttagggggaatcacagtaatggatgcgtacgttttaatgattgaatggctgcaattagttgttcccaggcccacatgcatcactaatctgcaaaagatcatcctgcaggtgctcgtacagtcacccggctgccctagcttccataatcaatcatgtgagtgttgcttgtaaagcccatttcgcaagccggcgtatttaagattggaggagaaaggcgcgagggcatctgccatctggggagaagaagccccagttcacggttcctctaatgatgcgtccataattgattaaagcgtaaagaaacgactatgccgattaacaatattatcaagcaaatgcttatgcgccatccagaaagcacgcaaatttgatatgtaaaatgctgctgagtgctagcagattgataaatatttgcaatatgtaattcaatttggccacaagcatgagatcatcaatcaagactaaaaagttttaagacgataatctttaattctaggtaccaatattattacggtacgtctactacgatgcgccgaaaaattgattgaagaatgggctaaattgcgaaaataatataaactattgttctgtttgggaggtgagttaagcaaccacagcatgggcaaaggaagatcgctcgcttaccaatatataaggacctcactggagctttcttgcacaacacctctcgcacgccgagagagagagaagagaagaggagagatagagagagagggagagagagaggcgacaacaatggctggatgaagcgtccaaagggatcgcattgatccatcattccttccattttttcatgcatggctggtcttcgtcgtctgcaaggacttgtcgatggatcaatgcgatccttttggaggcttcccctagacattactctatcttcctaccgcgcgcgcctgcttcatcggcagttgcatccatcaaattccggcccgtctctcgtatggctgttaatttccatgtgccagcatcacaaggtatgcggttaatttctcttgtctgctgtgcttagtgaagatgttggctcgctgacgatttcttgattgttctcgcttgtttcataacaagaatgactagaatttcccatgcacgtaattacatttattacatgctgatgatgatgatccgcgagactctctgaatacaatagacaagctgtggagattgccttcaccagccaccaggtagagatagctgttgtgtgtattctctgtcttcattcacagtaagagattgaaagaatttccaattcgaagcatcgattgctgtttaatttcatggtaaatgggaaaaaagaggtggtgacctttatgtcactgtacatgtggatgactccagtgttacaccatgtgactttttttaggcaaacctaactgttctggctatagatatattccatatacactgatgttacaaaatggaatatatagatcagagagaatcaggcatcttcagatactttcatggtaatctaagtaagttggatagtgtacattgcaaaccgaattactgatcagatttgcattttaattggtggagtgcgtgcatccaaagtatttcctactaacatgagtaattaacagcttaacatcttgcagctagcatgactaaggtagattcatgaacatactaatcttcaatccctcactaatgtgttatgcttatttacaatataatatactgtgcagaaaattta

SEQ ID NO: 4523 - DNA, 1776 bp, Zea mays
  misc_feature (1)..(100): optimal_loci_95864_G1, chr3:19841579..19843354, Cluster 27
aatctagtgcgcttgaaagaaaaggaatgcatcgagccatagaggccttcccatgttttacttcaaggatatgacttcacttgtatttcatcaaaccctaaatcattagtaggctagatgtcagaccgaaaaagcataactgatattgagaaactctcataaaactatatccattgttcatatgttacgaagaaacactagtcaagcctaaaaagttgcacatcactcattttatgtggcatacctaacttatctgataagccaacgctatggacttgtctgtaggcctttaatgtagggtccaacctctagggaaaactacccatggtgggctcaagcatatccttctatcttgtgttaggattacactgttgtatgaagtcccttgtttttcacgtgaggcttcgggtatcaaaggacttagggactggcatttctcgtgatgataggtcagaggccttagtgacctaggccctcgaggactactagagagccccgagcacctatatgcttcatagtgtcctagggcactagaggcctagagttagatcacaagctctttagggcacgaggggcccaagaacatagattattccaaccaatgacatttcgcgagaactagaggccttggaggccttagcggttccttgtgagaatttgtgtaattacttcttcagggtgctccgacatcaagttactcggtgcccgaggtggtctcgggacattagactctctccaacaattccccctatacatatcatattatttgtactttctaatatatattactacctcccctaacagattctcccctacatatagtttgtctccaataaatccctatacgctatataactcagttaagcaacacatatttatcatttttatttttatttaaaaatcatacaatgtttgtggtaccatagtacatattcttatcatgttacatggcttaattagaattaaaaacatattaattaacgtataggggaagtatagtgctcctctatttatacaggaatattcttgtgtcttcctatatatagcgagagtcattatagaccaaatgtccttaaagcctctcctatgctggttgaggctcctttaaggagggatgttggagtaagccttagaccctgacagcggtggtcccagcaagcgagccccacaataacttcctgtactggaattttgaatgcatcttaacggctaccggagatatagatttcccaagcgttgacaaatccaatttcattttaaatctattaagaattaacctagtttggtgtgtacaacttttgtaacttatagatagaagaactacataacattgttgcatttggactactctaggacttaccgtataaaagctttagtaatcgagggtcattttgtggtggctcagtccaaagctagcaagcagttctcagctagaacaacaacaacaatcaatcaaacaatagacaaggcataacaaggaaaataaatggagtgaagtacaccacatatccctagacaagaaatttagggacatatggtgtacttcacttagacttccttcaacagctcctaccgacctctccctcccctttccttgtagttgtttgggagggggatttttttgctgtaagggtacatgccaatctatcctctacgtgctacagcagtggcggataggactcggcaaaataaaccgaaacggaattaaccaaaaccaaaattgaattaacacttataaaatttgattccatgtttcagaaaaccaaaatagctaaa

SEQ ID NO: 4524 - DNA, 2267 bp, Zea mays
  misc_feature (1)..(100): optimal_loci_9687_G1, chr1:51404912..51407178, Cluster 27
gtccttttttaaccttagcctaaaattagctctcactagaattctaactcagccccaaagaaagtgaggagtgctacttagaccacataaccaactcagttagatatgtctttttactaacataataatatacatatatatgagtatatggccatccgtatgtaccgtgtaaaaaagtaattaccttatacattgcaaaatgctacacaatctctcccaagtcaccattatttatcagccgcagcttgaaacctgtggctattcgccctggggcaccgcaaccggcagaacggcagctcagccccacggtccaggcgttggaaaactccaccgcaccagccgtgaaaccaggacgcgacaccggtcaggtggtcaccgggtcagtcattcatgcatcccccccgccacgatgcacggcggcacggaatcacccgcccgggggtacgctccccatgcgcccgcgagagcgagatgtatggtagcgtacgtacgtggttttgagctctgttttggctccgatgtgtggaactaaaccgccgctggtcatcggtcccgtccgacgttgcacgtttaatttgccgatatggttcatttgaacgatggttttgttttacatacagacgatggctggcacgtacgacgacttgacgatgctctatacctatataggtacgccgtacgcggtacaggctgtagtaagaggtggaggccgtctatatgctgtgtgcacgatggcgaacacgttgttccttctgtacggtcacgtgcaaagtctgcgtgggactgtgaggaggaggaggagaaggaaaaaaaaacgcatcggttaatcattgtgcatggctatcagttaaatctcaccgtacctgcaatcattctccgtgcctaataagttctatagctaaattgtgttttctctccgtttttccggcacggtgcacatctttttgttggtacatgtggttaacgacaggcgggccaatgcaatacgtatggatatcaatggtgaaatttatttccccccctattcaatatatgtcttgcagttgtaaatcagaggcgccaaataaacagagtctccatcttaaatatcatattaaaaggtccgacgaattcggtcaattaaaaaatttaaagtctaaaagacactttaaacaactacacaagttctatcttgatatgcactaaacttttccaattatacataaatgttggttcaggtattttggtaacttgaaatttaggcataaaaaattgctaccaaccgcagtaaaaacgggtttacgccatgcatgaacaaaaacatggcaaataacaaacatttcgttgattcgacacgatgttcataggtccgaaccttttgctgcatgcaaaaattaaggaattgtgtcacgcatgtcctgtcttttgcacaaacctagctacctctctggctcttgctgcatcgacagggaggcagctcttgtccccaaagaaccctccagcggaggggcaacggagatagaataggacagagtaagccattactaaaaagtactcctacgtaccaccaagcaaagttttagcctttcgttcatctcaatcgcgacgcacgttttcgaatccaagtgttcggaacactcgatgatcgtgtgtcgtggcctcgtataaatcagacacgatcacgtcggctacgagtaaaataaggatggccgcacggctttctatccccgcccccaaataaactaactagtgcagcaggacgctagctaatggctgagtgggagacacataggttgagcgcgtgagtggaaaagcgagggcataagcgtgttaatgttcgatcaggggagcacttgcacatgcacttaggtgtgggtcagtatttgtaggcttcgaagggctcagggtacaaaagccaccagtatataaaataactcgcttcaggtagttcccgtcaggtacttttcttgttccaatcctggaggcggctggagttcattgtataagcttctagtttaattagtgtgctttttttccctgcctgaatacgctttacattaaggcgatcatatatatacatgctgaataaacaatactgtatgtgattttttttccttttagagaaaaatgtaaacttaattggattccacatgatggctacgaggtgcaaagaacctaaaccggagcgctataattatatatatatatatatacacacttagctaggtactctgcttgctttatggatgcttaaataaggtacgttgatagaaacaaaaagaaatgga

SEQ ID NO: 4525 - DNA, 1546 bp, Zea mays
  misc_feature (1)..(100): optimal_loci_9690_G1, chr1:51409760..51411305, Cluster 27
tcccttataccatgatgattacgaatgcaaggccagataataaacaacaatttttttttaaacgtgtggttggatgatgggccatgcatgctttggatgtgaagagcatctgatctgggtggttcttctctcaagcaaacgcgctggtgatgaacttgttgaggcgtgtaatgattggggattctgtagcgcaataatcttatcaacgttacctgggaaaaaaaagatgtcgttagtgtgggtttgccctactatatataccctgccgaaacaactagattaaaatagatcggagccataataatgtaaccatggcatagaaaaaggacatcaccaaatcgtatatatacacacatacatacatataaagttgctctgcgctcgtcgttgtcaagcttgcttgagacgatcgtcattctatccgcgtaactgaaaattattacggcctttcaagaaagttaccaactaccaaaaggggtcgatattttgcatcctcccacacatgcatatgcatgcatgcatggtagccgagatatcaaaaattttataggcgcgtcgatgtcagccaaagcccaaagctatgatccatgttgcagttttcaaaaaaaaaaatgatccatgttgcaacggtagtacaagtagttttcaccagaggccaccaacctagttgatctcctatcatgatgagcacctcatctacctagctagctcctgcatgcttgtcatcaatgtattctataatcagagcattaatagatgctagctaggcacgcacgctaatgctcgctccttaccaacttatttattagggctagctcgcagtgtgtgcagaggcaggctaatgcttgccacgccattgccgagtaccacttcatctatatgttagcttctcggtacgatctgtgtctaaagtattcgtgccaagtgcatgcatgcccaagtaggccgggagcagtagtgtgtgatgcatacatgcatgaccgcaaatggctactatggtccctactctcgcctcagacgattaagtagtgatcactgatgatgaagcaacaacactgctacgagtaattatatgcatgattagatgactgagtctctgagttctagaagcgcactgttctctcatggtgcgcgcgcgtgcagcaggcggacaacgatgacgatcgatcgaagccctgctcatcgaacgcgcgccggcggcggcggcggcttagcgtgtgaacgattgtttactcagcttttttgaacgtgtcaaagggcacatatattccgatgaggcactgccaagagtggagcgcatgatgggaaactgaagagggtccacttgacagccacgcacgcatgcatagaatacttatcagttttaatttgttggcggttctatatatgtagcttcttcacatattttttatataaaaatattttttttcttttcttagtttattttacagcgaagaagtctctcatcatgaactaaaaaaactgaatttgggacaaactcatttagtggcggaggacaaccaaaaaataaggtatggcttggtac

SEQ ID NO: 4526 - DNA, 1434 bp, Zea mays
  misc_feature (1)..(100): optimal_loci_97656_G1, chr3:29641768..29643201, Cluster 27
gcatacacacttatacatacttatagatacacaaattgacaataaacttgacatgagtcttgtgagttcacgtacttcggatactggagggtgctacctgaaataagttcaagtttggcaagttgccaccagaattcccaaacaaaatttagacttttgtattccatgtttgaattcgggtatccagttacatgtttttccaagccctattagtaggtatgaagcactcaattaattgggatttatttagtgtcccgtctattttctaggtccatgggttgatcgatctggtctatgtgttgttgcatcagctggagttagaattgtgcaaattatgcactatgttctactcaatataccatgtgcacaacccatgtttggaaaaaaggtacaaaagacaaactatatcaatttgtccaatatatgctatcaaaaataagaacattattgagaccatgttggtttcgtgcctcatttttagaatctcattattaaccaaacaactcatggattatgtattggatttcgtgctagaatctcacaatctctccatgcggtgataaaggaatttgtattggaatttgtgtagtatctaacttctcaaaatccatgggtaaccatacaccgcctaaatgtttcatagtcaatacaagattcagtatcataccagaacaagtcctttatatttccctcatcatcaaaaacattttacatgaacaattaggacccctctcatgccattccttcatatgacgaataactagttcaacatcacctcttcgaacttatgcaaacatctcccactcatctttttacctagtgcttcatccaaaatgaaaaaaagaagtggttctaatgtatttgtgttgatttattgcatctagtggcactagtgatgattgagctatggttttctcattactcttggtggtttctgccacctaaatggcttggagcggtagtggatcatcgagtggctattagttattgttgtagcttcgatcaagtgattgtaaggagctcttgtgcttgtccccttagaatatcataaagcacaactccggtgaaaccgtggctagatggagtgcacaatatgagtggttcttgcggtacccaaatgtttagcattgtcaagttagttaatgtgtgaaccatgaagtaggtgctcatcataatgactatgtaggttgccagtaatcaaccaaacctcagggatatattttgtgtcattgtttactctgtttgctttgcaactcactcttgtgttacattaatatctagttagtgtcgtagttgcttgtagtggtagctagctagagcttacagttgtagtcatagttataactagtttagttattagttttgtagctctagttgctcttgctcagtagttgttgttgtgtggtgcttgtcattagatttacagaataagtc

SEQ ID NO: 4527 - DNA, 1493 bp, Zea mays
  misc_feature (1)..(100): optimal_loci_98336_G1, chr3:33786120..33787612, Cluster 27
atttttaaatctctttagccttacccattacaacatctataaatggaccatactgagcatgccatcatcatcctcatctttgtccctataaccaatgtttcttcatgcttggtacaacatcccattgcagtaagtggaggtgaatcaatcataatgaagactattctatcttattcttgtagtctctgtaggaacaacacatgaaacccattcgcttgtgtccatgaccatcttgagaaaataataaacggctttaatatattcttttgagtttcaatccacattgtgtatcccttgaagatccatctagattattttataaaatatttttgatgctatcttttttaaacataattttaaaattttattttcatcatctttttcactattctattttctcctaaatcatattaccttcatacatattattataacacatatgagaggatgatctcactaaatttgaaaatttggagttaaaaacagaccatggaattcaaaagatctaggtaaaacaagaaaacattatataccatccttcataaagtgcatataactattttctatatcccctcaacaatctacacaataattctatttgtttgtataccctccttcataacgattgatttggatgtaaatacaatcacaaaattcctatttgttttccctaaattatattaccatcatacatattatagccagacaatataagctataatgaaatatcactatattatatatatctacttaaaaaggatattacattatatctatagaggtgcacatatgagaggatgaactcactaaatttaaaattttagatctaaaaacaaactataaaatttataagacatagataaataaaaatgtatacccttccttataaaacccatattgattatattttccaccttccctcaacaatgtacacaatatttctctagggattgatttggatctaaatagatcaaccacacaattcaagagatctaaacaaaccaagtaaccttttgaatcatgatacatgacaggatgaactcgctaaccttttttcacacttaaataagtgaaaacttcaacaaattcttaaaagcaattgggtggcactacccctccttgtagcttatggtagcataaatagagctactctctattcttggcaccagctcaaggagagagagtttataaagcaggtacattagtattcgttgatgtcttgtcattagtaccagttgaagatactagccaatactaattatattagtaccaattggtgtctttaaccagtactgatgacttgacattaatattaattagagacaccaacaggtaacaatttcctctacaaggaagtgtcagttaaaaaaccattactggcatttgcgttagtattgattctaaagtaactgatgttgtcggatggaagtccctttctccagcaaaactaggagcaccaacttaaaaactgtaaattaaaatcataatgggtc

SEQ ID NO: 4528 - DNA, 1399 bp, Zea mays
  misc_feature (1)..(100): optimal_loci_99247_G1, chr3:39233978..39235376, Cluster 27
gaaaactccaattgtaattttggtaattgaaataactagtagatcaatatttactctagtattctaaatgagctagatttaagtctgcatacatggatgagcaagattaataactataaaaataatgatgatggccacaaaggatggtcaagtgcttaacatagaaaaaaaggagaaaagcaagatgcaaggttcaaggaaaaggtatatgatcaagacacaatagagtgcataatcagacttaggatagatggtcgctgttaaaaggggattttaattagacaacataatcatcaagtgccacttaagtgatagaatcatatgtattgcatataagcctaaatgatactcatgagagaaattgaaaatagttattgaaaacactctcaaaaatacaaactatgatctaatatgcttgagaaacatttaagaatcaacacactttaagaaaattctcttcttgtacattttagagtgcaccagacatggcactggacacaaagtcaagttatatttaatgtacaattttcacccaaggacaatggtgtttggtgtgcaacgggcatggcataagtgacgtgtttggtgagacactagatggtccatcagacacttagagagcatgtcaaacacacacttcatcattgtaatataccatgcatacatggctgatgtggcactggataccacaccagacagggaactcatagagcaagtaaattacaaagtttcggtcgaacactcaccagatgtgtctcgtggtgtgtgtgatgagtgcaccagatacctaacatagttaacaactagtttgtacttgttggagatgtatcccttaggatagcacctgacatttctagtgtaggaacctacaatgcaccagaatgtctggtggctctaatttatttgtttcaagaggaaacaattaaatttatttgttagcttataaatagaaccattggctggccttagctgatatctctagacttcatacacttgtgaacacctcttgtagctagagaaatacatttcactcacttgaaacctatagtttatcatctgggtgagattggagcattcatagtgtattgcatgtagttgttgtatcttatggtactagttgggtgacttggtctagttacacttttattattcttagtgcttggcatacctagatggcctagagtttgtgggaccattgagtgattattggagattgttatcagatttgatcattatgatgggaacttgtgcttattccacacagaagattcacaaagagcaattattgtggaatcatgacttgcctctctagagtgattattatggtgtccttattgtgggtttggcatatgatgccaactagtgcgtaaatcacctagcttggactcgtcacaacgac

SEQ ID NO: 4529 - DNA, 3903 bp, Zea mays
  misc_feature (1)..(100): optimal_loci_232228_G1, chr6:144719567..144723469, Cluster 28
  modified_base (2818)..(2818): a, c, g, or t
  misc_feature (2818)..(2917): n is a, c, g, or t
  modified_base (2819)..(2819): a, c, g, or t
  modified_base (2820)..(2820): a, c, g, or t
  modified_base (2821)..(2821): a, c, g, or t
  modified_base (2822)..(2822): a, c, g, or t
  modified_base (2823)..(2823): a, c, g, or t
  modified_base (2824)..(2824): a, c, g, or t
  modified_base (2825)..(2825): a, c, g, or t
  modified_base (2826)..(2826): a, c, g, or t
  modified_base (2827)..(2827): a, c, g, or t
  modified_base (2828)..(2828): a, c, g, or t
  modified_base (2829)..(2829): a, c, g, or t
  modified_base (2830)..(2830): a, c, g, or t
  modified_base (2831)..(2831): a, c, g, or t
  modified_base (2832)..(2832): a, c, g, or t
  modified_base (2833)..(2833): a, c, g, or t
  modified_base (2834)..(2834): a, c, g, or t
  modified_base (2835)..(2835): a, c, g, or t
  modified_base (2836)..(2836): a, c, g, or t
  modified_base (2837)..(2837): a, c, g, or t
  modified_base (2838)..(2838): a, c, g, or t
  modified_base (2839)..(2839): a, c, g, or t
  modified_base (2840)..(2840): a, c, g, or t
  modified_base (2841)..(2841): a, c, g, or t
  modified_base (2842)..(2842): a, c, g, or t
  modified_base (2843)..(2843): a, c, g, or t
  modified_base (2844)..(2844): a, c, g, or t
  modified_base (2845)..(2845): a, c, g, or t
  modified_base (2846)..(2846): a, c, g, or t
  modified_base (2847)..(2847): a, c, g, or t
  modified_base (2848)..(2848): a, c, g, or t
  modified_base (2849)..(2849): a, c, g, or t
  modified_base (2850)..(2850): a, c, g, or t
  modified_base (2851)..(2851): a, c, g, or t
  modified_base (2852)..(2852): a, c, g, or t
  modified_base (2853)..(2853): a, c, g, or t
  modified_base (2854)..(2854): a, c, g, or t
  modified_base (2855)..(2855): a, c, g, or t
  modified_base (2856)..(2856): a, c, g, or t
  modified_base (2857)..(2857): a, c, g, or t
  modified_base (2858)..(2858): a, c, g, or t
  modified_base (2859)..(2859): a, c, g, or t
  modified_base (2860)..(2860): a, c, g, or t
  modified_base (2861)..(2861): a, c, g, or t
  modified_base (2862)..(2862): a, c, g, or t
  modified_base (2863)..(2863): a, c, g, or t
  modified_base (2864)..(2864): a, c, g, or t
  modified_base (2865)..(2865): a, c, g, or t
  modified_base (2866)..(2866): a, c, g, or t
  modified_base (2867)..(2867): a, c, g, or t
  modified_base (2868)..(2868): a, c, g, or t
  modified_base (2869)..(2869): a, c, g, or t
  modified_base (2870)..(2870): a, c, g, or t
  modified_base (2871)..(2871): a, c, g, or t
  modified_base (2872)..(2872): a, c, g, or t
  modified_base (2873)..(2873): a, c, g, or t
  modified_base (2874)..(2874): a, c, g, or t
  modified_base (2875)..(2875): a, c, g, or t
  modified_base (2876)..(2876): a, c, g, or t
  modified_base (2877)..(2877): a, c, g, or t
  modified_base (2878)..(2878): a, c, g, or t
  modified_base (2879)..(2879): a, c, g, or t
  modified_base (2880)..(2880): a, c, g, or t
  modified_base (2881)..(2881): a, c, g, or t
  modified_base (2882)..(2882): a, c, g, or t
  modified_base (2883)..(2883): a, c, g, or t
  modified_base (2884)..(2884): a, c, g, or t
  modified_base (2885)..(2885): a, c, g, or t
  modified_base (2886)..(2886): a, c, g, or t
  modified_base (2887)..(2887): a, c, g, or t
  modified_base (2888)..(2888): a, c, g, or t
  modified_base (2889)..(2889): a, c, g, or t
  modified_base (2890)..(2890): a, c, g, or t
  modified_base (2891)..(2891): a, c, g, or t
  modified_base (2892)..(2892): a, c, g, or t
  modified_base (2893)..(2893): a, c, g, or t
  modified_base (2894)..(2894): a, c, g, or t
  modified_base (2895)..(2895): a, c, g, or t
  modified_base (2896)..(2896): a, c, g, or t
  modified_base (2897)..(2897): a, c, g, or t
  modified_base (2898)..(2898): a, c, g, or t
  modified_base (2899)..(2899): a, c, g, or t
  modified_base (2900)..(2900): a, c, g, or t
  modified_base (2901)..(2901): a, c, g, or t
  modified_base (2902)..(2902): a, c, g, or t
  modified_base (2903)..(2903): a, c, g, or t
  modified_base (2904)..(2904): a, c, g, or t
  modified_base (2905)..(2905): a, c, g, or t
  modified_base (2906)..(2906): a, c, g, or t
  modified_base (2907)..(2907): a, c, g, or t
  modified_base (2908)..(2908): a, c, g, or t
  modified_base (2909)..(2909): a, c, g, or t
  modified_base (2910)..(2910): a, c, g, or t
  modified_base (2911)..(2911): a, c, g, or t
  modified_base (2912)..(2912): a, c, g, or t
  modified_base (2913)..(2913): a, c, g, or t
  modified_base (2914)..(2914): a, c, g, or t
  modified_base (2915)..(2915): a, c, g, or t
  modified_base (2916)..(2916): a, c, g, or t
  modified_base (2917)..(2917): a, c, g, or t
ccgtgtgtcagcatcacgtgcgcggcgagaggaaggatgacgatggcttggttgctcgtagttgtagagagatagaatgaaagcttctttcagttctttgtatatgtaaattcttgctaataattttttgttttaaatatacatatatattaacgttttcgtggatggttattgttgtagtacttaacatgagaatgagtgcatggccggaatgggatggcatgatgaaccatttcaatttagtatcagccttcggtgggaagcaaaccataagcgcgcgtacacataccacaccacaccggcatgagtgcaaggcattaacgactcgcaatggatgtcctgtcgaagcgagagggacggggtgggtggcctgggtccggcattatccctttgccgagctcgagcagatcaggcgaaaaaaaatcggatgaggctgctccggcgcggagtcggccaccgaagcgagtgcaggcgcaggcagccagccgtcgtggatcccgcgatccgggccccgggatctccgctgcccacatggcccggtggccgccagggtggtggccgcacggagaggcgtccggatcgggcaccgcggctgccgctgggaggacgtgggacccacctctggacatcaggacgtcaggcgcatgttctcgtaggccacgcgctgacacgatcaactgttgcggaacaaaaatggcgctgtgtcacgtccatcatccatgccgtcagtataagcaagtactactaatcgagcgcgatgcacgctgattggcgaccgaggtggtgctaattattggtgcctgtactacctaaatggctactgcatggaacggaatcaccggaggcaggcaggcaggcagcgatgacgagtcttaggccagagtcgctgcgggcacctgtcgcctcacgggcgcctggttgccgtcacgggctgtgcctgctcggcttcggcttcggcttcggctccgcctgccgccccgcgcgcgctcggatcggttggtttggctgctcctatccggaacgggatggattccgataggtggatgagtaaaactaactggagcgagccgggaccggcaggcagaggcgccgcgcgctccacgtcgaccaaccagctcctccagtcccactagccggggacggggaggacagcatccgatgtggccacacccgcttcaccagccggccggtgaccacttcgaccagcgagcgagccgttgtgtggctgctggttggacagccgacgcgcgcgccgggggggccccgcttgttgtatacggcatccatccgctgccgctgcggcgggcgggcgggcgggtgccgacgaggtacaagtagcaggacaggagtgcaggatggctgcgcggctacctgaccgtgacccgcgacggggacgggggggaccccgtcgccgtcggcacagcgtcagggcggtaacatgcgttccgttgcgcgtacggaccaccggtgtcgtctaacaggaagagctgtcagtgacaggtgcgtgccgccgagtgacggccgcgcaacccatccgcgcgctcctgctccggctagcctatccagtgcggttcgtggtgttcctctcagcgtgtctcgtcgtcggcccggtcggcagcggcagaatttcatttcagactgttgcctcgccgaggattgtgcagatttttttttgtgtgccggccgatggagagtttcccgtacaaaagttgtggatgcaggttacaccatatccagtgaatactcattcttagccttgtttacgtactacggttccaaagataggctaacttaatacttctgcatgaacaaccctcctcccacacaccatctcagctcactatccaaacttcaatacgttcagcaaatgaaaaacaaagtacaaacaaacgaagctaagaataaagatgttgggacgattaagttataatcatgcatttacggttttccacgtagacaggggtatatgatgaaaaagaacattaattatgccaaaactttagtggtactgaactagtataggtattgatccactgaatgattaaaaaaaaatcaacatccattgtgcctcacaaagagataggcaaaacttcacggcaaagtaatatgatccagggcaaatatgtatggcacattaaatgataactccaagtggatctttcatgttctttatcttcagtgctaataccacaagaatctggactacgggagcagaccaccagtttcattcatatattttttttatgaaaaaaaattatagtacgtatcaggggtgggtctgtgggtggggctacttgctgcactcaaaacgtcaagtagttgtctagatggcacatagcctatcaactatcaagttcattacaaaaattatatacaaatgcaacaggtcaatggaaggatcatatttaagctgggttcaggagcagtagtgaacaatacacacttttcagtccactagcctaacacttcagtgcagcagttgacctatacacaatagcaatgttttagttcaaatttacctgaaacacagcataccacttgaactcccagactccagattggtggtctaccacatgtcaactgagttgtgccagggttgacatataaagcagtacacaaaatgtttcagtcataaatgtggaaaaacacatcatgcaactactaggattttactaccagatagatagtggacacaaacatcaccgagatacttccctgaaaaggaaagaaattgcaacatcacggtacaagtaaaatgtgaaggacaacaacacgggcgtagaacatggagagacgtctgtgtcgagcaaagtgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatatagtcacactgcaaaagatatggacaagttcaagtgtcaactgatgttaaatggtaattaaacattcatattaataggagagcaatgttctacgatgtgggggtggggggggggtgctgagctagacagtcaaagaaagccctcgacaacctaaaagaactatgcggtttttggatgacaactagcatgactaggcagccatcctgcaatggagattgacgttgtttcctcaaaaaaaaaatgtaggccggtgttgcatgcatggaatttttttttgaactgccaaatgccccttctgcctaaaagtttaggctttaagcacaactggttaagctaattaggactactaaaatgtagacttaaacaattttatgcagtacctgacagatgcagcttcgtgctcagcagctagcgttagtaaagaagcatggatactctttaaatatagctatttatagcatctaccgtctaggtgagtaggcagacattgttcagcatttgagcccttggaattttctagtaaaatgtcatttttataagaattgcaaaaggttccacccatgcagccatgctgcactagttcgaaagagaaatggtgtgtgctttttttaaggaaacattttccagtagtcttctaaacaatccctcgaagctggtagccgaccagctacatgcccaatcccaaatttgttttttctaacaaaatttcaaaaatgtaactgaaaacaagatctagcagcaaatataactaaaaaacctgctaagcagtaacaataggactttaagctctggttgcagtataaatataatcaaaatgcggtggttatgtgatctgtagttcagattgcaaagattttcaagctaggaataacgccttgcatcatcagattcctttggttcaaacatatgataaacctgagataaaatttaaactattcttgttcttcccacatagcattctgggtaagccattaaacttc

SEQ ID NO: 4530 - DNA, 1440 bp, Zea mays
  misc_feature (1)..(100): optimal_loci_102780_G1, chr3:59321717..59323156, Cluster 28
tccggtagcagtgattgaataagacatcaaactggccgatcttagagaaaatatcgacagtgaatatcgaagtcatggatgcatgaattgactaaaactttagatgcgtgaatatttagcccactgcctctttgaatctgtttatagacatggggtttcactcatgtgtggtgccaatgcattattagagactaccttttctggtccaccgctacaaataatgaaatgaaatgcctattattagggccagccggccacggcacagccgggcagggagtaccgtgcagtcacgtgtaaaggagggtggtagaaataaaaatttgaggtcctgcttttaaggttctgaacaagtgtaatgtttgaagaggggacacttgtgaatattatgtgtatttatgtttgcgcgtgtggacacgagacagaaatctattttccaagtaatttttatttccaatattaaatagaaatggaaatgccgaatgcgtactatttctttaggattcatatatagatgcatgggttgttggaaaattagttaggtcgatcgtactttcgtaggaaaaatcaaagttctagaggctagctggacaagtctacgttgaaacgaaacctctgaccaggcaccgacaagccatgcaagccgacatccgaaaaaatgtgagctccaagttcacacattgtcacaagggctatgtagtaagaatggaaaaaaaattaagcgtaacaaaatcatttggctaataagaaaatatactcactccttcctacacaagcattcaaaaaaattaaggaatctctttgccttaagggcatgtgtataacctagctagagagctgcaggcataaaatacaactaaaaaactatatgatataacaaaatgtctttaaaattagtcacatcatacatataatttagaaaaatatgtttcgagagtcgtgtagagacggattcttaataaaaagactatctattgtatatttttttcatctaaccttctagataactctcaagatatggagtactaatgaggttataagtgacctaagtatgtgcagaaatatgataggtatattgtttatcttttgtatactttttaacctgtattaatattaggtaaaaatactaagtattcatacttaaataggcttcaagtttatcggtgtaacaaaaataacggagccgaaagcagcaacattatgtggagtagtaatcaattattaaattttattttttattttgctagagaacaataaaagcatgaatatatgctcacatatatacgcacacacaagagaacaaaccttggggtagaggttccacctgtagccatatgatgcttggtgaactgttttaattagtccaggcaatcacgattaactccttagactcgctcgaagacacggcttaacacatctactagtttcgtgcctgtgcgttgc

SEQ ID NO: 4531 - DNA, 1423 bp, Zea mays
  misc_feature (1)..(100): optimal_loci_10419_G1, chr1:55744952..55746374, Cluster 28
ccacaagtaaacccatgcaactgaaagaaatcacgtggttttactccatctattatgataacagaccaataataaatttgtactagaaagacagaatcatctgtcaaaggctcaaaaccacataggaaaaggatgatgcaattaggatattatacaacattctggtcggtttaactgatatggagctgacagcagaaatgcattcaaactttaaaaaaatgcaagatcatcttcaacagtgagaactagatattttggtaatgtcggtcacaacttataaggatgagattattctcctacaagacccaacagagatatggcatcaaatatcaatagatctggtaaaagtagaatctggagaattttctagttgcatctgatgatacggtaattaaaatacctttctagctacatcttaaatatcacttcagaatgactactagtaggtaccagtagatcaaaacgatattttagaacaggccaggatggaagcagacatacatagcctatgccttactacagatgtgcaggagctggtgttacagtatatatcaaaaaaaagatggaaggctaagcaaaatcagggcactgtgttactgaaaacactagtacagactactcggtcaacagtctacacaaattaagtaaattgaggtaagtgtcagataagtaaattgtcatatgtaccatagtgcacagatactttacaaaagctcaacttttatcagctgccatatgactgctccaatggttcaatgggtgtagtttaacacaaaatcagccagcctgatagtgtttttgtccagccaaacctactctgaaccactcatccaaccctttttttctttcccttccttcatggcccccatggcccatatctagatgtttatgatgtgacactagatatacatgttttgcacaaaacacattgaatgcaacattgacgcagcaatttggatatgttggtattgtcagctacaggctactcttgttatttacaaaagcaaaataatgataaatgatcacattgtatgtcctatggccaaacatactaggcacaaaagtaatgataaatatgcttcagtttcacaaagacattcaataagaaggtactataaatgttttagttgggctggccaattaggctacacgcacaaccaaaacaactacagaagttactggtgaatcacccataattaaaaaaagacagcattatttgtaagtttacctgcaagaacagtgtaaataagcggctgaatgtcgagagcagtatcccagctgtatatgcaccatagagttcatgaactgtatgaactatcccatacttcccaaactgggccttgtctattatgccctttatgagctcattattgtgaatatataagaccagttcagaacgatctttttgtttttgtttttgtat

SEQ ID NO: 4532 - DNA, 1510 bp, Zea mays
  misc_feature (1)..(100): optimal_loci_114050_G1, chr3:136422551..136424060, Cluster 28
gcgctcacccttaagtgaatgtgcgcaacggcaaggggcccctcaggcgaatgcgcacattggagacagagaatagagtgaatgaagagggagagagttgtgcatggagagagaagaatgaattaaggttttctcctatcgataaaaaaatctagcttttgtacttagtatttttgcagctaagcgttgcatgagataggatgacttagatctattgggatactttcagccaaacatgtgtagacttttgtggcgtaggcctaggttgtggcctagggagcaggacaacatgagggaggaggttgttgggttggggcatgtgggccgactaggtcatttctggcaaaagaagagtgaaacatacaaatatttatatattaaacttgaacattgttttaagtccatgtttgttggaagattatgttagtgttatctgacatttaagtttaagtttacaactttagttaactttttttttgcaaataattattttattcttagttaaattgatattaatctatatatttaactcaataatattatgagatgttgatgtatagtaaaataaaaagttttattatgttctaattcttcccaaaggtgatttagatttagaataattttcagtattatgcatgcttaatttaagccaactctaaactatccatgtatatcgatttaagtttgtttatttattcgacatcaccatcttagatctcatatgccctaagtgtagtttctagacttgagccattaaatggctctaatttccctcttgaagggagaagattgacatggcattgacatttattcagatagactacaattgataattctagtttgtcagccctatgttggcaacagaaggaaaacctgagtcagataacaacacaaccatgataatggcatatgatctcgaacatgttaattgagagagatataatacaaagtgcatgatgatcataagaagctatattatagaatctatcaagggaggaatcccagaatgccagagtgctatagagtactttgacaaaatttagcaatattttcactggtccatctaaggcatgtgttggaaccataataaaaaagaattgttactgcgaagtatgatttcactagaataagagagaacatacttaagataaccaattttgctaataagctcaaatctttcgacatgaaaataaagaatgactttgttgtccttgtccacttgatattagtgtctatagtcaataaatttgacaacatgagtcccaaaaagtggatgatagagaagtttgattgccatgtatgccgagaaagagaacatgcttaagtccatgaatagtaataatggcaatctagttaaacagtcacatcataagaaagtatattctaacaagtcttttaagtctcagttcaagaactagggtaagaaacttatgtgtcattagggaggatcaggctcaaatggggggaacgacattttaaaatccacacaacaagaaagcaagttcaagtg

SEQ ID NO: 4533 - DNA, 1411 bp, Zea mays
  misc_feature (1)..(100): optimal_loci_115279_G1, chr3:144086857..144088267, Cluster 28
cttttttactttatttttctccaggtaccttgtcattataatggttgttctttgttttatgatatgatgtatttttctcatttaaaccattgcaatctttgagtttatgtttacctagtaactgtggtaacttcattaccactatccctattttatttttattattcatgctagactagatgtatggtttggcgtgcataatctatatactttaattatctgtgtttgcttttgtttgattgttacatgtgacttgaattagcctgcctacagtggctttgcttagaatttaatggttttgttgcaagtgacttcattttgaacttaaattcacactaggattagggctgagttacttgtgtgaagcattgtctaaatggtcagtaaagttcgtaaaagtgctgttagcatctagtatatattcataaattgcacggttaggaccacttcaactattattatgctactttatgttggcttctgatttcgatgtaattcagctctttagatgcacctcttttacatagctacattatatgtgaattagtactttgttttattgattcactaatgggatctaagttttttctgggctaatcaagacaattttctctcctgaactgtttcagaacaccgatgagaaattataaagagccaagctccttccaaattgaaagggattcgtcagcaggtcacaactttcaagaatcatcttctccaaagatgtcaaaatcgccatcacttcagaaaacacatggctttctcacattccgaacttcagatgccaatcataactcacatgaatcaccaaatattcaaagccccccttcagagcaaatggcagaagccaggctaccaatggttgcatctgagagagctccatccatcaaaaggcaggacagttttgaaatgaaattgcctgatcttcccaaaattgatgtcccgctgcatcgacagtcgtcaaatacatcagacccagaatctccaatatctccattgttgacttctgatccaaaaaatgagcgctcccactcaaaaactttcagccggcctcttgtcatctttgatagttttcatgctgaggattccaagcagcagcacacaaaagcaccatctttttggaggcttgcagagcttagttttgcggaatatttttatgctctgttaggaagtgctggggctgcttgtttcggttcatttaatcctcttcttgcttatacaatatctcttatagtagtggcctactacaaaataggggtccgtgatgtacatgccgaagtgaataagtactgctcattcattgttggcatgggtataattactgtactagccaacttcttgcagcacttctactttggtataatgggagagaaaatgaccgagcgtgtcagaaggatgatgttttctggta

SEQ ID NO: 4534 - DNA, 1426 bp, Zea mays
  misc_feature (1)..(100): optimal_loci_117595_G1, chr3:158436083..158437508, Cluster 28
catgcccaagtgggtggaaacaatcagcaagacaatggcattgctccatgagacctagagggctagggctagtgactacatttaaacacccccccccccccccccccccgtgaaaattcatcttgcacaacctgaagaggacctcatgcatcctgccatttttcaagccgtgaataatgctccgcattatgagccttcgcctgacttgaatgaaaatttagttattttggaagagggtagttttgatcatatctttgaagaggaaagcccccaaaatgatggcatggaggttgaaatggaccacaatattcctgataatattcctatgttggaaggttttctcccacatgaaattcagatggtagatctaatagaagatgactaggctcagctagataacaatcaaccttttgatcacgatgacaacttagaacttgatatgaaccaaggaaatattcaggtttctttatggttgtacatcagcataatgttttttcactatactggttctaaaaccattggtagatttttacaggttccttttatctaatcctgctaacttcttatgggctaagaaattgttctcaagcaaagttcgtgacttcctttatttgaatgggtagctatgtggttcgccctaatgtcgatcatgtattcatgtccatcagatgttttttagaatgtctagaagatcttcaatcaccttcgcatgctaagaagacatcaaaggtacctctagtcgcatttggtttatggagaagtgataggctaaaaatactctcggtggttttgaaggaaaatcatacaaaatgggtctagaactcctgcactacctatgctaaatcctaggatcattcagaatctgggacacgttttttgtaatctgtcagagtcctctttgacgaaggataatctttctcacaataatgattagtgttccaccaaacctatggcacggaggaagaaagaaaccaagaacaagtctctttcaaatgatcctaatggccaaagttccaagaagcacaagttcgggtaaattattcggtgattgatgctgcttgttggcccctttttgtgctttgggaccctttgaatattttgtaactaatgtatcttcttgtttggcgaaatacgataatactttctagaactactacatatgttgctctgaacgttgtggcagaaaatgccattggttccaactttatttttatattctattggatgttattaaattttttgggatgatgttggtcatcttcattttgtttactggtatcgttggtcagatgggatcttatcattagtatactttacaaatatgcctttctcttttttatggagatgtcactggttccctatttcatagttcttttgtgggcatataataaaaaaaacttcacgctcattttgaatataaatcact

SEQ ID NO: 4535 - DNA, 1667 bp, Zea mays
  misc_feature (1)..(100): optimal_loci_117967_G1, chr3:160521637..160523303, Cluster 28
ctgaggaaccgatcattaccgatcgtctattgacatgtgtggtcttttgattggttaatactattttctgattggtcaatattgttttgaagtctacaaattaaaaaaacaaaatttcaaaaaaaaaacattacaagaacatgaaacaatagtagattggaagacatgataaaaataatagtagacgtgtgtcttagtaatgatacggctgccaaaggtaactgataaaggacttctagggcaatagagagtgaatcctaacttcataaatatatgtctacgaagtccagacatcaagagcctaacatgtaaggatttctagaggttcaaaccactgtgtgcatatataatagtaatagcctatgtcctcttggtgatcctagatcactgtgcatagatggtatgcaagattataagccttaacccagaaagacataaggcctctttgaagaggagtgaaatgagacaagctaaactaactctcattattgctgttgtggttggattgtcttttaactcttttggcttggatttggtggatctttgtatgtaagtaaacgtgtttaatatattcgattgtgggttagaccccttaattggctatgtataccccatattttataataacaggagtgattttatttcattgaaagactaacatgatactattgttacgtcgttttattagaccaaagctaattattcgcctcttaaagttggcttgggtctaatttgaataccaacagtggcagcataaccatcacccctttccttgtcaaattacgaaccagctggtagataatttggagggaaaaaaaacaagaggggatcagttcgttaggtgacacgccgagaaagcgaagtttacaaatttcctcgccacgttctggcattctactgtctgtcctactaagcgaaacggtgacacagggcgaggattagaccttgacgctttggaaccacgtccacccacgacgctgacttgcatgttggcgagatgtgccgtgcgtgagattttttgggcatgctggggccacgggtttcttcagagagcaacgtcgccattatttctacgctcaaattggagtatcacaccccggccgattggcagaaacatgtggatttttcttcaaagctgagtatctgtaggatgtagctctaaaaagttagagatggatgtatatatcgtgtgcatttacataactttgtctatacatatagatattttaatttagtttacaagctacatacaccccataaataaagctacatatatcgctctcatgcgtgtcgcgtcctcataggaggtgctgactgctcaaggaatgatatatgcaggacgcacagtatacttacattcattgcaatctataggctatagctagtgactttctaaaaaacaagctaggcataaattatttatggtactgttcatatatctactgatataaagtaacagtttcttcattcatacgtctattcccctcctccacgcgaatgcagcgagtgtcgccagaggttcaaacgtgctcaacaaaatatcaaaaaaggtgccctattttgggatctaaattgtggtctctacgaacaaaacactaatctctaaccactacaactcatataggtttatgctatacaaagaaactatatatatatatatatatata

SEQ ID NO: 4536 - DNA, 2013 bp, Zea mays
  misc_feature (1)..(100): optimal_loci_121949_G1, chr3:184275101..184277113, Cluster 28
gattcataacatacataagcaacaattctattgctaaagttaatatatcacattcaagagaaaaaatctaacatgtcgatcatcgacacccatcacttgattgacatttgacaacaaaccaaggagaattgagataaaatactagacggcaaaagaattgtcgaaaaaaatggcagctggagcactggagcaggggatagggtaagaccaaatgactatagattacgtaagctgggacagcctttgtaatggcaatcattttaagggttatctcgagccatccgtcttgtcttatattctatcctttctaaattataaaatggtttagttttttttctaaattaatgttattataagagatagttctactctactctttctaaattataggacattttattttttttaaatacattgtatttaatgttacaagacattatatagtctgggaagttataataagaagatgatagatgttctagttataaggtagactaaaatctaatttaaatatttattatatttattttgaactcacagaatcacctcctatatatgtacgccaccgtaagaggatgttttttattcaacaaatatgcagacccgagtttaggttgtcggactatacttttacatggcaattagagtcatggcgagtttatcgtcatctggctctacaaatcctcacatcagcctacctgtttaactgtctccgagaagccgatgaaatccaatcatgcgtagaatagggctgctatctgcggcgcaaagttgcttggcttcgtgactggtggcaccaaggcgttgtcagaaaaggggttgaggtggacaatctaggaagctagagatcaataagtcccgggctatctcatctcattgctacgtcatccatagataaaacctaaataaagatttaaggtgcctttgtctcgcaaataaaagcaagaatactgttggccctggcaaaccatggagagttggagactaccaccttcgcataattattcttgtatcgagtgtcatggaatgcttgagtgcaataaaatggatgagggaaattgcaggacgccggttgtgagacaactgagtagaacatatcgtggagacgatatcggtccaaacacaaggccttgtgaccagactctactagccaagcctgttttgagaaagatgccttgttcgtgaattgtccttacagaattgttcatcgctttgctactgtaaacaagaagggacagggaaagatgcgcgcgttgcaagacctggtactgcagcaaacacaccggctaattacatactaccaacatcgcgtccaagctgctacctaatcatttggcaccacatttaccatggccagtgtcttagagctagagtgccttcatcaaagggcgtagcatcctagataattttcagtccatacagggagtagtgtgaaccactttcgcaagagcaaaacaccaatgttgttcataatattggacattattgccaaagcttttcagtccatacatgagcttggcttcagacaaagatggcatgatttggtttcgatcacctgggcaaaaacaacatatctggtgctgtaaaatggacaacctaggaaaccaatacaacaccgatggaggtctatgtcaaggtgatcctctgtcgctcatgcatgctattcatattggcaatggcaatggcaatggatcccctacagcagacagtgtacaaggcaacagagagaagagagaggactgctaactccaattggggccaatcctattcgcatgcggactaggctttatgctaatggcgcaacattgcatattcgaccttgtgcccatgatctgatgaacctacaacaaatattgcacacgtacttttggtgaaactaaaatgactgcaaacaaacgtattgcaatctgaaatgtatggcattaactgtaatgtcgatgggaaaaacattgctgattcattcagaagaaagactagtggatatacctcaacacagcgcagggacatacacaa

SEQ ID NO: 4537 - DNA, 1505 bp, Zea mays
  misc_feature (1)..(100): optimal_loci_125811_G1, chr3:204657622..204659126, Cluster 28
ggcctcactgcacgctcgtgttcatacttcatggacgtccacatcctatgctagctaggctaggctaggctagcctttgtgacgtatgccgtgaagtgtgatgaaggcggcaacttcatgcagcagggaaagctgtacgccgcgcctatcgatcgatcggccatatatacatacgcctgcggtacatctcacgtagcctcgcctagtcggttgtctgtctattcctcgcacgcacgcacgccatcagctcattcatcgaattcgaaccatcgatgcgtatctgggcgttgctgtacgcgagcaggttcttcggccccattcggttctaggcttttgtagcagccaacgctttcatagatccatgctctcgcttgttaacttcctctacgtatgtcccagccgaacctgcctgccgcgcgcgcacgtgaagtttgcggcctcaagagactcgggatattattgttaaacttgacatgtttgtggatgatgcatgcatggaggatctacgacaatatataatctttgccaaggacgacagaacacagaagggtcctgatgaaactgatcgtgcgtgtctatatacatgcatggccaaatggatctagctagctatcaacgtacataccgttactgaagaagaaatggagcccgtacgatggtgcaaattaaattacgctaggaatggataaaaggagaacacgagcgagattcatgcgatctacagattttgtttctcaaaaaaaaaatctctggtacagttttttaatagtcaataaaaccgattgaatttcttgcttgttttgtttattatgcatgtggttggcaccttcaatcccccgatgagagagtcggataatccgcggtacttgtttgtcgcaactcgaattagtgatagctccgcctaaactaatccctgactgaacggcaaaaaccacattcgatctgcaggtgctagctcccattcagacgaccaacttttttcaagatgtctggtctcccttgttgcagttcagtgcaccacacattattgttcactgaacgacgtgctttatatcctttctgctggtgattgctacctttgctatgccatatcagaatacggtgtttgttggtgaacatacatgtacgtacgtatgtatgtatagttccatattcctacccatatttgtgattgttgatgtttatgtacttcttggatttaaagtacaattttggtgtatctattgcatattgttttatagacaagagtaatgaaacgtttaggtatacttgttacgtatttatttcgggctgcgtgtttctgcagcaccatgtaactctttacttggtcagttctgtatgccatcctttttttgcttcttctcttgctcctacatttgactagaaacagcgaaaaatcgtacttgaaattgaaaagctgcgagagtgagttctgcaagactgcacattatcatgtccaagatagaaagcagagctgcagatttggtacaactgattccaagaat

SEQ ID NO: 4538 - DNA, 2691 bp, Zea mays
  misc_feature (1)..(100): optimal_loci_126742_G1, chr3:209090560..209093250, Cluster 28
tcactatggctcgcaacctgccccaaaccaccacttccaatcttcgtcgtcggctcctcactcaagttgtcgcctctgaccttcatttgtgtctgtccacccctcttatgaggagctcatcgactcctacccacaccattgagtcatcttcaataccaaggtaggcactggacgacttcattctgaggccagcctctacagcgccgacacctactagctcacgagaaattacatgtcgtcgatagtgaacaatcaccactacaagaagcatatggttatttttggtttatcgatgcaaataaagcatttgtctgtgaccaaaaaagtgactttaaactttatttgcatctgttaatatcgttaatgtagtcaatatcattataacaattgtttgaattaataatcattaacgcaggcaaatgtcttaaagaactcgcccgtgttaaatggttaacggaggtcgcattgctacaatgcccgcctccaataatatattgatgatggtagcctatcttaatatttttgtatcaattaaccattttgtggtttaaatttgtattcagtttgaatttttgagatttacacaaaggcaatattatatttagaacgcatagaatacgcacgctgagaacatatgtatatccatctatctcatttgtgtctcattattatcctatcacaaacaatacaagttgtgtatcatatacgtacaagttgtaatgttttatagcacgttactttcttattataaatcttcatgatcttgtaatcacctaaatatagcttatccagtttttaatcttgttattattctcatgaaatatgggttctctcttgtggttaaagaactttctattttgatgcatgcattcatgcaagatgaattcacatatgtgcgctacagttcttgttatttgtgcatgagtgacttgttccattttatactagttttgtgcattttaagttgttggtaagtgatgatgaatatattaatcgcttcaagttactcaaaatgtagtatccacataatagtgttcttggtggatgtttcgtgcactgcaagatacataacatacgatcgatttaaatatatagagatcatacatgatataatgccacatacaacttttggtaagtaacgagaagttgcatctaacagttatagtgttaccatgccttttcttcttctctgttctcacattgaggtattagggatcctcaatgtatatattgtatatgttatttgaaaatcatgggaatcaatgataattttagcattaaatgtaaaaaataactaatgtctcttttaagttcaatgcgctctcaaggtccttatacccttcttttggagtatcaaatattcgaatacaatggcatatccataccgagtagaaatgtaatctagtgatccatggtggctaggatacattattccaacaatacaactttcaaatgttgaaatataaaaagatgtgatcctagttgctacataaaagttcaaagcagtcttttgacttacttgaagcagtagaggtaaggagacaccaatattcctcgacccacttcttatatatgtacatgtacgttgccgccttatacttaaatttgttgtgtagagcttttcaggattcagcgtcaacattagtagggagtaaggatacaacttgttgaagcttgtcttgaacgaaccaaaatgagccttcaacatcaacatctagagattaaaacacaacagcgtctattgttttggacagtcatcacagagagaatcctttgttgcctgctttatatttttggaattctttagccaccataggctcataaacataatatcgccgttgtcaaggcaaaggattaattcttcaaaaagctacgtgacctcatggtccaccaaggctggctcaccatgatcctcatcatcattgtcaccccaccatcaacaatgtcttaaacaaaatcatccattatgaaaccttcatcatgatgatttgcatcaacattgtgcatgttggcttatgataatgagggtcctcctccatggttcacattcactgtcgtcgaaaactagtttcctcctgcatcatcactcatatatgcttcaccgtaaaacctttagaccaaataatttatcatgaaatcacacttgataaagtgagattgcacctcaccaccttctttgataagcttgtttttgcagtgagaacaagaacatatgattccctacaagttcacactcagagaatgctttcgagtaacaacaacaaactttgtatggtgataaccttgatatttggtacgtccattctaacattttcatgccagttaaccttgcaaacatagcgaaaaagatataaatataacaatattacatgcaaataaaaactagatgtgttttctctctcctccatcatagatctggttctatatttagatctagattatctaaaacttttaaaagataacataataaagatatatgtgagcgtgtagcaacctcctctgatgccctttaaggaatccgaaagcaaaattgctttccaaaatagtgaaattttgtatttataaaatcaaactccaacaaaatgatagagtggtctcatagagaaagaagatagtctggttaagattgtatttatacgaagccattaacaaaggcaggcatcataagagagaccgcctccattaatcgtc

SEQ ID NO: 4539 - DNA, 1426 bp, Zea mays
  misc_feature (1)..(100): optimal_loci_126877_G1, chr3:209739084..209740509, Cluster 28
aaggttcgccagacaagacggggacaacttcttttctgaaaggagcaacctaggatacccctcctcgtagccaaaagtaactctaccttctggtttgcaaaaatgggcactgttttgatttgccgaacactttctccccaaatcatagcatgggtttagatcctcttcaatttcaaatgttcaagtattgtcatctttaaatgctcttggctgctgagtgatgggtggtgccaactgatactgatctaaatttgtagttaacaatttttatccaattttctagtatgccatcagttgatgtgcctaatggtttttccgagtgctgcattctctttagcgcttgctggtattgatcttgcaagcgtccttttttaatgtaatgatatgcaattctcttgcattggctttgtattgcagtgtttgagaaaaagaaaatcctggaagcgttatttaaagactacagttgatttttacttcattgcaggttgcagcatgctccgtgctcatgtatttctggtcatcactaattttgggcttcatcatcagatttatgttttgtacatttttaaccgtcagatttgtaacttcagaaaattctagcacttgttcatatcagtattatgtactgatatgttctatcgatctctgactctgatgttccagattgttacgagctaacgggatgatgtcgctctcagatgaagatcgatctgggttcagaggtagactggtacatagacggcctgaagcagtgaagttggtggtgggaaactgaagtgaagttgctgatgcgcatgtaccatggtccacgagaaatcgagaaccccttaaccttttatagttttcgacttactgaaatagccatgtaaacaatgcataaaggcctttgtctgttaatttgttttgcaattttcatttgacgctaactaaaatccaaatgcttcagttgaattatatatatcccatgacatggctatgaccgatgggtgtatttcttatttaccccctttataaaaaaaatatagttatagatttaagtttgatcaagttagtaaaaaacatattaatatgtgtctctcaataggtttactataaaaataaattttatatctaatctaaagttgtcatctctcgagtgctataaaaatcaaactagagagactctaataagttaggattccgctaaagttgttattaaatcttccacgaggaataagcacaagagctcatcataattaatgattagagccaacaacaattattaatagctactcaacaatctcataaactctaggccatctaggcaacgacaatcataagagatgatcggaccaagtcgctcaactagcatcagaagatgcaagagctctatgatctcacacaaatgatgatcaggagtatacaattgaatggagtgctaaggtgc

SEQ ID NO: 4540 - DNA, 1522 bp, Zea mays
  misc_feature (1)..(100): optimal_loci_128314_G1, chr3:216872602..216874123, Cluster 28
ctttgttcctcttcctccatactcctacgtgagtggacactcgatagtgggttggtgactggtgcttcgctagattcgagaggcacgctacaaaaactactaggactcgatgatagcatttacatagttaagaaggcgaatattctatatttttataaagtatatactaaaacaaagttgattattacaataaaatactttaatagttagtaaatttcactaactctactaacatctaaagtaagtccctacttaattatagtagctttgattctatactagatcacaacaccacacaagctactactagcaccatttacactaaaggtctactaacaaaagtaattaacaactaactatttctatatctacactactctagctagctaaccaaataaatacaacacataagcaagtaattgaaatgtaaacaataagattatagtgagcaaaccactaaggataagaggtgaacaagatttatctctaaggttcaattgcttgtcgacgacctatgccctcgtgttatggcaagttcctaaatgatgatctacgctaactagtgtgacaagcttaacaacttagatgctacaataattaatcaagtagtccattccaagtagccacaaacatttcactagagttgctcttttatgcttttctcatggagacaagcacaagagccacttaaaattcctcgaccaaaggtagcaaaaaaacacaatagttcttcaatgatccctccaacttcaagccaactagatgacaataatcaccaagagtaataagaggatgatgccctcaaattaatacgagtccttcctctcgatttgttgggtttagggtttagggtttggggtcagccccaaatttgagaggtatatttctctaccaagaatgaccatgcccctctcactttcatacaaatgctctcatttctaggatcatctcgtactatcctattctatcatcataaccaagcacacattaagtggtatatacttaccatattagaaataaaatatgtagggatgacttctttgaaaaaacatccatgtctcattgttccttgtgctcatgtgggcctttcatgaccacacaagataaattttagcatgatattccttctttctttgcctttccattatagagagaggagtagtagagagtggcatgagatgcttgtggttgtggacaactcgagttgataattatggtcttattgagtgaggtgtggacaatacacaatctgcatattgctgagtgaaatatcatcaaggcccctaagtatgttttgacacattaatgacgatacaattaaaggtctaatgagatttgttaagtgtgtgaaagtcatatgtttagttttagtaattgagacaactagtggctaacttatactctattattgtcattgagatatgttaagtccacaccaaggttgaacaaggtaatgatggtgccgcaaggtgatcaagtgcttaattttttgcgaagaaggaagaaaaaactaaatgaatgg

SEQ ID NO: 4541 - DNA, 1727 bp, Zea mays
  misc_feature (1)..(100): optimal_loci_128380_G1, chr3:217146227..217147953, Cluster 28
tcgtgttaaattttgtggctgcatatgcatcccgccgcacatatgtacgtatgcatgcaccctttatttaatataactaattaagtttataaactattagatttaaatatgtttagtggaataaatcgtagagcatataacatgacgtgaaaatctagatggtagcacatgtgctatgatatttgtacaaatagaatcaactggcataaacacaagatactttaagctagacgccatagtataaatcacgattttatataaaaaaattaaactagtttcatatttttaagctaattttttcctacgaatattctaagattgagacagattttaggattaagtgttcgtggttttgctcagttcaacggcccaaagcccatggtgtggactccagaacaattgtgggcttgtgtccagcatgctagcccacgtattagtctatagagttggataatttagtccaggctgacaaaaggcccgctttcgtatcgcctcgccgaaaaggtatggaaaagaccagcaacctaaatggcacatgcctacgctctctgtagtagcttcgagttcttgcaaatggaaagtaatattactagaaaactcagcgcggctttgcagcgtattggagtcatggttaatatttacgtacagcaatagcacgatcaggagttcaagtacttccgcagaatacaattctgtgccttgatccaagtatatgtatatgtatgttgtatacccaaatctacatgcacatatataccttgacgggaactgaagccactgaaaacccatactgagcacgtctaatggccttagaagattcccagtacacttccaccattatactagcagccccgaaatgttttgtggtattcctgtgagacaaaggtacagtaattaacctgccacacttgcaattagcagatcaagtatttttcagactaagaatgcagtagtaaaggcacatgagagtgaagctagtaaattctagagggaagttaatctgcattggtttcttgctatttgcacttatcttatattagatgtggatgatattttttcagatgtaattcaatagctaagttgtttcttatcggctaatagaaacgtagattaaggaatatactagctaaaggcttgtggaaatgctaggactcactatcgcagtacaggacgggagtgcaggtctagcttgtggcgaagacggtggatgcaggcagctgcatcgctgctgcctgcacacgagaatggggagggaagagggggtcccactcggctcgtttatacctggttccgtcgccatctcccacgccaccggccaccctcgctagaggtgctggcccccgtcacctcgccacaacgccgatggaccggatctgcattgcgccatccaggaggagggaagggacaggggacccgcagccgcagagggcagggacagggaaaaaggttcaacaaatatttgttgaacgaatgatttaaacttgaaagggaggcttcaccaagctataaatgtccaaaccttttcctcaaaaaaaaggggaaaaggtacaaatcggtaacaatcagagagtcgctgtctagagacacacaggccacagcacagcaaaacgatgtttggcattggcagtaattggtggttgctgaaagaggctctattttcaacatgtgcttagatgttcaaagcatcttccaagaaacatcctgcccgaccacattatcctggaaag

SEQ ID NO: 4542 - DNA, 1621 bp, Zea mays
  misc_feature (1)..(100): optimal_loci_12969_G1, chr1:71060280..71061900, Cluster 28
cgacacattgtatgcaaccttagcacatttgcattggcttaagctttaaattttcagctcagttgcctgttcttatgttgccaatcccaaagtagggatgcttcgcaacttgtatgcagttaaaaagaaccaagtgacagtaagatcttcggctttccagtcttgatagtttgagtttgagtgcctgctaaactatgcacctccatgcatttcggttacatactgaatctttcggcgtgaaagctagctttgcatgaacttgcaccgcactttacgttgatctgaatttatcatctcctgtttctatcaagcaaacctgtcgtctacctcagctccccatgttcagacttcagactgatgaactcagtcctcatatgctatccaaattaaactcagacgcaataatggtgctgcgatcaaacaaaacatgtccctgtccatatcttaagcatcgagacaacatgacgctattaaattagaccagtgacagtgaccgcgcgcctcgcatttttcttccactcctcacaatcatccatgccactggagccttaattagcagcaagggagcgagcttcctgtccacttgaaacccaggaggaccacatcgtctatgagaaccatacaaacaatttccatatataatagcctccatgttgcgctgggcgaatgcgagtttggcacacaatcaataagacctcatcagctctgtgtgagcaacaaactaaactattcgagattcttgtgagggtgacgtagccgggcaggaatatacccccatcaaatcccttgtgccttcgcaataaaaatggaatttggtttctgagcagcaatcttaatttatatcctgacgttggcgatgcggacgtgcccattgttttatgttttgatagtagggcgtattctgcaagtacctggaagaggaaggagatagtacttccttctttttgaaacaaacaaagggtagttagtactttccttccctcatcgattgatctggatttttttttttgaaaaaaaaccctgcaaattgcaccactttgtcatttgtggtgtggtttaagtgtgtgtagtacagccccttgcagcaagtacagaagttgaatcacaaggagcttgtactgatgaaaccagccagaacaaaaatcagaagcacgtccagtgaagaggtctataagtaaggtagacagctcacacagatggagtttaatattttcctgtgccattatatatgtttcttggaacaattcagcatgagcaatgagtcacaccacatcttgtggcaagtagctgtccttagaaagcactgcacgtatattattgactgaaacactatagttaattgtgttagtcaataatactgttgtgtaaattgaatagttgtaaatgacctttgtgcatatagtgaaataaaaggaagagagagtgtggtcagggatggaaacacccgaattatatgacaaatattttaacacagatgcatgaaatttgggttgtttaggcctcaagcactcaagcaccactctagaatttttctaaattgcaacatggtatttaggcctgattggttctatatctaagatgtcaaaaattgccacgtattttgggttgtttagtttgctgc

SEQ ID NO: 4543 - DNA, 1599 bp, Zea mays
  misc_feature (1)..(100): optimal_loci_12998_G1, chr1:71217700..71219298, Cluster 28
tgagtaatgcacgcatgcacgacgcaacggccaaaaaaaacaaaaagaaagcatgctaggatgcatgaagagcggtgtattccgcttctagaactttgtagaggcctaaatattgtaccgctatgtcttgacagcctgttaatccgaggttatttgcaggtataaatactcattttaaaataaatccctcgaatgacaggtattttaagtctaaacggtcttaaataaaaaatatcaactaattcctctacttttatatttcaaattataagatgttttaattttaaaaatacaaaactgttgctatacatttagatatatgttatgtttatatacatagcaaagatacgtaataaaattaatatatccgaaaaaggtattttttttataatttttaaacagaaaaggcaagaaattatggatcatgttgagagctgcaacttcggtttacactgtatgaacattagaggtcgtttggaaaaaaaaagtttcgaaatcaaagacatttaaagtgaatatttgtgtccctaaacgaccccagttaaaaatattattaactataaagttatagaattcactgaaaactacaactctggtatatatcaatatccaatgttattttttttaaaaaaatgaattctaaaatctagcgatttaaaaaatatttagaatatattaaataaaaagatagcaatagaaatacaatttaagtataaagtttatatcaatacgacttacatggtgaagttatgttttttatatataagagaaggggagataacaaatgatagggagactagggtcatcaaagtcatccaagaaatcactttgaaacggtcaaaagttttttctagaaaagttaaggcatacttgttgtccaatcttgatttttgaggggtttatttttcaaatttaagggctagttcaagggtggttcagactttttttttgtatgtactctctccgttgcaaaagccaaaaagaacccaacatgttaactttatcaaatatatataatatcaatatttataataactaattagtaacgttagatagttctttgaatataataatttttaaaatgtaaactttgcttaatatttttttactaattccatcgaacttaaaagaatttgatcaacactcgttctatagcgttttttaatggagatggaactaactcgttggttggaccttggtaaacatctaatagccggcatcaccaacatcatcaaatcccccaaccatgcgacggaaataaaacaagtgacagtgacatgtgccatcttcatccgtaacatttttcttcaagtttcatttggatccgtcattttcggccatgtctgtacttgtgcggttggacacggcacgggaagcttcccataaacgccaggacacgcttcacgcttgccaaacgaacacgcatcacttggcaggcggcacaggcgcagatgccgcgtagcaggggtagaccagctaggccaccacaagatcagatctccgatcttttcttctctctgtagccaaaatttgcttcggctacagggcaccgatagccgtgtttgctgtcgactggtcattgtgttttccaagacaccg

SEQ ID NO: 4544 - DNA, 1459 bp, Zea mays
  misc_feature (1)..(100): optimal_loci_130348_G1, chr3:227056654..227058112, Cluster 28
gatccacgttaatgatgacgtataacggtggtagaccacagttttaattaaaaagtaggactttttttttttgcaaaatgaatgatggtggacagaaaactggtagtttataggagcagatatgccggacatttaggaagacttatgtatgcgccgctgtaagcctgtaattatgggcttagattatattatcagttgcttgagccctgatctcgttgagtacttgagctccgattgttttgcatgttcattcacattcaggatgatgaggggtctctggcttcatcctactacctgggtagaggcgtagagtagagccagtgaaggctgcatatggtaaccaatcaaatagagatccctaaagttagggttctatgattacaaatttcgcatggactaaatcaactagtaccagtgcttcctttccgtattggaggatggcacaataatatatatacccttttatggccgtcaccaaggcgtgcctgcctacgacgaccgatcgtgaaaactacaaatgcgaatggtgagtgcaggtagttgcatctgcgcatgtatgtctatagtttgcatctcttctttcctaccttccacaagcacacctcactgtccttgcaatacggaaagaaaggaatcagaagacagagtgaagagctgcatgatctcgaacaagaactggccaaagttcttcgacacgaggcaactcgtcatggggcaaaaacaaactgctttcgagaccattatcccagaacgatctacgcagaggcggacttccatgatctttgaactttgtgcgccctatcggaatcacaaaatatcatctgttatctcaaggtcaaaagaacggtggcgataatgtttgtatctacaaaccagatggcaacgtgaccagaagggaatcgctcttctctatccatagccccctataggtgaaggaccagctgttcggtcccggaacatatggccaagcagggatacttaattttggtccctcatctatatatatatctatataaataaaatcgtccaatataacccccctccctcgtcaacttcacaattcagatccaatgagcacctgataggagagcagcaacatctccagaaaaagagagagacagcagaacttaccatgcatttttttttcacttttactgcagaatgtccagtacaacctctttgccaaataatggagaaaacgatattaacacaacgcggtgatatcgacaggacatgtctcctagacatattttagacatgtaactgggacgtgcttaaagcttaaaaggtgacgagacaggaggtaatggaggatgtccacggtgaagaaaaggcagatcatcgatcggtagcagacaagagaagaaaaaaaaagatatcccaagcatcgccaggtggcctggatgggactgcacactgaaacacaatcgaaaacacgttctttgcgagtgtttagagg

SEQ ID NO: 4545 - DNA, 1529 bp, Zea mays
  misc_feature (1)..(100): optimal_loci_130447_G1, chr3:227475676..227477204, Cluster 28
tatttcggctaataaagggtgatcaaaagctcgatggatctcatcaagttcctggcaggatcaaccttcatgtttgcctcctagatatgtatatggtagacatctctcgaatgcttcatagacaccgttttgagaccatggtggcctaagcttctctaacaactcactgagacacaatagaagacctgttcgggaatttcaatgaatatttgacattgagtccaacacaggcaagaccatgttctatgagtcagcctatgtgccatcatacaactggtccaaacctagtctaattttaagtacaagtccaatttggacacaaccaagtcttctaagttagcttctaatccatcagatagctatggtccaagcctagttgattctctctcgtacccaagaatattgcttcaatctcaaagttgatcacaagtcttaacccatccactctcatgctagaggagatgtatatgtgcaagaagtctcactaataaacaaccaaaaaggccacacccttactactatgacaaacaaaaaaatcatacactaaccaagaatctagctacccgagagcaacactgcttcctcccatgtagtctccttcatgaatcaattactacactaggccagagtcactgtcctagctatctcaatcatcgagccttgtagtcccaaaaacttgggaaactatgatcattgttaggagatcttcatttcaaaaagatatatcaaccctaaggatgaagaagagaccaacatatcaaattattagcaaattgtggttggagatacatggcctaaaaagctacttggacacacaagtataagtaccacgtgcaacaacgtctttatgccttactttgttgtgaagtactcaaccaatgcttatccaaagagcagcatcataaagagtccaagcaacaagttggcaactatctaggtagatttgtagtgtgcaatcttgactctaacttataagaagttaggggacacataatctacaatactcttaaggctaccattatattcatagcacatgcgctatgttagggaacccaatctaccttctcattatgagatttgcttaagagtggtacaacaacgacccttgggcaatagagcttttggaaagcctatgaagctcaacccaagtatctgcagataaggttagagacataaatttacaaactaaaactaataagtatataagagcattattcaagatgacttaccatgggaggaggattggaaacacaaaaccccctgttctgttgaggcatactcacctgacctggtagaatatgttccatatgagtcaagatttcattgccttacaactctataaaagttagtcatgttgggttatcgactttgatgaactcaaaaacaaagtttctttatgatatgccagaaggatataacacctcaggaagctaacaacaactccctatgctaccatcccagactcttttagcacctacatttgctcaaggagatgctagatagtactcttaccaactccaaaaattatc

SEQ ID NO: 4546 - DNA, 1978 bp, Zea mays
  misc_feature (1)..(100): optimal_loci_131891_G1, chr4:3113659..3115636, Cluster 28
tatactgttaatttaatcgccatatatgctcgtaacaacccgcttttatgagtagccacatatatataatgttgaagagaatcggtgcctagctagctagccatatatgtagagtattattatatagccactttgatttaaaataatgttctggtttaagatttatttatcatagtgtcatagaaaatcactatcgagagaattgagggagtggtgagctctccaacaatataatatagctgctatgctatgctataatacgtatacgtagccactgctgtctctcctggcccagcaccataccgagacagcttttttttcatgcacacaaacgtgtcgtatctgatcaataatcacacgagacagagactctgcctagcttgacatcgatgggcaacgaacatcatgcatgtgcgctcgtggagtagctttctttctttctttatgtcctctgtactgtacgtgtgcgtacatgcacggtcgatcgatgcaataattaattaattaattaattatcataatatgagcgcggacacagagtaaatccaagctgccgctgtcaccaccacacacctcgaatctcactgttggttccttgcttcttgttgtgttttgtacatatagtctgtgagagctagctgaggaatacgatagatggttacgggaccaaacgcagcatattccgacaacttaacacgtcattgcatgtgatggagggaccgatcgacgacgacgacatggcccggccgggtcacatcatattattgcttggaccacacaataatattatttatttgttgcatatatattattgtttggtggaccacacagatctaacgtgcacgaacctgccagtattatttatttgtttaggcgccctattggatgaatccaccaaccaacacactaggctccaacagagagcaacgtacggttgggatcttatttaggatggggtgagtacattgtttagtagccacaaatagtatgtctcagtacgtcttggtggtgtgtcatatccacgcaccgttcgttcacgcattattttttttcccaatcgttacctaccacgcgcgcatgctgtctcgatattcacgagagtgtggacggtggaccatgcatgcgtacatgtcggagtgcatgtagatatcgtcgtgttcgtgcatgtctgggcattgattttttttttttgtattgctaaccaatcggtgttggaataattagcctgcctagggtaatatatataatataatgtcaagtcgacaaacatgcatggccttgcagtggccgtggggccggcctatatcacgtgtaccccggccgaaagcccatttcatatcgtacgtaccctagctagtgcaacgttcctgctactctgcagctagtcatctctagctaccatgcatgctgagagagaacaaaaaaagttttacggacgtacgtgcataattgcataatatataatcatctgacaacgtctcagctaggtgcatgtgcgacaacctgcttgtctaattcctagctactttgtagcatatatatgcagagaaaaagtttgatgcgtgacagttttcgaatctgtgatgacatgtaaaacaaaaacctccctccctccctccataattacatttcactgtaccatatattggtcattcgatgcattatattattacctaacgtgtcatatatacaggttaattaattatatagcctttgtattccatggttaattcgccgacgccacatatttccaaaatcgaatagagaaatggacgtgcatatacaacaaccctgtctaatctctattattacgaagcaacagttgtatcaacttgttaagcatataggctcgatggcggagaggcaaacggagaaaaaggccatacaaatatatatgtgctccggtgcaactaaagagcgtgggatcaacaattccatacaaaaagactagctatattgtgcaccgaaagctagctaa

SEQ ID NO: 4547 - DNA, 2579 bp, Zea mays
  misc_feature (1)..(100): optimal_loci_132819_G1, chr4:6526897..6529475, Cluster 28
acacaatatttgtaactcttatttcaccataaattatagcttaaaggtgccatttaccatagaaacatgaaatcacactcatgcacatccaacatatattaccatatccatatatatgcctacataacgtttggggtcaccacttgaaaaatattgatatatcatggcataactacatcaacagctcttgtttggggcaaatgagtcaaatcattttatccgtttatttttggaaaacagaataaaaccaaaacctagttgcactaggatcgtagccctaacacaagggctagattgtggcatatccacgagtaagaaaaaaacaccaacacaccctagcacaagtgtgaacagcagcactaccacaaatatagcacaagaaattgttggtgtgcatcgtcattgtagttccaccaattattactcaccattctagctccaataatgaaatttcactatagctccaaactctaacaaataaatctgaagattattgtttttgagaatgtaaactaagctgaagatataactagatctctcttgtgcacattatgatatgattcaattttagcaaaaggttaaagtctaataggaactaatataaacacatggtcaaaattaaatatctacatcaccaccttccactctcccttttcacatttggagttgttgataaaatacaaaaacaaaagagggagagagatagagatacaaagaaaaactagtgtggtagagaaaaataatggcgaggagaaaggaggtgggatagataaaacaatatcgaatacacagaccattggcttcttggatgatggttaagatatagctccaattggttgctctgtggtgccaacatgaaaggctataatgacacattactaatcgttgagtatttttttgaggtgtgtttctaatttttttatggtaaatttcttgggttgttgagtgggttcccaagagacctttgtccttgatggaaatgttggatcttgatgattctctgcatgtgccagcggtggttgaaggttaaaccttgctagtgtagcaccaagcgatgaagcagaaatgccacttacttctcctaatttgagatagccccataataattgcatctatttaattcttgcatttggagcataagtatcatcaatggaaaaaagagcaatttgagcatctcaatgtgcatacaatgaaaaaacaaaagaacacttttacattttaggagttctccaaatcacatatttgaataactcattgaaatgataaaaagtagagtttttcttcactcaatttgagtctaaaagcaaaatttacatcatttggaagattgtgtaattagctaatggaagaagcaaatcaacccacacctttgtcaaacttcacagaacttacgacaagagacaaggggcatacataaagacttacatacacttgaggttgaagcttgcaataatcctaatgaccaaaaggctctcaagaggcccaatatataggcttgtcaacctcaaactactccaaatgaagtgcgaccaatacgagttcatcgacaccattaacactcaaaagctatccaagggacgactggactctacaaggccaaccaacccatcaactgccttatacaacatgcatctaacctcttgagcttgaccttaagtgttgattataagatcttcaaatctgatagttgaatagctacatgaagcctgagcgactgggacttaacaatcactccaagccatctttagttataagtaccactcaccatctagggctataaatagggtacttgcctcagttgtatttacggagaagtgaccttaagtgttctcttccttttactttggcaatattttagtttatttatttgctcatgagtaccttatttgcaacagatagcttgttctattgattgtttttaaactttgcttggactagttggtaaatgtagcagttaagcatgttgtttaggctaaagcttagttgccttactttctacccatggattgccatggttgacagtaggtgatagtagcaaatgtatgtccttcatattcactagctaacccccctcctcgccccttttcaagactaagaaagtgtttatcacctagagcaaacacagttagagttaatctcttctagcagattagtaaagcttctaactcttcatcctcctctctctctctctcttacccttgtcctccgtagtcactaagctacattcatatttagccacttttcctttttatgagcttggaccacacaaaatttatatttacgtgcacttttctcgattcccaaccaagatttggcgtccttaatttttcacttacataattttctttcgctcccaattgagattttgtcgtccattttttacttgcatgatttttttcaccatctgattcttctaaccatcatagttgtccttgaacgtacctagctagatcaaaggggtggctatggctggctagaagatattagaacaactccagcaatagctctcaaatcagggaaatcagggctcctactttttgatttgagcgcttccactcattttttaggaaacacttttt

SEQ ID NO: 4548 - DNA, 1543 bp, Zea mays
  misc_feature (1)..(100): optimal_loci_13570_G1, chr1:74632810..74634352, Cluster 28
gtctagggcatccccaacaaataacctgagtacctggggccctccgtgccttggggcaacaatggtagaaatacttagtttttaggctctttagtagccccaaatccctaagatctttggtctcaggtaatatgaaaagtcgagccctgagtccactcaagcttgggcctctcataggaacaaaggaactcttacaacagctaagtataaagccacccgcaagatagaagtaaatagctaaccgccaccaaggctatgatggcccctagagaaaggatgccacttctacagtatgctcctgatggtctcataagttcccgtgttggataaggcttccatatatcacatataatatgatgtgcaaaattatagtctgataggcacactatcccttcaacttagacaactaggtactcaagactactattcaatatgtgcatcggccttatagctacgcatgggtgtgtcatcatactaggaagtattatcaagtatagattgctacttcggttaccaacaacgtcgtacctaatagtaggaacactattttcaattgttacgacataacatacctacccctgcagtatgtatgactgccactggagaaggctgacactataccacaattgagggcataactttgcatacgacttcatgaccaacagaagattagggttgttgggtcttaactgataggacccatggtgtaaccaacttgtaacctctctcctcccttagcccataaaaggaggagcagagtatcgatccaagagatatacgagatttggaaggtccaaaagggaggagatccaatagaagctagctcacttcatataagataaaacatagcaacatccatggacatgcataaagatgaactagggatcgataagcgagaactctcaccacaaccaagtggaaaagagggagctatgaggtcatgatgctcagttgattcttgaccttgtaatcttcatcacctttatgtttatcactccattagtagcaataggatgtaggatattaaacaataaactacatggtgctagttcttggtcacgcctaggtccaacacaccgctcgtttacgtccctattctctttagatctcatcttttcgatacttcatgtaccctagtgtcataccatgatggcatttattgtgataggtaggggaaggacacttttttatttttgaagtttactgtgtagcgtgactatggggacaccaacatgctcgcatgctagagcagtcgctttggacaatagctctaggaacccgaaccatgagccactccactggcagcatcagaatctcacacagtcttccccaccgctatcttcggtgggggacatgctttggagagggtatggtatgatcccgaaggtcttgctttggcttatgcctagttggaggcacaacaccctaggtgcattacaccgtaggcctccatggccctcggatgagtgcaaccatacacaacatgacactcctctaggcatgcgtcaggatcatggcaaggagacctgcaagcattaaggtt

SEQ ID NO: 4549 - DNA, 1671 bp, Zea mays
  misc_feature (1)..(100): optimal_loci_159834_G1, chr4:174008250..174009920, Cluster 28
tatatatgaaaaagacttttggtgccaaccatatctataccgggaaattttcggcggacttctgtagctacggaagtatacagataagcataaagtaccagacaccgatacatgggagctagcgagcttactgctcactagctgctacttctacctagcaacaatcacgtcacaagatcgtcacacccatgggactgaagaagatgctgtcaagtcatcagatgagagcgagagagacttgagtgagtgatgagtgtgaggttgttgccacccctgcctagtctccactgtcgctagctgcagccctccaccaccaccagcaccgctgatgaacacgaccgccgttgaagtttgctgctgctgcagccgatcgaattccttggagagaagagggatcagaatcagatttcagaaatcgccgacgggcgggcgggcgggcgacgagcgagaattcatcagaaattgggcatcgaaataatgcctgaccaatgacagctagatctatatattaataatgacctttaatttgtcagaaaactatgctctaatatacttacgtatactaggttctctaacgaccaataataaagctgagcacagcgagagagaaagacactggttgattaatagagggctagctacacctctactcattcattgtcaactttatacagtatctgttatgagagaaaagctaaataatctataggtatatcaaaaggcattattaattgcaacgacgacacataatatatacacattcttcttgccgccggtgtaagcagaagcgtccgatccagcgctcgtgcgtgtccagtcacacacagcttcttgtaccatgcatatccatcagtatctaatggctggattgaatttcctggtcccctctgtcaagtgtcaagcagtagccagcagttggcttctagattaattttaagcttggagcaaaagcagcacaaggtagatcgatcagcatcatcccaaaccccccaaacaaaataaaaaaaaagttagtagataacaagggacacatactatagctactacccctttgagaaagaagcttggccaaagcaaaaggaggcttgtggacagtagaaaatgctttgccccaaagacacctcttttcggatttctacctatctcgaccagaaaaatggggacaaaaaaatcgtgtgcacgacaaggaccttgcagctagaaatagttgggcagaaagagaaaggaaggtcataataataatacatctttttttataactattttcatatgaattatatagaaaaagaattcaacgcagccacagaagatgaactgaaattccgggaaaggaaatctgaatctgacgccagtccaatccaacagaccaactagagcccgaccgcccaaggcctcctgggctctccgtttgaaacctcatttgggccgaagcccgttagcagccttcctatcctatctaactctctattttaaaatttatcctataaacagtgtaatatacagtacaaaacagtgttttacacgtctatatgagatagccttacaaacaaatagaatgacgtattgatacttggaaaggacgagcaaggaatgagaaaatataggaggagaggactgagctgctacccagttggttcattcgtcaggtgtgtgagcggccgtacgtgggat

SEQ ID NO: 4550 - DNA, 1593 bp, Zea mays
  misc_feature (1)..(100): optimal_loci_160840_G1, chr4:180375711..180377303, Cluster 28
ctctgatttcaacctagttagtgaaagagcaaatactctaagcactgatcatcacaactgctgcagcaccgaaaagggtttgccaaaccttacttgttcactacaacaacgactaactctaatgaaggtatgaacagcagcacgtgctagttttatctatgttcttgtgtcctaactagagcataatgatcttacaaaaatgacgtattagatccaccagcaagcaagaatggcgcgaagatgaacttaaccaaacaaaacctagtattgcactcaactagctctcttccattctgaaaagggaaaaagaaattgaacggttgtgttcgacagtccaacgaagagagcgtagcaagccaaactctcgcgctccagcagagagtattcgcaggacaagcaatggcagctacgacactaattatcttattattacgtcgttcccacgcaaccgaaaaaagttgagtcttgatcaaatgatcagtaccccccccccccccccccctgccccctgccctgctcctttaatcctaaaatagataactttatagaattcaaatgtttaaattttgttctaaagtacttaactttctcaaggttcaaaaatacttgtattagagggggagggggagttgtcaggccaaaactatcagcgaattggcaggcaccgcagtagcagtgcggttatcgtctcgtctactcctgacgtctttgccgtggaactagaatagtacagtagtatacgtttatactcctcgcactttgtcctccggaatctattgaccggcacgtacttcatgttagatcttttgcatgtatacagcgtgtcaacgtttgtgaaagcggtcttacccaaaatcagtttttcgacattaatgcattttatttagtctgctaaatcttgtgcatatctcttcgcataataagtaggacaatccaccaaacgcgcaatactttgtgagggcggacaataattgcagtcctcaccttcaaaggtgatgaggtagttaccgagtcacgctccatttcgaccatagtaattgaatccaccccggtttttttttagaaaaaatggtttctagatttggtttatacaaactagtttttttttaaaaaaaaaaactagatgagcagcttttttggtttttaacaaactgataaaccagcttttagaaactgaataaaaaatgacatgtcgggagacattctagttttttaaaaccagttttaaaaaaatagttggatctaaatagaccctaagcctattttcagcggattactcattcttatattcatattcaaactccactatatgtacaaactaatgttttgaataactatataattaaaccgctagacactgcctgagactaactccaacaaactatatgtattaacgtataaaatattgttttatattataaactgttctttttatctaaagtagagtttgaaatatgagttaagtacgagtacgcaaaagacagtctaataaactgcttactccggttcacgtgccatataataaactcaatccgctagattctaccgttgactcgtcggtcacctcagacgtggcttgatggagtttgtaca

SEQ ID NO: 4551 - DNA, 1608 bp, Zea mays
  misc_feature (1)..(100): optimal_loci_162024_G1, chr4:187880006..187881613, Cluster 28
agggtggaccaagtacgagtttctgattttctaagttcgatgaactaggtgtttttactacacctcatacatacgaagatgaagtgcaagcatttgtgtaagtctctcttttcactgtcgttcattttttttcctctttcacaaattcatcggttatatatatatttttaacgggaagcgtaaaagtgaccattaagcttggttatatatttttcactgtacatactgacggcattttatttttcttcagaaaccaatgggcgcacacagacaacggcccacagcttgcggtagtttttctccttcttccttctgttggtgtgactggtggacggctgcagagagaatctagcagccacatgtgtgcgattcagtgccgttctagattttgtttagcatcgttgattgactccaggtacactgcaaagtatcatcccatccatatatatggtggttcctaatcaaatcaaggtcgccgaaaattggtaactccgtcctttttcgctggtctggcctaaaaaatccacatgcaaagcagcacaaaaggttctacacttccacgcaaatgtttttctaaaaagataattcgacccatgaagtatttcatgtacctaaactaaataaagtaaactattatcgatctgtaccgtataaagcaccagtttcaagcgtcgtcctacgtcacctttcaggccttcaccttcgcgctacccttcaccttatgtgcgggtggggttcgaaccttaattgttggctccacgtctcacacctacctagccaacacaacgcacatatttttatgttctaataaatcaaagtctttttatataatatatttttatgtgatatatatagaaactgtagcaatacacgggtatgaccagtactaatacaaagcaagggtttcgccaacgaaatatcaaaaaataaaataaaaaagaggaatgcaactgcccgaacaccataactcatgttggtttgtgttattaaaaaacgtatattatatataaaaaccgtagcgatgtacgggcaactaacaagtgccgttggtgtgcgtgtttctaaaaaaaaggcccggtcaaacattaccttgaacaacatgctttttcttataacaaaatggaggtaaaaaaaaggttatcatgtcatggaactggcgcgtgtcaacaccgatttaactgtactaccatcttcaaatcccgaaagcagcaacacatggtttaaaaaaacaaactaactataactgtggtatatagaatgattggcttattgtactagtatatgctaacaaggtttcgatatatggctgcgaacgctatgcgcccatagttttcagccaaagattccaaggaaggacacggttatcccaaggcggcgccgatggttacgaaacgtagtacaagggtttcttcctgctttaattatgtgctgcactgcatgtttgttgattccttgtgccattgctttagccctcctttttgcacgtattgttaatgtgcagttagtagtacttgacctgcgtggtttgatgcgcatgcatgcatccatgtttgtggcaggcgaaacaaggcttggcatcgtttcgcaggtatcatgggcggcatcgtt

SEQ ID NO: 4552 - DNA, 1413 bp, Zea mays
  misc_feature (1)..(100): optimal_loci_164397_G1, chr4:199185401..199186813, Cluster 28
tagtgagatatagctcacaaaaattggtgaaaacttgaaaatttgtcagagagcacaaaacataaaaaatctacactagaaagtagacccaagaaaaataacatgtgctcgagtgccaagtttgacatgtttgacatgctggaacaacacaaaaagcctaggtttcacaacccaaaaatagaaaaaaaaactcatgacccggagctcctcaattgtatagtaaatccaaagaactcattgtttgtgaaaagatagtagctaaaaatatgttgtctgagcctagatatatcctagtgaccttagtagtggccttagaatgtctggaatacgatggtttcgggtctaggaaaacacctaaaactagtgagctatagcttatgaaaattggtgaaaacatgaaaataggttcaagagcatgggacataaaaaaatctacattagaaagtgggtctaagaaaagctacatgtggttgagtgcctagattaacattttacatgccaaaacaaacaaaaagcctaaaaatcacaaacccaaaacaacgaaaaatagcgaatgtatttgagctcctcatcggtgtagtgaatcacaaacccaaactacattttagtagcctacgaattgtctgggactcgttagctctagggctgagaaaacacatgaaacaagtgagctatatctcacaaaaattggtgaaaacatgaaaatcagtctgtgagcacgggacacaaaatcctacactagaaagtgggccaaagaaaaataacatatgattgagtgtctagatttctatgtttaacatacaagtctagaaatcacaaacctaaaatagtgaaaaaaaactgacgaccctagacatttgagctctccagggatgtagtaaatccaaaaaactcgtttgtgagaaaaaaaactagctagaaaaatgttcccttaacctcggtacatcctagtggctttagagtgtgtttggttctgacaaaagttactttatgttgtatgctataaaaagttgtcgatagttgtctgctatgaaaaaactaaatgtcatttggtttgaactgctttgaaactaaagatttcatatgatctgccttgagactgtttatatgcaaatgggcaatgatgcaacattttcatgattgttgacataatttttatcattataatattacatacatacatatagctaggaaataacttaaaaataaataaagaaaagaaaatatattagataaataaaaaagtccataggaaagagaaatgatgggttggtaccccttaaccgatgacacagctaggggtaatttctccaaccttggtttgctgccagcgttgaagaagtagtgcactgcccacttcatgagtttaactacgaagaggcagatgtggtgcaaaaagcagaggctaagtgg

SEQ ID NO: 4553 - DNA, 1493 bp, Zea mays
  misc_feature (1)..(100): optimal_loci_166984_G1, chr4:212309035..212310527, Cluster 28
gttttgagggtgacacttttcgtatcaaagaagaaggttcatcagttgtggcgtttggatgatgcatgtgtgtgtgttttattttttgtaacttgctatagttggtaccactagttcaatgaatgttacgcctagttgattagttgaagtcagttttgagggttacaattatcatataaaagaagactcatttattatggcatttgaaagatatctatgggcttgtcaatccacatgagtagagtctccagcttagcaaggtcagaaggcatggtgtttgttaagggactgtttgtgcttcactactacataccaatattttctattctaaataaaataaggaccttgagacttttttttcaaaaatagaaataaaataactcaaccaacaatgatgtagaagctatttatagaggtgtctcactttcttggtagagaaacttataaaaatagcctatctctagaaatcaatttttaaagatgaatagaaagttggcttgtatttaagaatgcctctattttgaaaggcggcaagaaagtccaactgcctctaaaaaatggcatttttagagtttgcccactctaaaaatagaggtatttttagagacaactaggaaaaccaccctcctataaaataagtgctaatatatattttattcaaatcaagttggatgaagacaaactttatattatggttgatgtcatttccatttcaaagtatttatgatccaaagattatgttttcaaattttgaaattagaaatccatttttctaaaaaaaatgaaacaaccatgaatatagacatgatacaaaccaaagttgtatcactgatcctactaggcaagatctaaatcgtttcagtttaaacatttcccatttaaaattgtttaggtttctagtattcatcataatacttgctaaagtgaatataaaggaataatagtagcatccatgagatcacaagtgactttaagatgcaatgataaagaagcaacatatgaggacgatagtcatgagttcgatccttgtgatgtgtttttcgtaagaacataccgaggctgctagtctaagtttgatcctcatgtgtacatgtgtattttgcatgaaaattatatagcttctagcttgcaaccaaggatgggtcatctcgtgagtttttttagagttattcatttattatttattttctaggtccaaatcaaaagttatgtaaaactatttagagggatagatcaaattccaactacctctagctagaagttgacgtatatggataactaatttttgacccgtctctataaaccaacttctatagttggctaaatatccacctcaagatataaaataatttagagagacacatagataaagagtaggagagcatgttgcctttaaagactattttatactaaaatagatcatggtattgtgcaagcatcactccaaatcaacatttttttggagttacatgggattggaggcattatgtatt

SEQ ID NO: 4554 - DNA, 1665 bp, Zea mays
  misc_feature (1)..(100): optimal_loci_169239_G1, chr4:224950283..224951947, Cluster 28
agttggtaatatatagtctttttggccgggcttttgagctttttagctttagcttttctgtagcttaaggtggaagccctagcaaacatctatgtgaaaatgacttcttcgagaatgtagcttcttcgaattcagtagctttcacgaacttgtgcgttgaagccgcattttggcttctactgccaaagaggtccatatacttctaataacgcatccacaatattcacccttcccatacgctccgaaatttacaattagtaattcagcatggaaataccctacactagaaaaccgatctcgatgtctcttgtctccacgtcttcaactctagcaaggtaaaccctagctccctaccatcaaagtggctagggccacctatggcttgctggagattggttggaggtgctttgtggtgcgattagtatagggcatgcactaggtgggctacaaatgcagtttttaagagcatataaaatagattgtttgaggatgttttttattctaattagtttttaaagcatctagataacacatggtaattctctaagcacttgtctatgttctaagaaagaaaaggtagaatactttaaacaatacaatgggcataatccaccaattaaacaattttcaagtcaaaatacgctcgagttataaatgtttcaaccatgttctggattcacaataatgacccatctatgttgcgatatatagtctaaataaaaggtgagtagaaggcgtagaataatggtttctccttgtccctattcctaatcattgaaaaggttggcactagtgagaatccaacataaggaggcagtagaaaacattttggcttctcaacttatttggtagcagcaacaaagggctgagttcccagctataagggtacaattaggatatttgtttaatgttaggtaaagtacatttctcaacctctaaattgcacatcactccaatttcaaccatgaactagatatgaatccagatagttttctaatttaaatcaaattaatcattagtgtttagataccaaatagatttttacaattatttttagaaactagaaaagggggtagtttgggaatcaaattcatttggtttagatagttgaaaggtgtaagttaccggattttgtaattcaggattcaaaaccgaagatcagaattgtttgatttagatagctggaaggtgtccaacattatggttgaaaaatatactttatcctttcaattttatccatgtcaaccaacttgaacaacggtgtctcttgtaataaggcttgtttattgattatggcaaccatagctaaactcatacataagctcaaagaccttatcactggttcaaattaaacctaatgactcacggttttggaaaggtcttttgaagatcaagaaacaatttctgaaatgtggtacctttaaagttaaagatggttgtgagactagattcttggaggacacttggataggttcgaaatcctcgggctagattcttggaggacacttggatgggctctaaatcccttaagtactaattccctagcctatataatataatcaactatcccccatgtggcagtggcaaatgtcttaaatcatatgccattaaatatctccttctggcagcctagtataacctagtagcaaaagtcttccatactca

SEQ ID NO: 4555 - DNA, 2806 bp, Zea mays
  misc_feature (1)..(100): optimal_loci_170300_G1, chr4:229402913..229405718, Cluster 28
agtggcgaaattagctagaccaatgggagaattaataagggctcgttcggttattcagaattcattctcggtaaacgattctatctggaacgattgttaatttatataataatcaaacacctagaacagttcctagctagctttgttctcgggtaatcggttctaagggctggtttagtgacaaggaaaccaagagggattagagtgagttctaagagaagtggttggccttgttattagttagaggctgatctataggggtagctagctagatggggaaagtgcactccatgttatgcaaattagtagttaaggtccgtttggatgttggtatttgggtccatagaattgaaatagttctaatgtcaaatctgagcgggttttgaaatgggcctgaaatctaatactggcatctggatgcctcaattcccataattctatcaatacggagggtcgcggctcggttttggaacggggactggttagctagcttcaattccctgcggaaacgaccgacgtttccgttcttcaattccggaaccgtccaaacactcgaattttggtgggttgtttccaattccgaacttcaggctttaatatagacatccaaacgggatgttatattaattgcatttcatgtaatctagctgatggacttctgctaaaaaacttggtcgtccacctgacctgataaagcattattagtgattctattatcgaataatcctcagttatttttataaaatactagctaaccaagctgatcgaggcaatcgagcaattaatgatgagctgtcgggcggttcgtctgctcgattttgcttgcgcagttaaggtgacaggaactgctggttctgagttgccatcctatatatccgaaaatgaccgctttttatgtagcaaatttgaaggaaaccctataagtttgcatgaaatatctgctttgttcaggcaacgtgtggtccgtccatctttgcttcaagacctgtgcatcctcgaagttttcgaggcagccaaatcattatactatatgtcttatatggggggtggtaatggttgatgcttacgtgtcgtatatgtatgtctatgtgcattagatcaggacggatgtgtttagcctagatcggatgctttgtgttcagaatggatgcatgtctctatggagggttcttcctggctctctttatacatccaggggctagaattctactgcggtaggttaaaacaaactataaataaattgtactggtttattttcaaaataataatatcattaaaattcaaggaaactggacattacatgcaaacgagggtgttaattgaggtactaccaacaatatcaaaatgtcattacctactgcagtaggttaaaacatccacttcccatgtcacaataatccccacatggagcaggaagactagcaacgtaacgctcaattttattatttcatagtacaacaaactgaattttagcaagcaccaccatattattcccctgcaaaattcctttttccttatgacgcgaaatcgacatgatttggccaaccatattaaaatagggtggtggcgaaggggatattctccaaagaggtcccgttttcggagagttggcagcatggtgtttggccagtttggtgaaattggagaaaaacaaaacttggttcgttgcttttacaggtcaacgggttgaacctggaaatggcgttgatgcaggtgacagtgtgtggttaaaaataagctttcgtcgggctcctgtagaaagttgtagtcgtaggttgcttcatctctcagaaacatatgcaggttagaaactcaggagcttccatgttgcagatacagaccccaggaatcaaggatcatctggacgtggatcaattgcagccagagctacgttctcttattttatctgtctagattatataatcgaacaaatttcgaactaactggacaaattataatctcagacaaacaatcccttagtattggtccgcagcataagtttctgctaattggtttctcttaacttttaaccattagcattacaatcttgtcagatggatggctctcttattatgtcgtgcttgcagaattcactatggtgtgtgttccaacgattcattaagtatcatacggggaaaaaaacaagattttagaatggttgtacaattgaaaatgggttcacctcaccaaagctggcaacaaccataacagaagagaccctacactacactacactacaatacaagcaaccgatccgcagcccgggcagctttcagggaaagagaagtcgagaagaccacatgttcctggagttgcagaagggacaaggaacttggaccaaaaggaaaagaaaaacgaaaagaaaggacaaaggaactgttctgaacagcaattcaaacttttgcatgttcagcatccataatttgctttctaccggcaactgcagaatattaggaggatgctcataaatacactctaaaggaactccataaactacacgatagtcagatggctgggccagaacgctgaccagtgaccactcggagaaattcaaaagtgcagctagcttccttggttgaactcaatcggtgatggaatatttgggggttctgtttgtttgcaaccgggggccatcttcgtttggttattattgcctcggtgtgcacgtgcccagattttgtgggtcaaggaactgtagctcagttatggtttcgtctagccgtgatttgtggtgctccacacccttgtagattcgaccaccttcaatacctcattcgtatggtcaatcaaaatatagttttataat

SEQ ID NO: 4556 - DNA, 2561 bp, Zea mays
  misc_feature (1)..(100): optimal_loci_173344_G1, chr5:5491325..5493885, Cluster 28
acttgtcaatcactggcaccgtaccacacatttttctagagccacagcttaattaattaaggtctgcacatcgcttttccttatgtatgcttgcatagatagagaagctaacacagggtaggttcctaacatgtgagttaaggatgagaggaaggtctcagaagttctggggtatctaacccatattattgcataaaaaatgttgaaatggtgttgataatacgatttccaaaaatagatcatgatatattattccaatcaacacacaaaaaactagcaattctacaaacatgcctcagatatggacatgaataatctcaaccatagagtgccttatcctagagtgtcttaaccctatatatagtatccgtaacggatcgtataaaatagtggatttgcactgtacatttatattttcctcctgcaacccactatcctaataaaacatacatttctcttccactactaccacttactttatttcttttttcactaaatcagcccatatgcactatgcacgtcgtagggggctgttgtacccgctacagaagggggacgtggagtagcaaccgttgaagacaacctaagcataataacgcacaccctagcctaaacttgagagggagaaaactcgatctgcacggaataagacactccattacattgcattataaaaaggttttttaacatatcgagaaatctcccaaacccctatcccacacataaacatgggttagagcgtgagcgtctcggcttaaacatgtgcttttacatgagataaatgagggtatttatttcacatcagcctaaaaattgttcacataaagagtcaaaactagaatccgacaagcgctacccaaaccaacttgctaactcttaaacaactaaccaactcagtaagagactcttagaagggatgaagggtgagcaaatgcacacattaatattcttttaaaaaagatctaggttgattataccagcatatattaattaatatgagagttttgtgcaagatgcgcttacaatataatccaatttctagtagacctctagagactggggaaatataatttatgtactactcattagcaacaagagcgtcgataaatttttgctccagctagaagacttccacatgagggcttcatcgtgtatttgagagaagatgtattctactggcttctcttttttccgaaaaattatttcatcattcaattgcttcgaaacggtccacatggttagaatagccagagagtgcgctgttttgctgcccttgctgacggctgaccaagtccaacatctattcatgcagattggatgtttcagtccagttaggtttgtagactggggctggggcagtcgctccaaactctcttagtccttggttcgactccttgtggtcaagtacatgtgtaaggctcggctccgtatgtattggtggggcagggttctgaggacttgacatgtgtgtagattaatttttttatgtgtataaagtatgatacttaggaagcatccaattaacagcaaacaagtcaacaaataattagaaagaaacaacaaaatattatatacctgagaacattcaagatgataatttcacagttcaatccataaagaaactttagactcattccgttaatgaaaaaaaatataatccttgttttttaaaagttaaataatttaaactttaactaaagttatataaaaaattaaatttattttataaaaaagtatgatgggattataaaacaaatatttagagatagaaaataatatattaattactgtaaattaagtgaaatttattctaactctatattacatatataaaatgaaaagtcaatgttgcttaggttacctaacccccgcgtaggtgagtaataggcatatttccaatcatgacttgatgggcaaaggtcatctcattctcatctgtcaccaccagttggtcagcgaggaaagttgtccaggctgaattcatgagtcaatccacgccagcctccaattttatatttcttcgaattgctatggccctattattagttctgttgcaaatatataagatgtatttctttcaagcctatagagtgtttgtttggtcggcagaagtatccagaagtttaattaccagaccaaaataaataggataggaaataattagtgaaggttacttataaagttaaaatcgaacaatcttattaataccctaatttaacctgattacactaatctcttgtacacaacttaataggatcaattattagtaacttttgttagtagcttgatgtaccttagtgataatgatgtgtgtaagaaattcatatgtggagaagagtttttaagcaccctgacaatacatgagcggtgacatgcagagaatttcgaagtggacgctaaacctatacatggctacttacgacgttcttcagtagagtcaacaagtaaatgatggtatcattttcgttaaaggaagcattttatagataccaggaacagtacatcatgaagatacaaagtcttggtacaatttccggcttctgtttagaacacacaaccat

SEQ ID NO: 4557 - DNA, 1838 bp, Zea mays
  misc_feature (1)..(100): optimal_loci_173630_G1, chr5:7248126..7249963, Cluster 28
tttgattatacaatagctttttgccctaacttaaagggtgtacattgaaggtactgatgaggaaacaaggcaacaagcaacaaagtggagtgcctagattgatcattttccggtgaaggggacatacatgatgcaatgatatgataaggacgtctgttctctttcattgattgctctaaattctgcgcatttattttttaattccacctcaggccaagtttaaaatgtgtcctgccatgtagagttagtttttcagttttattaaaaatagcctaacctatttttaatttttatttataatcttttggtgcgacaaaatcatttgtacaacaagatttgtcaagttgggagcaattttcacatgataaacctatgactccactgctgctggtgtgacagtactgctctaccactaccacgacactgggaatggttcacaagacacaatctagaaaagattatatcttgttggataaaaaatgatttttataggtttgtagattccatgacacctataaatttctacttttaaattttgttatctaaggtcactaaaatgctcgaagaataatataaaatttcaataacacaataatcatgtataagcatttatcgtcttagaaaaacaaatttcatagtgtcaaacaagcatatttttctataaatattatagctctcgatgatatttacatctttataattttaagcttttacatttgaggttgctaaaatacacaaaaaacatatagagtttcatcaacataataaactgtataacgggacttatcatctgtcaaaagtcatatcttttatgtatgatatcaaataaatatgtcttttatattaaagttatagctattgatgagatctaaaactctttagttttaagtttttttttaagattgttaaggtgctcaaaacataatatgaattttaaatggtatatcaaatgtgtatcagagctgggtgttgcacccaatacactggtacggtggtgcccttctaatgctatatcgtcaacgattataaactagatattaaatccactcaaggttagcgatgggacttgaagtgagattaaggagcccaacaacgctaacttgaacatgatatcaatattttttttaaaaaaaatggcttatgctaaccttcttcacttctcaagatgatatttttttctatcaaaaaattacatatgcagcattattttttcataaaaatagagtgcttaatgttcatatgtcctaatgtttaggccaagatgcataaaattatctaaagtaataccttatgtaaatcatcatcatggggctataagagttttttaaatgagttgtttgtgccaatggtatggtctccaatggtatataatgagttgttaaaggaactttagccattactgctgaaacatataaatacgatgggacaattagaatgatcggctattgttagtgttgacagatatacgttaatattatacttcttttcaagagaaacacacgtacccacctccaacggccaactgattttatactctttttcctcctccaataactgtggtagaccatactacgtactatgttcaaaacacggccagcagcagcagccagcagggaagatgggaaatcacgaactcaataatacagataagaaaaatataatatcttcctcagccatgaaaaagacatcggaaaaaattcagctagagatgaggcgtgcggcttcttctgtttcgtagatgcgatgaatgtactgatttacaccgcgtcatacaatattatatgcagaagattgaacatggataacaatggcgacgtccgaacgcctctgctgcaact

SEQ ID NO: 4558 - DNA, 1537 bp, Zea mays
  misc_feature (1)..(100): optimal_loci_174367_G1, chr5:11886414..11887950, Cluster 28
aaatggagcaccgccgcccattcgccgagcccagcggctgggcctcctcgtgaaaagactcccagcggacgatgcagtggcctttcgcgtgaaaagagacccatcggccgcgcgggacccggcgaattttcaccggcgagacacctgggcgaacgaggtgatgccgcgcggggaaactagagcggcccgtgcgtccacgccggaacagccgtccgatgggccgccggcgcggatctggccgctccctccgcggtacgcgctgtcccacggccacgagcgtataaaggcgtcggaatcgctcggttcggttcggttcagcgagtggggtcgaatgcagccgggcagtccctcggttctgcggtcggccgcgcccggcggcgacgcgtttggggcgcgcggcggccggcacccggcagcgggctttggcacgcgcactggggtttgttcgcgtccgaaacggaaatttgttcgaaccactgatagatgcccgagcgcgagcgcagttgttcccgttgttgtttaagatggataggacaccgcaatgttgtttatcttggggctagatttgacgtggtttagatttctgttcttgaatgagacaacctgtgctcctctttttttcacaagcctgacggtgtgtccgtcctttccgtttgatagttgttggtccaaaaggaaatgaaaggcattttattttatcattagatgctcatttattgcattgtgttaattatagggtatgtacaaccacattaattaaagtgtctcttaaagtgtttatataaggttaagtgaaaaagatcaagaaacaagcttttcgtgaagggtccgtttgtttacaactttctatactaaatgtcttttaaatgcatttataatctaagagcttaaggttgtatcatgtaatttctaagaacatttacaacccaaataaatgacttatatcttaatgtgtatctaagggtgtaaatgtaaaaaagcaaaatagactttaccttggcgaaggaacgtttctagcacggttctctaattttagatacggttaaactcatgcaatccagattaacgagttatatcttgaggtttctagtgaataaagaataagtcttagatacattaggttgtataaacgagtttttaagtgtatctagtgattggagaaccatctacgatgtacatgtccatgcccttacatgtctcttgtatttagaaaaaaacattttgttgtctttaggttgtacatattctaaatatatatatacaactttattcaatttaggatattttaagagttctctagaggtaattgaaaaaaatacatttatggtcttcggattgtacataccgagaaatcaggtcatgttttaaacattagatttttcccaaatgttatgtctctttttgtaaaaataatttaatttctgcgaaatatggccaacgagaataaaccaggactaccaaaactttcaagccacatatccttaactgcgtgacgctcatttcttaaggcttgtttgggttctctagaaataattgt

SEQ ID NO: 4559 - DNA, 1473 bp, Zea mays
  misc_feature (1)..(100): optimal_loci_176454_G1, chr5:23002094..23003566, Cluster 28
caaagtccaaggccactttattacctttacctaggtgttaggagaagatttccagaaatctcgctgcaaactactacactctttgttttcccaccacgcaatgagtgcacagaacctgacaaacattttcccaccaagctagctcgtccgccatggacgtgtgacgtgagtacttattcgatgcattggtttcaactgttctcttctgtgcaggaccgtgaatctaatcctcactacctaaaccccccaaagcatggtattctagggcgagtacaataacgtactactatcgtgaggtctcgtaaggtcattgcatcctgtgctatgtagcatcttttacgacgtagggttgtggcataaatatgatagtacgaaatattattttacatcagttttcactgctattaacatcttcgtataaagatatttgagacgataaaaccaaactagactatatagaggacaggctacgggtcccactttcgagaccggtcaaatccacaagaccctcttgattgctggtttgatgaacagaaatcaagagaggattccacagaagagaaatttctttgctattcaattttaaataaaaaatgaaatcctctttcatgatcacttcatgatttctggtcatcaaatcagacctaaaggtacagagagtttaccggacccatccacgcgtcaacacaagggcgtccccaccacatatgcccttcgtatcaggcttccatccgtaacgtctatcgctagcctgtaagcgtggtccccttgaagagcggacggcgtcaaggcataatgacaagcattagcttttagcttttgcacataagaaatttcacaattaggaaagccggagctttaataaagcgaatgaagaataaatacgcatgcaggcacacaaagctaaaagaaaagaaaaggacaaagaatcatcatgtttttattacaaaaaaaaatcaggtcgttactagactctaaattaggtgttcaattgttcgcgtagcgcgcgcgccgaaaggcttgaagagttgcaagcgtttgcatgatttatgaagacacgtctcgcgacggatttcgtcaatcccagatagtataccatctcgacatgggtacacatgttcacaaaacggagagtgggcagatagtggtgaaaatttggagaggaccacgcttctctaactagagatgataatcatgataccatgcaagacattattacagagaaagaatcatctcaaataaatttctcgacgaggatagagatacgcagaaacatctccccgggaggatgggacggatgcgtatggggagccattccctaccataaacctacggctacggtgtatcactttagcaagttaattgatatctaaaatgtctttagtttagtgatatagaaatacattttttaaattttatgaacccaagtgacatacccttgactccttgagggccgccgttacatttaactct

SEQ ID NO: 4560 - DNA, 1486 bp, Zea mays
  misc_feature (1)..(100): optimal_loci_178199_G1, chr5:31876458..31877943, Cluster 28
attccaacttccaagcgcccggtcccttctcgtctcatcaactgaactgtcgtccttgtttgtttggtttcccatggcaacttgcagtccggccaacaagggccaaccgccacgaaacagaccggccgcggccgggctcacatgccgcgtgcatgtactgccgagtttcctactgccagtaccagccgacaacccaaaagacgcagacgtttacgcggctggggttaaattcttgtatccatcaagactccaagggaacgtttaaatcacgagaactatgatggatttttattggatttttacctgattttatttagtagggtgcaatagaggccgtatgatatgacacacgcttgggctggaccgagccaccacgagagatggtgccaagtctcctagttcagtcactctgataatggcctgagcctgactactgtgtggttcagtacactctgctcgcagtttcatagatattttatttggacggccttttttttatggagcccctagctgagcggaaggtgacaacgacggagatgaccaacgtttggaaactatacctattctttgcagtcatcacatgcatgggacccagagccaaatgtttgcaatgtaccctatgcatggcgatcttcacaaaagaaaatggaaccaattaagtacgtccatgcatgtaccatatgggtgatgcatatgtgaattattaatagcataacatgtactccctagcttagctatttttttgttcttatctcttgtcacacgagcatcgatgcagtagaactagtgtttaatataaaaaaatagtgtctgaattaaaaaaaaaaacatagttatatcgtcttatatattaggatatggagagaataacagaggattccatataagtactttattcctaaagcaacaatgcctgcctatatcttcgacacaaataaaaaaaaaataaaaagccgtaacggaaaaataacggatcatagggtatcatcattgcacgcagatgactagatgagttctataaacctggacagcaatcgaaacagacaaggaaaaacgtgttttcgatggcaaaggtgcagtgcagacggccgcatctgcgggaagtcgtagtacatgccagcgcgcgcagcacacatgtattttccttattattgtttcggatccaaccaaattgcacgtcaacaaaataaaaatagttaggtcaaatcgaacggccgatgacgctaccgaggaattgaaattctggtactctttgcggtaccaaatttgtcattttctcctatagccgagagagagagagagaaaaaaaaactgcaaataaacagtagccgcactgcacaagctgctctgctctgccggcagcgacgactaggagaggtcaacgccctctttcacagctaacgtatagcactatagctacgctatggagtgtctcgagttgagtaaactagtagcaggcaaagccacacaattccaacacgacaaa

SEQ ID NO: 4561 - DNA, 1415 bp, Zea mays
  misc_feature (1)..(100): optimal_loci_179635_G1, chr5:39452927..39454341, Cluster 28
aatttcgaatttcttattgtgtccacttcttatcccattagggcacatttaaatagaggtaatttgcatccaaatttatagggtttagttacgtttgatggaagtgcccaatttactagtacagtcctcttacaacttattcccttgtattggtccgataatcttttcttgttcgctactatatctttaaacaatgattgcttagttattgatatgtgtaacatcgttttgattgttttcggcagctgcagttgcacagcaaaagcatttaggttgcatgagaactgagaaccgcatttcaaacagacatcagccgtaaggaacttccccaaacgcattaacaaagtaagcattcttgaatcttgatgcattgtcttgaagtttaacaaaagacggatctttgttggatgtgttggtgacggtacctcagctaatgtttggagtgactaatgggaaccaacttgtacctggctgcaaacacattactgatcacaggatgtataaattataattatggaatgcaaagtcgagcgtactttgtggctgacagagcttctgggttgcagttgcaagtagtgactgggtgagggataggttttttttttttttgacatagcttctgatgtgttggcaaatgacaagaaaggatagagcacagagcggcgtccaagaggctgctgtatgatgaacagaaatacttaaagcaaagcacaagggagtttctcgccctctctcgattatgcccaaactgcatttgctcttttgtcctacagcctgaactggaaatcagttgacaagcacaagggagtctgagctattgtgaaatcggacatgtgattgtggccgaagttagggatacaagaagttaactcagggcagaaatctctccgatacaggcaaagaagagcttctctactgaagtctggacattgttttgtctcttttagtatgcgactctgcacttcgatggtccatggggtccaaaaggaaatacaagcttttgctcataggaggttcacagatcgagtcaacatttcaagtgaacccacatcttagccaacagcaggtagactctttaagaatctggagtagcttttgctggtgagccgaagtgatagactcaaagatgtttagatcagattgtcaagtgctccgaaattagtcagttctattctatcatctcaggccagagatgtttttccctttgctgctaaggctcttctgttgaagcagtatggtttccttcggcctttccctcgccagctgcaagcacagtggtcaaccctttgtacttgctgtgcgtccgacgatgccaatggctgccgccaagcaagaaggcagaaaagaaggatgctgccatggaggagggagaaaaggggactgaatcactgaactgagtttcaatctggtaatgt

SEQ ID NO: 4562 - DNA, 2022 bp, Zea mays
  misc_feature (1)..(100): optimal_loci_182684_G1, chr5:58756442..58758463, Cluster 28
ccggaaggactcagactctagagacctacaactacgaaacgaacccggaagtacgcagctctctcttggtcagagatcactgtctctccgcttttgtcaggtccacgctttgacaaaaattttttttttgggaactcactcaccaataatatgtactagcctttggcggccatcagcagctaggttgttttcggtcctgcctgcctgctagtccaaggtcggaaatggtgcgtgccactgccatccatctagtcaggcttggacgccgctttacgtgcgggagacttctgttgctgtgctgtgcctgtgcagcaggggagggggagagaggagcgcgtgagacaaatatatatctaaggtaacactgttcattctagcacttcacagcagtgtgtctcctatcactgtcactcaacatagtgaagcttcaagagttccccttcaaaattccttggtcagggtgacacatcgttttcccagtcttgtggttttggttttcggtagaaacgcgtgggtgggaacacaacacacactgggcctgggtgggcgatatgaaaaagaaaaacaatataatacagctcccaaagaacgtggacatatattatagcgaaaatgaaatggcgcgccttctataaatcttttcccctcctttcccgttgcaagtatatgcgatgcgagagagatccgtatcagcgcgacggatgactaaaaggacgtgtgggttaggaacggtgccgtactgtccgccattaaataaccgtggaccataactatacgatcctggccggggaagaagagagattattattattattactattattattattattattattattatataatataaaaaagcccttgtggaggacgggtggtgttttgcattttatgactccaattcctgattttttttattaggagcaagagtccatgctgagcctagaacagcaaaggatgtgaaagagtggttagttatagcaactagagagcacgtcgactttagtggggggccggctcagcatggttaaaagtaaagtgacgccttatagctaggtattgtagtgcccccactttgattagaggtggccaccacccacgtgcggtagtagtggtagtagttagtcgcatgtcccaggaattttgaactgaatatgcctaactcccatcttaaactagtgaggatggaaattgaagcaaaggtgctatacgcacttgtagagtggagtgagggcaatgcatgcttcaagcaaattttagaaccgagatgtcacgcatgcatattattgcatgcagtacaaattccaagaaatttgttctaaaaaaatagggctcaaggtggtatataaaagcaataggcttggaacagcaattatcctgtaccatgcaaaaccaaacacagcggatttttttcccttctcttgtgccgtacgagagcactgagcatgctgttggatctgtgatctttcttttttttttgcattaacctgctcaggccccaaagcagagacaatcagtctacatgtatcgacgtacgatggcaccataatgaggcaagcacaccagcaccaattaagaccaagtggtcaaaaaaaaaagccaagcaacttttataataatggtattcagattgaagtatttgtatatgggtttctcaacaggaagcacatgtacaatgtgatgcaaaaattgctgcatactagacaatgcaaaagccctttgaccagcgaagccctttgatcagcatgccatgtcgtcgatcctgctccgtatgattgcccacaaaaggcatccgatgcgcttcccacatccagcttggcatgcaaaagaggagcgcggaattattccgatcaatttatttacaacggtagcacagcacagtataggcatcacgcagtatagccactgcgccatactaggtcaaaactcatatgccgctcttggttgtagtagtacgtatagttatggagcatagcatggggcaaactaattggagcactaacgcgcaagcatcatttttct

SEQ ID NO: 4563 - DNA, 1436 bp, Zea mays
  misc_feature (1)..(100): optimal_loci_182953_G1, chr5:60809529..60810964, Cluster 28
caagcaaagcctgcaacaaggtctgaaacgggaacggctagctagctcatggagacatggaccaaccaaccaccaagacaagacaaaagcagtgggaggcagccaatatggtctgctactgctatatgtatctgtctgtctccttctaaagcgcccaagtcagcagcggaaaacaacatgcgtgcagcagatgcaaccgaaatacaacagaagcaagcttttacatgtaggctgctgggctctgtctgacgtggtgcgtgtgcgtaaacaaaccggattgtctagtctctgaattccgatgagaaacagagaaggtgacaggatcgtgcggaggccatcgacgtcccagtcacgcccacgtggtggtagggacgacagggagagaggaatatgtggagctacagtgaacagatcagctgtcacactcacacacacacacacaaaatggttgtctccatcgactgcaactgaacggagaagggcgcgatccgtagtagtgtatcttcctttttggatatggttgccggccgtgaactatcagtctttaataatgcttgttttttttgttcctcgactctttatttcacagatactctatctgctccaatttataacccgtctgatttttttacacccccgattcctcttatttaatatatatatataattattatttatttttactgtaatatggtttagcatataatgctctaataagtatgtattttgatttctattttttttaagaaaatgaataagacaagccagttaaatttcaagtacgaattataaattgaaacggagggagtatgtgctaatcgtaaacaatacttgttctcctataattaaattaatagatgtatctttctttataaaaaaacacaattctttgaaacatggaaaccatgcaaggtctttacacctgtattgaaaaacgtagtaccaaaagaaaaacggtagttcattgttgtataacagtatcagggtacgtaaaataccaaaaagatgaatttacgagagagcaagacatagaacgacgattatgttgaacctagacacaatttggaaccaacatgcaagctcatggaccttgggacctgcagagggctccaagcaacttagtgttagtgtatgttctaggggaacgacaaccccaaacacctgaatcatttagaagtgcttcgaggcacatgaggcctcagggacttcatctcatgagcgccctaggatacgaggggcccaagagacctatactatcctagccaagaatgtcctaggacactagggcctcaggccatagaatgccccaaggcttgcccatgtccctttatcaatccttatggaactttgtagttatttcttatgtgtgcccgatagcaagatacctaatgtcaagcccatgccctcgctggggcaaggggaggtccctagagcat

SEQ ID NO: 4564 - DNA, 2593 bp, Zea mays
  misc_feature (1)..(100): optimal_loci_184746_G1, chr5:74911664..74914256, Cluster 28
aaaaaacagacccggctggagtgttggactcgaactcctttgattaggtggagactggagacattatgactagatttgggcgttggttatctcactactaatttcatgcatgagtgcaagtgtcagcttgtcccataattaagacctggaagcttgttcaatttattatgctaaacaagttggctttttgtgaggtccatgctttcttcatctgattatgggaccctctgggcgtacagttttgcagtactgcctcttcactggccatcttaatcaaataatcaaaaggccaatatcaactgctataaaatccaatgctcaatgatcttacgagcaatctgagacgcatacatacgcggttcgagttttcacacattctgaaatacgatcgagtactgctctagttggcaaacagacaaaaaccctgattgattcaacaagtctgcagcgaagccaagaagcgtgttgctagaggcatgactgcgatatggaacagcagatttgaaaccagtgaacactgacgctttggagagccagccatgtcaaaatctgttgcccccccttttttgatctgtacatctcttcaaccacccaaagatgagggataacgtgcagctttcgagcactgtagctcgacagtggggcttggttctctaggcattgcatgttgatgtgaaagagatacggacagacagacaggcagacatggagcatgtaatcaaacgaaccatctggagaggcggcgttcgtactctataagaaaatcagtatttgcaagcagtgaatcagttaaaatcatattggttttttccttgattcgagagaaagggatcgccacaggaggtctgaaacagaaccggcgacccaaggatggagcaacgcattgacagtctgacagtgccgcttcggtcctttcagggcaatggtggtcacagtcacgtccgatatatggatttgtacccagagaagcttcaagcactccaagaaaaaaaaagcttggattgttgagcaaacacagccaagtttacacgcacgcaacgtaacctccgtttccaggtcgcgaagagcgacccgatgtcgggaatgcgctagctttattgctgcaaatgccacgaacagcctctttattttattattgttctcaagaaggtttaaagcgttcttgtgagcaaggttattacgtaacttttgttgtgcatccagtcacaggccatgatcttcaccggctggctggttggtctccagacgtgtctgcgtctgcgatagccgataggctcttgcaggtaaatccctgccccatccttcggcccccactgttatgaatgcacattgccccccactgcactcataagactaagatggcattgcaaccgctgcctttgcacacacaccattgcacccccctccctttcttgaacactagaaagcaaaaccctagcactgaccatggcaagctgcctcgttcaccacggaacggaacggaacgacgccttccatttgcgcccacagatgcttttgagcgcctactagaatcaaacggtccggccgggtctctgcgaatttttattttatttgaaaaaatcttcgtgctttataaagctttcgtgggggagaaggagtctgaatttcgtcaggatctggtgcagttccacgtggggattgatttgaacgaccgtgattataaagcgcggctcacctttcgatcaacctagtattccttgcttgcttcggtttaaaacccaccctaaccagatgcatctttcgatcagctgtggggggaatccagttaacaacgactgcatctgaaatctggggagctgtgcaaaaccactggcggagcaatgtgactgggaatccagttaacaatgactgaatctgatctggggagctgcgcaaaccactggcggagcaacgtgaccgaacatgagcgcggcagccttccagtgcatcaccggccggccacatgtggacagattagcgcatgcgtaagtgcgtaacccatgtccctaagcagtattcaagcggggcacacgggtacagcccgcctcggtttctgcgctaaggaatcgagagaggtcttattcatttcttctcaggccatatccccccaccccgatcaaggcatgtgtatctttttttttacgtaaaatatctagcaggacatattttcgcgtgatagcttatcgtgcgcacacgaatgaccatgccaccgtgctttgattgataggacctgagctatacactgttaacaaattcttataaacagtcttatactatatgccagcatttagcgccctttgctatgtgctacataaaacctcgctctttattctacgcgcctttattccaagtcttattcggttacttgatttcataattttaaagtttttttttaaaaaatctgcacaacctttgcatctctagctaggaaagatatttctaggttcttttggttacttgtgttgtaccttgctttttttaactcttaattaaagtcagagctcctggcattacgtctaggttcttgttagcaatatctgtgttgtttgggtgctcatccaaaataaactcctcacagcagacaacctagcac

SEQ ID NO: 4565 - DNA, 1689 bp, Zea mays
  misc_feature (1)..(100): optimal_loci_185230_G1, chr5:78768369..78770057, Cluster 28
actctttttttttgcatatcagtatattacgaagatactattaaaacattttatgctgattgccgaacattttagcttcaagagtttataatttgaagaaattatgtttttgagatatctgaagcccagagtgatatatcatatggacaaatgtgtaagacaaaaaggaaatagacgtttgtaccaggcttttttggacctggacctacactgtacctcattttatcatttttctggtagctgatctatatattctgcaagtgtacactatttatctatttaacttttaatttgtgttcttttcatttataaacctttgaagcttgttacttatttttaattgcacatgctgttctcttattacaggtaaatcagatgaactgtctttgcacagaaagcttggctgctctgattttacattggcttctttacttgattttccaaaatctcctgaaggggacgttatgtcaccttgttttctcggtccagcggaaataataaatctagtaaggaggtttagtagtttgattatgcatggaggaaattttgaatgtgtacacactttcttgggatgcacaattaatctatcagctgttctcatcagacatagtcagtatgaagctgctcaggtactatattttatttttggactaaaattcattagaaacatattatgttttatttgaatgttgctcattctatatagtatcaggctatcagctatcaaataagctctgcttatcctcatttttatctctaacagaatctgctgggaattctggaaacatacttgaacaatggaaaagtatcgcatactggtcaagatgcagacactgcatgttcagcatatcttcatctcaatggattttgccttctgatgattgcacatgatgaagcaaatattattttgagagaatccaaggttcatgatgctatccgatgctttttcaggtactaccttttcactatgcgaacttgtggattgagccttttgattatcatcaaacgacacttttctggaaaccgtctttagtggctggggacatcaatgatttatttttcctattgtgatactagacaagaattatgtagcataaacatatatgttattgagctattgaaaacaaccggacctgatcagtctaactggttatttaaaagcctaactgacagaccatgtgcttgatctacttctgtttaagttaagtggtagttgataagatatggttttccgtccttaaccccgcatcatgtataaaaatcttctttaactagatataattactagggaagagaagtacctcacagtcaccactcaccagtaaactggcggtcataaatctttgtggtagcaccttgcaatgagtctgatacttatttttgtaaattctatagaattgtaagcacaattgtagttgttactttatgaaatagcgatgcagagcaactcatctttgcccacaacatttgatttgctgtgttttgaaaaagaaagggattgcacaccctttattagaaatgacaagtaactaagtgagcttgttatcggcatatcattaggagatctgcttgtgtcttttgttaaatatcagcaagggattttgaagcatgcaatccaatagtctaagttaatgttttctggtaggaatcacttcatttgatttagttacctaattctcaggtcttgtg

SEQ ID NO: 4566 - DNA, 1412 bp, Zea mays
  misc_feature (1)..(100): optimal_loci_196864_G1, chr5:155248977..155250388, Cluster 28
ttgcggaatggctctcgaagcacgatttgggaggcaaactattggcagcgtattctccgtcgtcgcccgtttccaggtccaggtgacggtgtcctccacatcaggctgtgcagctgtacgcgtcccggatctgaatccatagggaaataaaatttcatagaatttgttttttttttttgtttcttcttcttcttccttttgccattcctaacagctcacagcatccgctttcggtcgttaggaatggcctccttcctccatttgccttgtgtttttctttctttccaaagaaaggatctgcggaccctctcgatttccttcatatatggccgacaacacccaagtggccaaccaactctcggtcgggtgcagcttacttgtaaaatctgatgtttttgtgctgatcgtattttgtaactcctttctgacaattaatggaaagccttcgtcagagagatcgatatactactcttcctattatacttaagcggttaccttaattacattgggatcaaactcagcaccactaattaaccagatcaattcactatggactgaataatatgcaagcggttttctgctcttgttatattgtacatagtatatcccctcccacacacacgagggtccatgtagcgtggaggacacagtgtcgttttgcacaaaagccatgatcccattggatctgcagagccttcagagaaagctacatttttgttcggcacagatcgagctgggcgccttcttacgtcttaattgtgacagtgagcggattactttcacacactgtctctctctaggagtgattaaaaaaaactactgtatatacgtatgcaccttaaccatcatcataaaaccagaatctggcttttatgggaaattatttcatccatatatttctgtgaacatgtagcatagcatatgaaaagtgacattagcaacaaaaaaaagcgtttatttggcttacacatactacacctatagtgattattcttggcatgattttctggcgtttctgatggacatctcaagcgaaacaataatatatgtcgtacagtgagatttcatggtcatggatatatgcacagtcattttttctgccagattccatatggagatctatgcatggagaagcgactgtaccattcactgcgatggagcgtcattttgctcaccttttgtgctgactttctgctaataatagttcattaagatgctatttcataagatgacgacatcttggtgctttaccaaactgaccaaaattttgaatcaacctatagatcatagctgcatgcatgcattattattcttgcactagatcggcctgttcatgcgtcctctgaaataggtggcgctggatccaatgttccgaagacaacctctgcaatctagctatgattcaagaacca

SEQ ID NO: 4567 - DNA, 2004 bp, Zea mays
  misc_feature (1)..(100): optimal_loci_199396_G1, chr5:170255348..170257351, Cluster 28
ccgcgaggctaaaaaataattggcataaggtctccaccctgacatgaatccaagatctcatgcattatcttgtgtgtagctttccaccacacccacgcaataaatctctactatattaaaacacatgtttttctagtttcacttccactgtcaccacttaaaaaagaaaactcttatatttatttgtattcaatccgctgtccctctaagtcgatcggaccacgtttaaacatttaattagtaaatagctaaaattatgtataaatatagatttgaacctacttgataaacgtggctaaaatatcacctcttaagacgctgtgaaccacgcaaatagctgcactcaatgcagctttagttttgcttcataccacatagcttgaccatgcaaattccagtgtcaaatcatatgcgtacaatattaaggccctctttagaccactatgactactttcttgtgtctagtttttagccagagtaatcaaataaaacatgctcgaacattgctgccagcgcttattgcaagttttcatcatttgcgaaaacatgatcgctctgagtagggatcccaagactagttcaattgaactaaaagagttcctcgaaaggagctatgcatgcagaagcagaagatcgaatagacttcattagtttattaaacagaccttgacagtgtgttggcaaattttggtcacctgtttgtgtctgatgaaattttggtgagctgaagcagtagatcttgtttcggggtttcagagacaggtgtgtctgatgcatgaaacaaaatttccagcgaccatgcattagaaaatgaatccaacaaaagctggaattcttaaattttctaacctgcttcaggtcgttcaaggcttccattaattattagacatgcccatagcagctagaaaggaaaacgcaatatagctagctcatgggacaattccatcccactattcatgggcagtcgggtacaaccttgtctctactaccatatttttagttctacaactgcaattatgcttagctttattgtttgtcacttgtagcatagtcggcgccatatagtaccatgattccctctaagttcctagctcttaaagctgtagcccatgcccttttagaacttaaattagtaccatgataccaacaagaaatcatggtttatttctacatacctagctagctattgctatgctgtataagttcagaagaattatttttctcaatgaaatgttattcctgaaaagatcaacctctccccctgctgcactgaatacagtattctaaatagtgggctagctacgatatttagcgatcacacttctcaaacagctagtagcaggcgaaatcgggctataatgactaaattgtacatattagcaaatagatttaccatttgcaaatagttacatctagaggtagtagccgctatatatagcgggaagatttagaacactgaatatgctatcataatgtgttcgatagacgtctatgatagaccatgtaataggatgtatcaatcatgtatcttcgtagaaattattcacactaagctaagaaatgggagaaggttaaacgattacagaaattaaagagagcgtgtaagactatcccttaaacacaaaatctaattgaaccttgttttaagtttcggatggaacactaagtccttattaaaactgatctcagtaaaaaaaatgtaactctgattaacctcaacctttattaaaagaaagacaataaaatttttgaactaccacaactgaaatcatgtggattagaggtctagaactcgatatataaaattaggaagcacattatgctagatagaataagaattgattaaaactcttatttcatgattaaacaaaatatgttgagagttaatcatatcaatcaaacttatcatatgaataactcaaagttctagcacaattttggagagataaaaaacaagtctaaacttgagaacaagaaatcaatttaaaccaaaacctggacatg

SEQ ID NO: 4568 - DNA, 3004 bp, Zea mays
  misc_feature (1)..(100): optimal_loci_201054_G1, chr5:179660352..179663355, Cluster 28
aactaatcatagtggggcagggatagattattcaggagaatattgcgttagtggctgattatggtgaaagaaagatgtgtctgatgtcgtaatgcagtaacatggaatagatctttttcactaacctttaagcgcgtttatgtactcattgttaaagtagccgcattgcatttccattggtatattacgtggtgggcctgcataatttatttatgagttaggctatcgtgtacttcgatttatggtgaaaataaataaatgtgtacatttgttgtacctattgagactagtctatgctgatttaaaatacgttttcgagcttgacgagcctcctttttatccattaccggaggagatgcatcataaggacctatcgattaagttgtatgttacaatttagtatggagtatcctgaattggaaactgtgagtaattttttataaaattaaactaaattacttactgtatctatttcttttcggactctatgtatttacaagtgttatttgataatttgggttggctccttctccattggatgacatattgacagagctatcatttggattcggggatgaaccgctcattttctttttaaaacagaatgggttttgtattagtattagtgtactgttgtttcaggtggacaaacaataaaacagaaaaaagatattttttcttgctttaggtgcgaatgtaaaataatggcagttcgtgccttcacatcataggttgtttcctaatcatattaaataaaaatactggcagttcgtgccttcacatcataggttgtttcctaatcatattaaataaaaatatttgtagttaatgcctagttgtggtagtttgggaaaagaaaaaaatgaagtaacggtataactgtagtattagaagtttattaaagaaagggtacatagttgtaaatgatttcaataaaaggaaaagagaatggaatatacctgtagacaaccaaaaatgtttccttcaacatttgtgggatgtagaagtgtaggtcagtaggaattccttgatgtgaaaataaatagtaaaggaatcaatattcatataattcaatgtgtgaataatctgctactaatatttaaacttcacattcatacttaaaaggattgtaactgaataaacccacagtaaaggagttatgtaatttagttattagaatagtaacaactgtatattctttggaaaagttgacgtctcttgtattgagcataagagatcttgagttattagaataataacaattgtatattcttaatgtattcaatacttgagtttggagcatgcgtattcagtaaatcctttttttaatctgctgaacaggcttgctgtaaagagatcttccagcacatatttcaagtcactaacaatgtattgtatacagtttgtagattttcaaattgccatggtgaggatagagtaaagtctccaaaaaaacaatatgcatatattctggagaacaaagattccttgtatagagcaacagatacaaatgaggactgtaaatagattgcattgaagcccaaaacgttgtcaacggaagagatagcacttcaaacttacttaggaagagtaaaagagttctcttagcaattttaaaatatagaaaatggttgtattgtaaacatcagtcccaaacaataatgggccgatacaaaccaaaaagttctcgatacagtaacaaaaaacagttcacttttgaaatgtatgttgatttgaagcccaaatggtgtgaatggaagatatagcgcttcgaacttacttaggaaggagcacaacagtttctagtagcaagtgtaaaatatagaaacgcagttgtatcggaaaccttggtcccaaacaataataggccggtacaaacaaaagaatgatctcgatgcagtaacagcaataactggtcacttttaaataatgagtatacggctttatatgccatcagcaaaatataacgatattttcaacttacaaatagagaagcaaaatagtaccatctaccatatacagaatggaaactaaatgtacaaatgaagaagtaaaatagcaccacctagaaaatgtcattgtaccaatgaattgaacaatttttggatgtgtaagcaaaacaataacatgtaaggaaaaaaatgacattcaacaactgactttgaaacagtagtaagtaatcagtaaatgagatttaagacaggagtgcaatgacaattaatatgaagaatttacacaagctcaagaatttacacctaaatctaaatagcacaaatgaaataaaagcatggttttttgtcacaaacatagaaataaaatagcactatgtaggaaatgtcatttgatgactaatcacaaattgagtagtgaaacaacagcatataaaaaatagagaagtaaaacaatactatgtaaaaaaatgtgggttgttctctttgaaacaatagtaagtaatcagtaaatgggatttaggacaggagtgcattgaaaaactaagcggaagaatttacacctaaattcaagtagcatgaactaaataaaatatggttttgtgtcacaaacagagaaataaaatagcagtatgtagagaatttcatttgatcactaatcgcaaatgaagcagtgaaacaacagcatataaaaaaatagggaagtaaatcaataccatataaagaaaatttggtttgattactgatttagtcaattgacaaatggagtagcaaaaatagcagcatgtagaaaatggcaagcgaccacttaattaaatagtttctagctaatagttgtgtgcatttatgggttgtcttcgtatagacagcagtacgtagtcagcaaaaatggattagaacagaagtgagataaatactgagctgaacagtttgttagcacatttagaagagcaaggtcgataacatgaggagaggaggatggaaatctagccacggacgcgtcattggtttcatggagcgagggcgtgtcctatcatatttctttcttttatttt

SEQ ID NO: 4569 - DNA, 3043 bp, Zea mays
  misc_feature (1)..(100): optimal_loci_203545_G1, chr5:194113935..194116977, Cluster 28
acctcctctcatctgttaagatgcagaaacgatgcagtgcttcatttcagtagttttatttatactagcaagagaggagtggtgggtataaaactcttacagaacccatcaataggtcgccgccctgatccgtccggcccataagtattggcgctgttaacgatttgaaattaaacagaggacggccggggaggaagcgtgcaccaatactactactcatcagtaatctacttgaactctctggggagggtcagctgcctgtgctgtgtttggctttctcctcccaccgaaaggaatgttgtgagagggacagtagtagcaactttctcgattagcagggcgggccggggggtagacacaggaggacgagactacactgtgtttgcgacacccccatggtgtctgtgctgtgtctctctccattcgtgctgcaggagtgcaggggacccatcccgcactctgctgggtaagtcgtttagcatggccacgagaattttccttcaagagctcaaggttaacaacggcagcgtcaaatggttgattgggggcatgagatgtcaacctaagtggggtggaaaagttttcaacttggagttttgacaggaagaaccaccctccctactctatccacatttacaatatggttgagaccattattaacaaacacttcagcttcatcacgccacgcctgctaataaagccttctcaagtggttatatcatacaacatgaggacccttcgcctttaccaaagttagagagacaaaaacggggataggaagcattaagcacgcgcatcatatattctaactacaagagggcggagcgcattaggagtaggctctgtgcactgcacggtggtctgctgggacggcacggcaggcgggtaaagggaaagggagttcctttgtttactccaaagttgaccctcagttgagatgtgtcaaccactagaataatataaggaaaagaaggctgcagggaagggaagggaaggggaaggacagacagcttgctcacgctcatcaatctgagagatgtcatgcgtgaaggctgcccactagtctagtgacccccaacaggttggtggacggtgacagtgagagaggtggaaacaacacgcaccaatgggagttgctggtctggtgctcatttatatatatgcgacaggctatgatatggttgtagttagttgtaggttgcgtcgtggactcctcttgagccgctctcgatctgtcgtgaattcgtgatatgggtcactaataagtcaaaggcactactgataactctgcgtctgcgtgcgacgaagatgatagtcaaaatgacactcctgtcacttggaatgtcacagggttgacattgccctccttacgatatggtcagaataaaatattattagtggcttcagcttcacccccaattatccctccgatccaaggtgatcttgtaggtactatagtacgtacaaaatagcaatgcacaaaatatagtggaattgccagctcgttttttgtgaccacaatctctggctgtgctcctgtaacgatttcgaacaatcaatgccattggagtgctaccagcaacctcaaccaaagtttcaaaaggtaaaaacaatcaaacgaacttgattgagctgaaattttgctcatacattcacatggaagttttaaaaggaggccacaaaacctgagctacaaaggactaaaagcttcagctatagattgaaaaacacactctcaaactaaggttttctcaaaaaatacacgttagctaataaaagtctggaaccattgttaaaatcatccaaggagaaaaactaaacggtttcgaaagatagagacgagagaaaaaaaaacaactctctagttagtggaggtaaatccgacttcagcgaaactgtgaggaagtcaaatgaaagtttttttcccccaaaaaatctgctccaacaagcccctgggctcacccatgggcttttagacgcaaaagggctgtatgttggtaggactggatgtctggatgtgggtagcttcagctcgcgtggtagacgcaacgtgaggtgtggcactgtgcttcccggcccatctaaggcgacagctgacaagcgctgggaaatggacagaatagcctcccgattcacgtgacagaaagaatcattgcacggcgaaaaagaaaattggaatgcccaccctgaaagagacgtcctcaaatctagtggtatacgagtagactcgactaaatctaaattctttatttagatggtatacgaaaagaccccaagaaattcttgtatggctttctcgatctgttcctctatataaaagaattatatgactaagggggtgttcgaatacacgcatgaacaattttctatttgccactttagatagtggtcataaatctcagctcatgacaagtttcaaaaaagattcatatggaagttcaataaatcttaaatggaaaaaatataggggcgagatacatacgcgttcatccatccatctctctatcacgccagcctacgctgtggcgctagtacgtactccagggtccaggccccctcgccctcgatctcgtgcatgcctgccttgtgtggtgcccgtcacgctgtgccaggtaggctgatacacgcacgcactgcaccgagccaaacccagggaatcttggagtcgtagagaagatgaactagctagggccttgagctgagctagccacccgtgaagctagcggtccgagtccggaccccaggcctagctccttttatgatgatgataatctggtctctcacttttatcgttagatcgttactacactacacacggtggcacgtacggctaggtctcgaacaccagcatcatatcaacggcttcgaacggtgtcacgtgcgtggccagcatgtaaagcagtttataaatcatggattgtgataaaactagactttcatataatttacagtggatacgaatcaaaagataataaggttttgtgtagatgttgttggaaaccacctcaatctatatatatgtgttaaggtgtaatttagttaa

SEQ ID NO: 4570 - DNA, 1623 bp, Zea mays
  misc_feature (1)..(100): optimal_loci_204400_G1, chr5:198874826..198876448, Cluster 28
caatcagcccggtaatcatacataaaaaaccgtgagtatagtatactgtagcaattttctacgaaattatggtgataagttccatacagaattatacacaaagtgaaagctaggaaatcggaatttacagaacaaaaaaaaagtcacgggttatctggtcgttcgctgttcttttttttctgtccgatgaaggttgattagtggagtcagagtcggttactaatgtctcgattatctagaacaaaaacgttttctccactactgggtttgttgggcttacacagtgtgataggccttcgttcttcgaatcagaaacggcatacctatacgatctggcgagtacatttgtggtccatgggcccaacaaatccgccgcactgctcgttatccctcgcagcaagttttcgccaaatctcggctactagcccacagcccacccggccacaacacaaggcaaggcctgccatttgtcgtttgccagcccgtttgaactgggactctccgtcggctctataagctggcagccacgttttgtgttctatcttcaggacctatttgtatccttttggtgctcttctattcagattcaatataaatatatcaggtggggacccccgcatgatgaaaaaatttgtaccgtaatagagtctagctgaactctgactgggcgatattacacatatgctaggcacaccattaaagcagaagaatggagagatacagaacatgatgaaatgagcattgcattagacaatacaacatcatgggaaggcacaatcgaaattgcaagagtttgccaccaaattagctgaaacaacaggtgcctcgtacaaaaatatattttgcagagataagcagacagggaaagtgagagcatgagcagtgcacttgtcaggtaaatggttgctaaatggctacggtacggtaaggatgggctgtacataaagcaaattttcgaatcggcacatgggttgtaaatatcggagataactatgtgctatgcaggtaggatttaaaggggagaagagacgctaggttatgtcagccatgtacgtgagagcaagattaagcatgcagtatgaacattgaatgtgttgtgctgaaaattccttaatatgtaggatctagattaagcatgtagcgtggaagaactgggctgcggcttgccattagaacccaaatatcctcaccaacactcacaacccccaaaatgcactgagaactgagtcaaacatgcagatatgacgcaccatcaaaattaaagttttaaaaaaaacacaagcaagcataatttttatcaagagaatcaggttggttaaattctactcactccgtctcaatttataattcatttgaaagtttgatcgactcatcttattattttttgtgcgaaaaataaaaaagtagatccatacttgaagtatcccagtaaagttaataataattgtagttttttagaataagatgagacgatcgaacttcctgtaaaaaagttgaacggattataaattgggatagagtgtgtatttcacaagaaaattgacaacataaataaaaagatttctgagtcctcaacgtgtcaaaaaataggaaattcacatggcctcgatatcggtgcatcta

SEQ ID NO: 4571 - DNA, 1437 bp, Zea mays
  misc_feature (1)..(100): optimal_loci_205578_G1, chr5:205540385..205541821, Cluster 28
gttggagttttcgtcacgtcacccgatttgtttaagatttttaccgtcggctgcgagccatcgatccatatcgtcctgttcttcggactgtcttgctaagtcaatgatgtctttcgcctatcacggatatggtcgctaataaatcgcgatatgcagtggtattgcgtgctttgaccggtatctcatcagacacgactactcaagtgtatagtttgtatacctctctaaagtatcctatttggtgcatggtgccacaccaaacatatcccgtgaatgcacatattgtctcacgcgctttctcaagtgctatatcagatacgtccagtgattgaatagccccaaatagttgccttcgtagctctctaggagccatgttcagttcacaccagataaaatggtattaaatatgactgatccgtgtttggcggcacatgtccgatatactgccaatctaaacaggacatcatcatattggttaatttagttgtggttcaggggaggtgttaggagtaacctggctgaatatgagtcagtcttggtgtaacaagtagtctatctctaatagagctgtaaatgaccaagacacaatatctgtagtagagttgtaaacggcccagatagtcagataccatgagtccatgaatgccatcgtgttgtattctatcttcaactcgtatttggccgctatatattaattagcgtataatacgttgcaggacaatgcatcgcttacattatttgtttcaaacatatgtctagactgtgctcggatactcatggagaattgcggaagctagtttttaaaagcaggctaagctaagctgagaaagcgtttgtttggatattaaactgtaatagtcagcatgttttgtacaacaaagctactatgataccctcgtataaagagattgctatggtgtggtaggctaaaaaaagagaggcatgttggttaatttagatccaaaaactgagtttgttagcttgctggattgtgcagatttggatttcggaggcttctggattatatacaagtcgactgcaagttgaatctgtatggactactagaagctagcttccacaatttgctataatctaaaggtcccaatattaatggagtatattattgcaaccaaacacgaattaataactattcccccgtcttaaatgtaaagtcgttctactacctaaagagccgtgacgatccgtttaacgtcattgcaatttccatcatgtacatcattatttggaataaaagaaaccatcacatcttctaacaattagcatgcatagccatattttgatgcaatgacaaagaaaactgttttcacccccgtagagacgtgcctttctaaactgttatctagggtaggactcgcgcgcgtgagtggatgtggcctaactgtatggtttttgcttgcgtgtcgtggagggtcatcg

SEQ ID NO: 4572 - DNA, 2511 bp, Zea mays
  misc_feature (1)..(100): optimal_loci_205579_G1, chr5:205554907..205557417, Cluster 28
taatatgctatgctcgatcggcaatggattggagcccgcggctttggacgtcatgctggtgtcagcgggacatcagcctgccaggcgtggtctgtgcagcctgcacatggctgcatgcggtgggtggcccggggaggcagcgagacagacagggacggttggacacggtgggcctcgtgcttccttccttttgctcgcacgaacaggttgtagtactagtgtacgatccaaatttttatgaaatactggctgcccgctggcttctcttttaatatcaatcgtcgctttaagattatgtgctgcaacagtgcaagtacaacaacaactgctcctatcagtcaacccctttttctgacttgtatatatagagcagggtgacgcgtcattgcctttcgtcattggctgaaaaaatgcactaaaatcctccatctctccgaagggtgtggcacacgatcaagtccgtagtaggcagcagcacattcacggttagctgaacggcagcaggaaataaacgggaggattttcacatgtatcttggtgagaaattgggccacatatacagagcgtttcgtgtgacatcaccgtacgtagacacgtagtatcatacgacaaaatttatactgagcgtgcggctgccctacacgtaggcttcaacttttcttttagcctttacgtttcgtaatgcaaacccccttgttgacaagtggcgttatgaattgaaccaaagcagactggacgtataatttgcatatctgctacgcggtctaatttggacagatttagctaagttagatagttgtttgactcacaacagtctatcaataatgtgttggaaaaaaaaaatgctcaccgacacaagacgtggtggtgcagtacgtagagagactctacctatacatagcattggcgactctctcggtttatgctctgtaatataagcacgataagaatccccttttctatgatataaaatttctgtcatagatcaacaacaacaacaaaacgtcacaaaatggtgtctgtgacggtattaaatattatcacggattgagcgttaaggattatttacctgcgttccaaaaaccatcatagatcatcaaagcaatttgtgacggtaccataccgtcatagtacaacacaaggcgtagctagtccaacccaagtccagtctctgtgtggtgaaaaataaaaaccatcgatgaattgacacatgatcaacaatgattatgtggacgatggtgtagatgcttacacatggatgatgagatggatgcttacaccaccatccatcctagcccatttttaaggaatcatgaccaatttgttaatgggccaaaatcaagggtggtccatttatcaaatagcccatatcaacatggtaacatttgttttgcattcccggcaaatcgtgtgctgtgatgtgaatctgtccagcttatatactagtatagtaccgagccagaccagcgtatgctgcgaatctgtccaagagaaaaggaaaacgaagcttcattcaggggcatcattcaaccactaatgtaacatagggaaaaaaaacaaatagtaggcagaatacaagacttcgaaatgagcaaggaaacataatgtctgactctggagttgtcaacctctgagtctaggtcgtagatagtgcctaacctcaactatctagctagctagtgccatcatcctacctcccattttgactccagtttacataatttactttttgtaaagataactgtttttgtcttaaaataattatccatatgatacttatgtcgaccaaagtttcttaaatctaactagatttataaaaaaaatactaatatatttatacgtgtaactaaaattattataaaaaatagattaaaagatctacataataatgttaactatttactacaaatgttaatggtttttatatttaataaaagctacaaacaattggtttcttaggaaacaagaacatgaattatcatgaagtgtattatacttaatttatcacatgccgccctactcttggtgacaaatattccgtgtgccccacgccgcccggacaccccggcggccggcgcgcttcgacgatcggtgcctgtacgtccggcgacaacacgttgacaattaattaatgtggcgaaaacagcatcagcagccggctgggcggcatggtcagagcgtcaggccaccgtgagtgagtgagtgagtgagaggcggcaggacagccgtgccgaaccaggagatcgatcgtgtttcggtttcgtggcagaacagctatgccatagaccttcgggtcgcagacaacgcggcaggcgaccttgcatccgcctccccaacggtggcagtcgtcgtcgtccctggccagagaaatgccagcagcagcagcccagccatggatatgttgtgtggatcgggagtcaagctgctgctgctgcaatcaataatataatcatgctccgcagattgaatactgaattgttcaaggtcgttcctttgcaccttttttaatcc

SEQ ID NO: 4573 - DNA, 1744 bp, Zea mays
  misc_feature (1)..(100): optimal_loci_205873_G1, chr5:207130789..207132532, Cluster 28
aaaaaaagaaaaaaattgtatccccttacacttgtttgaaagaaagtatacgtgtagattttccccgactgtcgcttcaaacttgtttgtttttactaattggatgattataaagggtgacatactgacatgcagctctgacgtttagaagcagtttttgaagaagacggtttgaaaaacttgggctccacggagttcagccgttgggggaccacttgactcgggtttggttctcatcgttgcgagcaaaacatgtttccaatttgttatcagagagattcatgctttattttgttccaatgccccctggatgacatagcgaatattttcattgctcgtttgccagttgcggacacctttgcttttcagagtgcctttaaaatcgcatatttattacataccactagcaccattgaaatataaaataaaatatgtgctcaaatttatgtctaaattaccaacatctactatcacaaaaataaattaattaacaaacataaagatctgtttggacatttttcatgttataccagccccggaggtgcttgacccaagccgtttagcattaggagtacactaattatccaactctcacctttttgctacagtctttttctcaaaagcctgggaaatggcctggactccactcttttccataccctttttattcacacatagcgatcgcaaattcaacgctgcatgtctttggcgatcggtgccatgtaactttaaacagaaagaaaaagttgattgttgctatatgtaccaaatacgatggaatatatgctgtgtattgctgccaaaaggtgatgcgtttaatttgcaggtagatagatactccgtgcgtgtgcaaacttgctggcttttgtgctgttccagaataatatgatatatttttgatagagaactgtgtgtgcgtgcatacaaaaggttgagtgtggctgagctgcactgaaaagaagataggcatgaaaagggaaggctgagtacctgcagcattgttgtctgtcttacctgtaacctacagcttttgcttttatcattcatccacgttagcgcctcttgcacactaaataacctagtaatatatgctcatgagcaataatggttggttcaccagtttgaacaccggggaatactagggagcacaattaacctctgtaacgtggacctggttcaaattaaaggattatagctagaataattgttgaagtataattgaaatgccatattttatcatcttccgttcagtttaaacttttgaattgaatgataaactaagttatttaattaatatgtagtgcatacttaaataaaataactgtaccgatttattttcaggtctgatgcctgtgtgtgtgaccttgggggtacggtagggttgacgtacaaagtgttttttttttcacttttcctatcaactacttgagcttttttcccccttcttttcttgaatattggtcgttgtttgcaactcgcatgttgttatcaacggatgcatgtctatcactaccatactagcattacagccatgaatgaaacaataatagatactattatctgctctgaattattaattataggctgttttgagttttctagatatatagcttttgctaggtattaatatggacaggatatttagatatataatagaaaatgggtatctagaaaaaaaagacttataaattactaatggaaggagcagtgaagtacttcggctgacgaacttgctattgcaggg

SEQ ID NO: 4574 - DNA, 2233 bp, Zea mays
  misc_feature (1)..(100): optimal_loci_206111_G1, chr5:208346123..208348355, Cluster 28
taatttgttggcagttcgatctgttggaagaccaaatttgctttattcattcacttttaacgagcgtgagagaatgctcttacttgttatgtgcttcctccattttaaattataagttatattagctttccgataatatgcttagaaaactgtgaatctaaaaaagccaaacgacttacaatttgcaactgaaggagtaacttacaaagcatctgtgtaaatattgatttatcagacaatgtcgatattgctcactttatttggacccattctctcattttatgaaaaaaattgttagcccaagaatatgactgaaaacttggaccattcaaccagataagtaaacttataatataatctctgttggaattgctgtatttttttatccaatttcatcatcttatcgaacaattgaaaatggcattcttttcttctctgtgccggcgacataaatttcagatactatccatccagtcttgctgtgtatctgggtagaattgcccccaaagcatgttggacttatgggcctctctcatatactgtactccagcatgcgttgcagttgttgctggatagagctaccaggctggatatctggatctatcataagttttatgactaggcccatgaactttagcaaaaagctgcaactttgctcgttttcaatatccttattagcttaagatggtagatgatagaggggctggcttgttgttccttgtcagggaaacatcattagggtttctatccctaccttacatttcaagctccactctgcgaatagtgcagaacattgttttgtctgtctatatagctggtctagtgacctcagccatactctttgtactgggtgtagtcagcactagtactgtgactggagtctcagaccttgattatttaagatgcctccatggttccattcaagtattttatgaaaagttccatgtcatggcatttcagtaacgatgtgatagtattgaattccttgggtagatgagaaatggagtctgtttttttaagtagtcggactaagtttgtccttgtatgatgcagtattagaaacaagttacaattaatgatagacatatatgaaataaccattgtcaatgacttctatgtcctgttagtgagaagttcatttttgaccatccaactattgccggagtttgtttttggccatgcaactctagactgaatttttttggtaactaaactatcaatacccgacaaatttgaccatctagttggtttcaaaaatggttttttgttttctaaaaaattaaatactggcagaaaattttagctgtatttaattatttatacaaactagttctagcaatgtgggcatgtggcagtaataaaagaaacaggtttacaggcggttgaatgtcagaacaatagaacaaaactgctgagagcaatttagactccggtgtcgaaacaagtatgtgcaggttcaagttacagagctatgcaaaactctctgacattagtttcttttacccgtcttcatgtaaatctgtcgtatgtttctttacatagattaattccaaatggatagatgagaaataccatattccataccaaattacaaactaaaggtgcaacaagaaaatgttcttatgacacaggagcagaataagattactaacacaaactcttttcacattccatgatcattttctactggttatacctaaactatgttgtcgcttgttgccaatttgcacgaggttaccgtttacataagttatccctttaggagcgcattgcactctataccctcaccgccaagcatgcactgggatgcatgctggggtatttgaaatactgaatattgtacgacagatactaacagttgtgctatttgaaatattaaagcacagtacggcctgacctggatgagtttgtcttacatgcattattttcaaagttccaatcactctgtacctacatgttggttttcttcagtgacgtggaaagcttaatgcagtgtctaaccctatggcatcagccatcataaattagttagtgccttggtttgcttcctcgttccaaatgccctcaaatgtatgcccaaaaatattaatcattgatctagcgtagaaaaaaaaagagttgtaaaattgatacttgtcagtgtcaggtaaagctgtgttgttattgctagagatttgaaatgagtttgttaatgctagccgtcaatatcttgaaggaaaaggcatcagctctc

SEQ ID NO: 4575 - DNA, 1447 bp, Zea mays
  misc_feature (1)..(100): optimal_loci_206522_G1, chr5:210600967..210602413, Cluster 28
aagaagtcagtcgttgccactgtacaatccattattgtctatatttgtcaagaatagtgcagcgactgcttaatttgcacatagatttttgtgaatcgcgtatgtaagggtgtggtttggtacgaattccgtcgacatgcatcgtgcgtcaacggtgctggtaactgattagcgataagctagcttccgggcttcaattcgatgtcgatttcaacttgcgccacgagtacatgactgtgtttagaaaggtaaaatgcccaaaacaccacttggttgctgtatgaaagaatgtttggcgaagtgcatgagtctcaccgctggttggttcatgcggtgagaaacaaaaaaggtggtttgattccaaagatcagccgagaaaaactaagagccatgtacttctctgaaccctacacactcccttgttccaactctgtgagccttacttgccttttgctacctacttgcgtgcaaaattgttgttccttcatcttcatatatatggatgatagggataactctatttacttccctaaaaacttaatgaagaaatataatgtacatggtacgtcaactcagataccaagagattatggttccttctagatttaattaatacataaaccatcagaaaagatgatacttctaaatttgattaatacataaaccatcagaaaagatgatacgttttttttctgagcatgtagacaattgatgctatttatttgtagtatttttgaatcaagcaaagtttcagactggatcatgggaatgggggatgcaagctaacggataagatcagcaaattaaaaagagcgatattcttcctttccaacaaaggggaggagcattttcgggcaaaagaaagcaaaggcagatagatattccggaatagcgcaatactgaaaggggccaagaactccgtatcttaagcaacaatattttaggcagctagtagagcgttccaaaagctctgaatcattgatgctaatgacatcacctgccgcatgtacgcatcggctttcagctaaatattcgccgttagccccatgtgacaaggttagcattaaccctccattagctgatctgatgtttaataagaaagatgcagaaataattctgagcacgagcagtgatatcaaagtgcgtttctgttgcttcgtcagtgctgtccatgcatcatacacagagagaataatggcgcagtatatagcagaagtcaagtcgcgggcggttgtgctcttgtcgtcgtacagggaacagtgtggtggaggccaggaactgcgcaccgaggagcaacttgacagatcgtaatgcttggatcgaactaacctaggtcgtatctgttttcagcaaggttatataattcaccttataggtgggtataaggcaacaattagaataaactggactagggtagcctatatgcatgattatataagctgggagg

SEQ ID NO: 4576 - DNA, 1414 bp, Zea mays
  misc_feature (1)..(100): optimal_loci_207772_G1, chr5:216610300..216611713, Cluster 28
ttaagcctcatcatttcaatcccctagccgcacctttcaaaggaggatgcaaacataagggcattgctggggtatgccctttcaaatctaaatctctgcacaatttatatgtgtaggttgattggcacactaatatgcctttttttgaaatgttcatatttgtaacaccgcaaaatcttaaatttgggtttaggggggggggggttaaaaagaatcaaattatagtgtcttctcttaaaacaaataagtattaatgcacttctaatatggctacacattaatcgatgaataaaataagatttggatggtatgctggagttactctttgtgcatttaaactacaagttcaaattccaactcagtttggaaaatgatttgagatttgaaattgagaatttaaaatataaaagaaatttaaaaaagaagaaggtagcttaccgaatgggcttgggcgcggcacttgtcttctcttctctctctgtggctatgcgttggtgacgttgcgggatgtttccaggcagattgccctgcccctaatttgtcaatgacttgattcccatcatctcggccgacctgcaacagctattagttaggctaacaacaaggataataccactacaacaaataatactgacaaaactaatgggaccaaaatttctgaaacatggtagcggtagcgggagaaatagaaactatataatttacaaaaccagaacgaactgtatctgtatatctatctagaaattaggaaggcaccaagtttattcaagtttctacaggtaagaactaatggagtagcagttacattagcatatgatgcaagcacaatgacttggtaaataaataaactaaccaaacaaaaatcgaaacacaagcccgtcggcctagtagaggagtatctaaagcatggcactggtactatactgaaggactactccagtttataacgaagaaatgtgtggatgagagatggtggacggaagcaacaaatcaggacaaggaccctaggtgctccgggctggatcctgctcctgatgctgtggggaggcggaccctccgagcttgcgatggatgaaggccttggcacgctggggctcgatgttggcgtaggagagcctggcggcggcgatgatgagggcggcgccggtagtggcgcgctgcgaacaggtcgccgtgtactcgagccgaaccatgatgccctgcggcgagcaggcgggtgctctgccttccgtaattgggctcggtgaggcccaaaatctgttgggaaacatataaacgattggtgtatatatgcttgctgagattattccctcacactgcaacgacacgatcgggtgctcatcgtacgtacgtaggagtaaactatgtgcatgtttttcgatgctaaatattacacggaaaaaacataagtaaa

SEQ ID NO: 4577 - DNA, 2319 bp, Zea mays
  misc_feature (1)..(100): optimal_loci_225369_G1, chr6:110390761..110393079, Cluster 28
ccgtcacaattaatacaatggaaaaagccttatccttattgtttggttctaggtgattgtcctaagggggggtgcacatggcactgggccgtatcggtcgggacttgaggtcgctttgcccttggggaatcttgaaggatgactaagaggtctagttatagtctgtagctatagcgcccctagcctaggtcgaacaatgagctccattatcgacctagagtgacctaggagaacaagagggctctagaggttaagatggccctaagaggctgggagtgccccaaaactcaggagggacttaagaccttatcccaaggtgtggatggcgctagaggctaggagacccacaaaggtctagagggccctagacttaatccctacagagtggagggccctgacttaattggatccgagtaaggatcctaggggcatggggtcccaaggacacacgattggcatcaatagggtcatcctcgagtttcttgctgttaggaccttagataggcatattatcaatagtagtgggcactattttcccatacgttgatagaaacccttggatccatcatagaactagggaggcctataggtgggtcaaaactcttttcaagatgcctaacaaagtggatccatcatatgtcggaggatcactatgtgttgtaatgataatgggtgcagggaggtgacatgtcaattagcttccctaggatgagactaggctaggaagagtgatctacaatggtaaagaatgtttgcaccatagcttagctattcctatgatacttctctggaccttgttgctatgctccgcgtgggagccaattgttagtcaccaccactacatgtccggatgttgaagcattggaagcggccacatcacacatctcttctttcgatgatgcacctgatgctttgggctcagagtttgtggttatgaagaaaaagggaaataacaaaagagaaaatcgtagggaaatttattgtaggtctacagaggcctctagacagggcgcctttccaaaaacacacttgataaaaccagttcatcatgcatgtcaagaattctgtgcatgctaactgcattgtttggtagtcgaagcactatgcaaccatcatatcacacgtctcatgaattgtgtgggtcgtgcgatgcttcaggttttacacctggcaattaatagagagagtcataacaagagctttaagtacaggtgtgtggttttcatgttcgtgcttccttgcgacccatcacacttacctagtactatcttcttcctcttgtcttcctcctttaattaatagtcattgtcttcccttcttgtcctaaagtgtgaccaccatggctgcgacctttgctattgacttgctaccatgtagcagggtccttaaacatgaaggtgtagataaggtgcatgaactcctagggtaggttcctcataggactaactatctaacaaggagatggccaacccatgaagctagctaaagacatgaaacaaggtggtgtgttctctaagtaaaaaaccaaccgactaagccagactaaaggaaatactatttctacaatatgattagaactcttctaccttagtcgactaggactcgacctatatgtggctccctagactgtataaagaaaggcatgggtactcccattttaacacatattgtatatcataatccaacacaaggaaaaatgaccaactagacatatggtattacaccattcaataaatggtaccaatatattttttctttgagtttgatttacactgaaacctcccataccctaccccgggtaaccatgcaacacgattatcaatcgtcagacaccaatatcattgctaaccaacctatttgaacgtctttcggtccaagctttacctaagtacgaagaggaaagcacagaggtagaggaaggggaggaggagaccaaacacgaggaacaacgggaaggtccttaaagtgagatgcttgtagctacacattgtttagttgcaaggcagaatagcaacttttgtggacatttgacatggtacagatttgtatcttttgtggacatgttaacatggtgcaaacatgtaacttttatggatatgttgacatcatgcatgagagacattgaatgtgatatagacttgttgcttctccatggttgtcatttctcatatgtgctgcatattgttgccatagtgctacaaaaaatgttgctaagatgctaccaaaacattgccaaattttcaaatattttcatcattaaatcggatttgaaataattgcaaaatatgccaaatatatttgactaaatcaaatgttttt

SEQ ID NO: 4578 - DNA, 1906 bp, Zea mays
  misc_feature (1)..(100): optimal_loci_229369_G1, chr6:131467872..131469777, Cluster 28
gcctaatgccacaaatgttgttcaacacttagcttatttgtctctacctgttctcgtgtttcttttatctggtttctttctctttttagcaaaccgtctgaccgtctatatatcacggtcttagcaaaccgtgtgactgtctacatattacgacgattagttgcttcatgactatgagattaatactccgaactttgcaggtcactagttttgtgccctataaactaccataaactatataaagttatggaactaacctaactggaatcgcatcgcctggacttttacggataacaaaacaataatgttgttttagagtacgacagaaaattaatcaacctctaatttcttaaccaatcaagaaccattaaatgattaatattgcaaactattgcaggtcactagttttatgctctataaacgatctaaatgatctaatataatataaacaactgaatttaccaagtcaatctagaatcaaaatctagacatacaatacaatcaatgaacaaagcgagatgaacgatattaccacatcttgcataatcaacacattaatctccaatatttatatatataagctgttttataaaagaatcaatgagttcctcaagatctctaaaaatcctagattaatcttttaatagatctaatctagtgcctaaatatctctcaaatcaaaacaaaacaaaacaaaactaaaggaacgaatatctccctcgaacacgaatttctcttggaccaccagcggctgacttaggccgcgttctcccatcctgggtgcaccccttcacgcgggccgacgcccagctgggcctcgctcctccacgcagcaggccgcctttactttcacgtcataggtcgcgcccgctccagctgacagggcgccctccgcgccaatagtcctgggccggcaccttcatcttgggccgcctgtggaatggccgccgagtgggctgccccaaacccctctgttgtgccgcacgcgcacagagagcaaggccagtccggttttggttgcatccgccagctcttggcccggtgcttcacacgcactcacggccgagtgacccagactggcaatcaattttcccccctttttacttttctttttctttcattttttcctcttttttctcctttctaggcatttcatatatatctacaacacacgcgatggtcatttgcaacagtatgaaacatctcacacatcatctttgatcaagaacctcagttaatttgttcctaaacttagtcccaaaacttagttttggtacctcatttcctctccacttaacacagaaaagtaaaacttagtttccgtacctcacttagttttggtacctcatttcctctctacttaatacataaaagtaaaacttagtttccgtacctcatcacctctctacttaatagaggaaactagttttcatcgtcgccaccggcccattttgcctcaaccaacacctcgatatcaataatccatacaaccgagtacgagggcaagcccacgacttgatttaaggttaatctaagaaaaaacacagcaccaagtgtgttacatcaatatcaaaacatatatttgcacacatacattacttccaaattatgttaataatcacttgcaaagcctatgccaattttaaagcaatgttctaatgttaactaacacaatattttcatcacacaggatttcacacttctagtcttgccttgggactcctattggtcttaagctaaggtttggaatgatcgctaatagtgatttgtccaaggagaattccataattctggttaggagtggagcagcttactcatctctatcaccatattcaaactccattatgtaaaatagtgcaaaactgtattttaggtaaccatatggataatctgctagacacagtct

SEQ ID NO: 4579 - DNA, 1903 bp, Zea mays
  misc_feature (1)..(100): optimal_loci_234257_G1, chr6:153805066..153806968, Cluster 28
aggggaacataaacttagatgccctgtaagaccatatttctagggtgtttggttcccacgtcctaaactgaagtttagtttcttttagtccacaaactgtcaaacgatataacaaaagcaagcttcttaaatagaaactttagggactcctaaagtttaaaagggtgactactaagcacccccttcgttcagctacatatatgattggtagggacatggaagaaaatatgactttctaatataccattgtatcaagtgaagcaaattgatttacgatataagaaaataggactttgtaatatacccttgtatcaagtaaaaaattgtataattcatactagattaatcagaagtagtacactttgtttttcatatgctcctatcatcttttttacctctcacaccattcttggggattcatttgtacctgctgttaaagtgatgttgtgatgattagtatgatgcttttggtaattctttactaattactacccctcttttggcgttctcacctgaggttcgtagaagtcactgcaaaagggtagagaaaagaaagcgaaagttgccagacatcatcagcaagttgattgaggaattcattttgttacatcgacttggaacggtagccacaacggtgctaatcagactggcatgacttatgttagcggaacaataccctatgctctattgttagtttagtgtttgcaattaaataattccattatcacgtaatagtgcctatttaccctatggcctgcttctcttcttatatgatttatagttgtcctcttgctattttttctaaaaaacgtagtagaggtatgtatgtgcactctataaggctgtagctgaaagcagaaacttcacgatgccatatggccttttttcccatgacacacccaagatgttagatctgttgtttagcgagcctgaaaggttggagtatccttttctagttaattatttaatctgaatagttaatttatcgatttatggggtaacaatagaagacaacttaaaatacataaaaagttagtgtaaaggactcatgttgctaaacgcgcggtacacttgtttaacacttctatgatgtttctattggattgatcattcttttctcttatatgaaagtttttatagaacattaaattgaattataaattatttcagagcctacatgttagatccaacctaattatttgaaaaacgagttttagtttttactatatataaataataattatttatattagtaaaggtttattgtgactctatcaataatcttgctaaaattgtcctaaatcctagttaactaaacctttttatatctatatttatatggttatgtatatcaatatatgtgatattgttagcgtttgggaaaggctataccttcggatgctagcattacgtcttttaaatatcctatgagtagaaggaatctcaaagagggccagctaataccagccatgtgtctctggaccctccatctcaggggaccatgcacaactctagctaagtttgacatcgttcacactgtaggaccaaatctcaaggcccttcggacctctcgcacccttcattaccccaacctagattgctatgaccattaggccatgagccaagtttattgcttgtcatggcttgggtccctatgggataaggtctatatttagacctcgatggtgtccttcaagatgttccagagcgaaacaaccttggaagtagaagcctctagggtagggcggtcccgagtggtatgaccctactacaaggtgtgcccctcctcgggacaaccacatggtacaagacagtcaaggtaaggcttttcccatcgtattaaatgtgatatatgattttgcaatcaaggaggtgttcagttgccttcataaaaggcaacatg

SEQ ID NO: 4580 - DNA, 1731 bp, Zea mays
  misc_feature (1)..(100): optimal_loci_236051_G1, chr6:162678359..162680089, Cluster 28
atccctcccgtcccggctcggcatactgtgcactgtaagtactagtcttcgacgcgactcagggccgacacgttattttgtccgcttatttattattgccagcaaaagcatatctgcagatggatccatgggaataaatttaacgagcgttagggtggttcccacttcctcggcacgtaatcaatgtcaccgtcgtcttttctccgtacacaagccggcggggaccagtttggccgggcccgggctcggctaatgctgcaacgacgaccacacatagttggatcagttcggtttttgctggatcatacagagttttatatacttgcaattattcacacaagtgacccggccattgtatttgggacgccatggcccactggccactggcttctgcgcgtaccagccaatctccacggctccacctgggtggaatgcggcgtgtgggtgggtactttggtagtgtttgtatccgttctatcctctttttttttttttaatactactaatcctattacatgagctcgttttctctcctcctttgatagagctagctggtaaggccagaaatgttggcggagcacctaatatcccagaccatagtttccttttttttccccatttaatcagcttgttgttctgtagtccagtggatttacgctgctagcgtctagcgaactggctattcaggtcccgggcaggacgagatgaggactcgtggtgggtagagcacccacccaccaggccaccagtcagtcaccacccgcgccacgcacgccgtgacaaaatcgcgacatactgaccgtgaccaagttgtatattattatatctcattcctcctacaatctggtcatgcaatgcatagagcaggggctactctgctgcagctggctctgggtgggtggtgcaaacaaagactagaattcattacttaaactgatcgctgcgctaccctgctaggcagggatccttaaataaatatcgctttggtattcgaccaaccagactttattccagttaactagatttatataaaatacctatactattcatatttaaaagtcttttattatcgacccttactgattacacggtataaatattaatattttatatatttagctaaagtgaagttgttgatttcttaaaaaaaatcgaggaaacttagtttttttatactaacttcatggttggaagcaacctagtttttaataatccaattttctctagtttccacaaactggtttatgattaaaaaaacttgttaatgctgttttgaaccaactcagtttttataaaccgattcgagctaggaaaagtagcttcttggtttttttttaaactaaatatctagtttctataaattggagcataaaattatatatttgataccacatcagtttaaaactggatgcttccagtccataaagacggtataccagagaggggcacccgccctttgccctttggggatgtggagggggcaaccgaagaacaagagaccccctttctctagtgcttctgctcgtggaagcgactttattttaaactcccctcctcattctgggaaaaaggtgtgattttagtatagtatcaaatcaaattactctgattttgaccaaattcgtgttgttgtgctatcaaaataaataagtattgccaaattctttattagatatattttagtgttaagtatcgattacatattttcctattcttttttattttaaagtg

SEQ ID NO: 4581 - DNA, 2372 bp, Zea mays
  misc_feature (1)..(100): optimal_loci_236378_G1, chr6:164492960..164495331, Cluster 28
ctgcattagcgttaaccgccacatcaggtccggcatggagaacaatgtaaaagtggcaagaggcgaccagcaagatcctccgaccatgtggttccttttcctgagcagcatgcatggatgaatccatcgtagcgtgatcagtgagactgaggaataatctttatgcatgccaatctttatccctcaggccagctagccctagactagaggctctacacgctagtctgcatttgtgacgtgacaaggttccttggccaacactcacgtaaattggtgtcgactggtatttcagttcgtctgaagagcttatttagacagacgatctagtgaaatttccgctctggtggcttaatatagccaattatctcatgccacttttttaaactgacaaatttatttattttggaactacaagagtatgcatagaagaactgatttcctacttatgatggtgccatgcccgattgatatgtcaccataaaacttgcaatcaattccaattagaaagtacgatgtcaacatttccacaatatatgaaggacgacgaagctaagcttttcctgtaagtcatgtaagttaattaagtacctgaataagacaatttatagatgcaccaatacactgatgaatatagctgcaggtatatcaaactggtacaagaccaacgcacgcatgcacgcacacatatttaattcttgttgaaacaacaaatatacttcgattacaagatttatttccttttgtcatgataagccttggaccacagtaattggtatctcttactattagatgtttactttggaatatttatatttatcttcaaggaaggtgttagaaaagatagaaaaatcataaaaatttggccaacgatattattgtaggcacaatcatttatagccgttagacaacatgcatataaatcaaatatgtctagcattacgaaaactaattaacctgaattaaccctttagtccatatctaaattacccactttactgttatgaaaaaaatgtggcaccacccaaattttacatgaaattactaatttttgttgttatgagaaaaaaaaaattaaccacatatcaaataaataactcaacagtgcccatatacatgttttccagttatcccactaagtatatatgtgtcatatagaccatgtttccttgccggatagcttgggagctagtatgatattgtgattaagaatggtctgacgatcattgaaaatattttcttaaactagtcatatgcacactatccatggtaatatacgaattttctagaacaaacaatcacaatccatatatatgtactacgtaagctattatactttaggattttgaatattattttgtaacttatagcatatatccatgcctatattttaatacaaacgtttgctcaagtgttttaacgctcaagtgtcttctgtagaaaaatgcattgctcttttaaagttccttgatagaggaaattcaaagtgtcttttaaaactacggtgcgaacgaaacattgtgaaaaggaaaaccacatggaataataatagtttttttttctttccctaaactcaagacacacaagaaaatgactgcatatcttcctaccccacttagcagtagcaagtcacgcgtcctgaaagttgatgcaatgcaaggccaccacactgaaatgaattccaattattaagaagtactacgatgtcaccgttttaaacaggtacgacgaagaaagaggatgcttaaacttcccctgcaagctaaggcagctgagtagtacttagttgattaagcttaatcacatgcacgttcatacttattaatatttaataaccagctcgttcatttcacgctaaaacgagcttggtagacgcctagctataggcatataattgttttacgtcagtctcagtgggcatttcattagaactttattctcattaaatgacatgccatatataagcaattaggataacatgacatgtaatttaataaagagatatatgagagctttagtaaaaaaaaagtgcaacgaaatgcccgctgagaaagcatgaaaacgtgcgcattgatctgcatatatatatagcactacgcacatttaatctgctgtctagcacttttaagcacacaccaacacatacgttcgtctcacgctaaaaaaaaacgagctagctatacatatacttgactagtttaatttcgatccgaacagcttggtttgcatgcggccggcctcatctgttcaattctgaccgtagtgcagagatatacagatcgatatgatgttcagctgtggctctttgggtagatgcatgaaatggagctatatacatgtgaaatgtgaaagggttacgctgtcattttctgatt

SEQ ID NO: 4582 - DNA, 1684 bp, Zea mays
  misc_feature (1)..(100): optimal_loci_236820_G1, chr6:166893312..166894995, Cluster 28
gctttattttcagctggcgctgaatacaaggtaagacttagtggatggtgaaattttcgaaatcttgattgtagtaggttcatttgtcatttgtagccagatattttcaggacaaggtaggaaatttgatgaaccactattcctgctgtttgtggttatgttttactgttaccataaatacatctatcttttctcttatcttcaaccataaggcataaacttcatgcacttcttacttcaaatttgacatggaaatccatgaatgttataactgagtgctgctaggtcaacatatatcttattatctctacaatgaacttgtgtgcaaaagatgatgctagataagaccatatcaccccttcatctagaatgctagatctagatgacttgaatgcatgccatacatctagagcataacacaacacaattttgacaagcgatcaatacatagaattttgttagttaattggttgctatgtccttttgtaaatgttccccttcatcattattcattaataatacatgtattctattataatgtataagaatagatggatttccatgaccaagtgcatgttcaatacttcaatatatagatgttaagcacttctggtaatttattgcacaattggataattagatttcacattttcagtcacattttatttactcacttcaataacacattttttaattcatgtcttgattgcacttacataagcttgttggtgagttgatcattgtaggaatatatctctttctctgtttaggtcatctgatgattctagtatatgtttcctttctccaggtattgaaaagtcttgctgacgggttgatctcaatcacagtgaagcctcaggatctacaatgtactttcttccggtgtacagcgcgggaacttctcgcttgtgcagttttgagacctgttgtgaacttagcaaatccaaggtaataactcactggacctggttcaaataattatttttactgtcatcgtatttaaatgttaaattgacaggtttataaatgaaagaatcgaatcctttgctctttcgcatgccaataagttggagaaaggaactgcagaatccttggatgttgtcacaactgttaagcacagggaaccacatatgccctctgttgatgaattttcggcactaatagaccactcaagttcaggtgttgagctcgttcaatttcgtcagggtcaatcgaaaactgcatcagatatacaacctggaaaaagtacaaatccatatagtctaaaattagaatcctctcatgcacctttagtcagtagttcacacccactggagtcaacaagtttagcttcgtcttcccacgttacttctgataatgggttttcgttgcataccaaaagcagcaacagagcaactgcaaatggtcatggtagagagtgtgcacagcccttgggtatcagttctgagcgtgcacatcaagctttagcacttgagcaccttgagaatatgtggacaaagggaaagaactacaaaccagaaaatgtagaacatgtcgcaaaagtgtctgttggatctgcttctctgggctcgacttcagttcagcaatcagttccttgcagcacttcagtttgttacaatcaaagtaattctgaaagaccaacagcgtcatctcagtcaaaggaccagcatttggtaagacactc

SEQ ID NO: 4583 - DNA, 2468 bp, Zea mays
  misc_feature (1)..(100): optimal_loci_237950_G1, chr7:4033224..4035691, Cluster 28
ccatgagcctagacggatgtaacctcggcgagttggtcagtttcaacggcctatactgcagaatggcaatgacgaagtgtggaggcggagaatgtagacatccagggacagggacagggacacacgtacgcagaggaaggatcaccaccttgttgcttgttggtatatttaatttactaattctatctattggggaagattctagaggagtgaagtagggtatcacacattcaaacacaccttttgaaaagtttattgtgtatatattcagtagagatgcattaaattgtttcaaaggatcagtaccaccactacgtacatgcttgtatatatacatggcactaaacaatggtactctctttttatggtcccgtattttcagagattgctctaaaagtcagctatatatgtttataattggatctgtagagacgggagataaaattcagacgcctttggaaatgatcctgttgttagagacaactagtacctcctgttgtcagctatatatgtttctcggattttaagttgaactatccgatcaagaataccaccagaccgtacctaacagcccacattgatagatgataagaaaaaaactgcaccattctagaacaaacacacagtttttgattcgacatgccggtcttatcctgaaaaaagagacaaataacatttgattgcacagaaagacccccctttttgaccaagggaaccagcggggaattccccccccccccccccccccccccatgtgtagtggcgcaaaacaaatgctggaggaataggaatactcgtagacgaaggacgacgtccatccatgcgtgatgaatgccagcagcagacatgactgatggctggagtttaaagagacggcgcaatatgcaagagctaataaataaaggtgcatgatctactactactagcagtcatatatatattctgatgcggcgcactgttggtttggtttacacggtccagattattaggcattttaggctgcatgcttccatggctagctccacaaagaagagcaggaagaaggggaaaaaaaagatacaaaatgctagatgtcaacaagcacgcacgtagcactctggcagtacgtagcagcaagtaatattgctgttgcaagtgcaagactactgcaagcagtgatgagttgctaggaagctacgactacgaggccaaataaaccaaccaaaattaagcactggcgacacttggacggccaggagataaggttcagatctcgcacgatcgagaggcaggctcacaacgcatggccagatggtcaatggagcgaggaatatatgcagagaggcaggccatggagctaataataatcgacacgtactgtccccacatgtctgccggcctgatgctttgcaacatacaaacaatatgacgatttgaccaacatatacaaaacaaagggagacagtcgatcgcagacacactgggcggctgcaatggaaagttccggcctttttggctcaatcacctaacctacctatcgtcagtgtttccgaaacagttcgtcatatggtggtgcgcccccactactacactacatgctaataagctgcttccactgacagtgatgcagcgatcaacaacgcgagtaaagtccaccccatctactaaatttctaaatctaacctcgacggtagattcagcatctagctagctagctagcacacgtactagacctaccgtgtgttccggccgccggcgccactggaaatggctggtgtgtacatggttaaatgatgaagattcagtaattaagaaccatcctgacgacgcggatgatggcagaatgatgtcggataccgtttcactaataaaacaaggatgatgcttgtgtgttcagtgtagcggactgagaaagaagtactaaaccctacctggtcgatcagatgaaacccaacactccaacagtgactcgctcgatctctttccctcccaaagatttcctcgctaaccacaaatgagtgatccatgttaactcaagcacagtagctaaaattcagatgatgcctgaattttagcttcctttcaggtgatggttgttacatatgatttatgttaaaattgtagcttttgttagagaactagctagacgttttcagttgtagtttagttcagaaaaataaaatacagatgttggtgacaatagaacgacgcatgtatatatgtctgaacttagcacgatgactgtaaaaagcatagagaaacatgattctataccaatgagaagaagcactatacccaagggcagacatactgctagtcgatgtagccgtcctgcttaatgcggggcacgaatgtagttgtgacgtggacgatattcattctagaggttcgctcttccaaaactcgtgcgcgcaagtaacaaaatgcagtgcttgaaataacagcggaacaacaacaacaacaacaacaacaaatgtgaacatgaagcg

SEQ ID NO: 4584 - DNA, 1921 bp, Zea mays
  misc_feature (1)..(100): optimal_loci_256644_G1, chr7:121399741..121401661, Cluster 28
agagtggtagctcaatactctacggtgagtgtttacggtgccctaaaccttttgacggtataagattttttttactttcgaccacaaatataagcatgtttagaaacttttttttagcattgaccattgctgtccacagtggctagagtgaattagaggatagtgtaaataccttgagactgcataataatattttgtaggtggtacatatatgataaaattctagtctattttatttgttcgtaatttttttgtggatgcatgcgcattcactgtgcactacctagctttgcctctggctgtccaaaatatatatgcaaattgttaatatggggctgcttttactgtgtccgtcatggttcacaggtcataatatatagtaactctttgtattttaacctgtatattttttataagtattgttagtcaaagtgcattattaaaaattgtgctgatgttctagtggatttatatttgtgatcaggaaataatattgcaatttgcaatgacatgaacatacggacgctagataaaaacatatgcttctaccaatttgtgagaaaaaacatctgatggacctagaactccaaggtctgtttagagttcaaccttttgttgaacgcgggataaaacatgtttctctacttcttttatacttcaatacttcaatttcaaactatatatatttaaacttaaacacaaactcatgagtatggcaacttgactattatatatagactacacgcacatataacataactgacactatattattgcacgcgcacataaatgtgagataatgacaacttaactactgtggactacatgcacacactacacacataaagtgagagaatgacaacttaactattatggactatgggtacacataacataacttacactacactacatgcacacataatgtactagaatgacaactcgactattatggactacacacacctataacatgagaaaaataacaacttgagtgttgtggacgcattcatgtacacataacatgaggaaataacaacttaactatcgtggatgtattcatgtgcacatataatgttatttatgtatacatagcatgagggaatgacaacttcaatattgtgaacacattcatgcagagaataataacttaactattgtggatgcatttgtgcgcacatataacatgagagaatgacaacttgacttttgtgaacacataacatgcattcatgtacacataacatgagcgaatatgggggaataacaacttgactattgtggatggattaatgtacatctaacatgagggaatggcaacttcagtactgtggacgcattcgtgcaagcacatagcatgcattcatgtacatataacataagagaatgacaacttcactattgtaaatgcatcatgcatagaatgacaactaaactattgataatgacaacttaactattgtggatgcattgatgcagacacataagtataatgataaattaactattataagtgtattaatgctcacacataacatgagggtgaacttgtgaacaattataacctaaacattgtagatgcatttgtgcgcacgcataacatgagggaatgaacttgtgaacacacaatgtccattcacatacacataacatgaaggagtattaacattccactagtgtgaatgcattcgtgcagggaatgacaacctaactattgcagatgcattcgtgccacacataacatgagtgaatgacatcttaattattgtttatgtgctattctgaatatataatgtgactattatagatgtgctattgtgaatacataacatgcatttatgtacacatgaatatgaggctattgtggatatataaatggaatgaaaacttaactattgtagatgcactattgtgaatacat

SEQ ID NO: 4585 - DNA, 1488 bp, Zea mays
  misc_feature (1)..(100): optimal_loci_257371_G1, chr7:125400398..125401885, Cluster 28
taatttaggacacatgtagcataatcttagctagaatatttaatttaattttataattacagaagttagcacatacaacgcgagtagccgatcaagagggccagcgggcggcgggcgcactgctgcagcacatgcaacaccgcaaccaacgtagtcccttgattcgtgttttttacgtatagttagttgttctaaatctgatcaaagataaatcgcagattactcaaaaatatcttgaagagcattgtgcgcatattttcctagtttgtaagagtatatttgttatggaggaaaagcaggaagcaaacagattgagagcccatagccaggagaggttttctataaatcttaggaaccttcgtgtttcatgcgcgcaaccaacgggacgggatgccgacggcatcgatagttccaagttccatgacatgttcgatgaaccgtaccagttcaaaaaaaaaacacgtcatctgtcggcaggttgcctacgacgataaaaaaaatggcattgtccaatcacctcgaatccttgaccagtgaacatggaatgcatgctggggtgcccttcttgcccactccagaaaacaggacgccatctgtccggaatcgcctgcctgatgctcaactgaacagctgacgctgggattcaccgtaacgtcgtttcaatgtgcgagctagcggtagctgacgacgtcgacgtcgtgggggcgcaagttggcgggggcgggggccgcgcgcgcgtcggcctgtgccagtgccaccgactccaccgctccgccgtcgtcgtcttgcggcgctgtcatgtgagcacgaccatcgcttgtcgatgctggtgcagggcgccaactaccttcttcctaaccgtttgagataagcacaattcgtgagcaggaatcgtttgatcgtgatgtaccgatggtttggaactttgtttaacgtttatagaggtatcgaaatgtcatagcctgacgcatcaaactttattattttgccaaaaccgcacagaattttcgcgttaaagaactcccatccccccccttcacgaaggattctagcttttttaaagaatcaattaatttaaagactaatcaaagttaaatagaaaaatactatggttataaattaaattaattatgatacatattctcgtagtaaatccagttgggaacataaatgttactaaaaagtcgatcaaagtttattttgcacaagtggtataattgcatcattttgtggacgaagccaataataccatgtatcaatacaaatcaacaaataactaggatataaggtacgaagtatagaggaaatcaccttggtacttggtagagatagaggatggaggatgatatcaatttgaaatacatgactgagattgttgttgaggtgtgtgctacactggcttcatagtttggtgtgaccaatgttacctagcgttgcaacactagctaaagagttgttttggatatctagtgatatgtgtgcgtacaa

SEQ ID NO: 4586 - DNA, 2429 bp, Zea mays
  misc_feature (1)..(100): optimal_loci_260564_G1, chr7:143196414..143198842, Cluster 28
cttggtttcaccaaatctgacggtgacgcgcccggtgcatggcctccggaagatgtcaagttgcaggtgaccgttccatccctcacaagctactgacctcctccccctcttccctctaatgatatcgatagataggctaggctgggccctgccctgaggtcacttgcacttcgtccacggccactgcttgaattgctcgccctagctacaagcctccacggaattgtttgtgatccagctgctttcgctcgtgtccagtcggtccggtcactcgtggatgttacaagctgctgctcatgggccaccagttgctgcactcttgctgtctgctttcaagccaagtgctctctccagtctcctcccttgtgctggatttcttggcgagttcttacgctagtgcctaggcgtagcgacgtgcgttgcgcaggtcgggcgacagaatcggggccgggctgtgaaacttctggagcttttccggtaggacaggagtgtaggacctctttcgaacaagctacgttttagaatttaaacacaaaatatatgttccatccgtcctaaaaaactggtctgtagtttataacaaaaatactatcaacaggtatggttatatataggaatatgtgaaaggttattttgaggaattcaataactcttatttaatatcattaatatttatacatttttaatagaaaatggtcaaaatgaagattgtttgacctatcatcggagtgagaagtataccatttttaggacggaaaagtatacactaagattgtctctagcggtttctctaaagggccccttgtcctatatctggagaaaattcttctcctctatacgctctagcagtgtcttctagatatagatgatgtttctctatcctctctctatatagattctctcttctatctacttattttatagcaaaactaaactatttataagatatttgagtgcatgataaatacatacatacataaatctagaacaaaatatgtttttaatattatttaacgtaaagaggacggaatatgaaggacgctggggagaaataagacatgagggaatgtttttagaggagactgtaaatgagatatatagatgaggaatatagatgatatggttggagatagtacaagactgtaaaattgctatgattttgacattggaactgttaatatattaaaccatttctatgtgaaactcttaaattccaaatagtcgctacacgctttgtttgagtacgcatacctatggctatgttggctttgcaaaaagaaacacaggcaagtatgcaggtcgaatatattagtactgttacacattgtcatgtcgtgtctgattacggcaacttattctaagagaggtcaaaaggagtgtcgcttgcgaagttggtacactagagactgatgttgtttcattgtttgtcctttgatgatggggtcgaagaatgatgcagcctagctttgttatctctgtcacggaagccaaattgttaatgccccaaagcctagcatacgcccgctgaatgttcagcagatgaaagtggcgtttggttagaaaattgactagaggtgtacaattattgggtgcatataggtcaagatgcttgctatattcctcttgtatctaaggacagtatgtaaggaaaatgcaattttaccactagcgcgtcgacgtcaaaatatatatatgttcgtgaggtttaattttatctatatattccactgattattagcaggtgattttttaattcagagggaaaaaagagacgtacacgcggaagctttttactctagtagttagagttagttgttagtactattgcagtgtagagtaatttttttaaaattgatcatagcgtggccatgtacaagattttttttgggtttactgttgtgacgcagcatgcatgcatgcacgcatttttcttccatgcaaaggcttcccacaaaacttctgttagacaggtcagtaggtcatcactcactcgatcagtttcggccaacacgtcgatttgctgcatatacacgtattggcgccacacgcgtggatggcattaatttgaggtataagctatataaatatatttttgttccattcatctgttccttgaaaaggcatcaatccgatggggtgcgtgtttaactcgagcgagattcatttggtggctgcttagcatcatggctgacaggtgaaacagtggagcaagctaacaataaaacctgcgtcagttgatgtgtatctggtcatcactgtttccgtcaactgaaatactactacgaatgagtatctagccactcattgacaaatgctgctaacgtgtactggcatgctcatgagatcacatcagcaatgttctggggtttggtcacttggagtctgccactgcaaataccttcattagtacgtattgtgcaacctgctgc

SEQ ID NO: 4587 - DNA, 2640 bp, Zea mays
  misc_feature (1)..(100): optimal_loci_262409_G1, chr7:153849396..153852035, Cluster 28
caggctctctgctacctgtgtgtagcgtttcgccttattagctagatccatggctagcttatcacgtttctgaacaatctccttgttccattactgtcggaacacatgactaacacgccaattaagcggtgtctctggagtgaaaagaacatctatcctacgccgcgcgcctactaaattttgtatacatcacatgtgatttgtattcgaagttgatgttaactggacgcggaaaaatcatgcattaattaaatgttacgaagcttctaaccaaaaggcatgaacaatggccagtggtgggttacatgttacgaagcttctaaccaaaaggcagcacacaataattaaaccgtaaaccattcaattaattaaccaatcgacaaaatccaaagtagctagcaccgtttctttttaaaattctcgatgactaattaactaaagccggtggtctgaatcttcaataagagtaagtacactgcacacatcaacgtgtatatatatagtcgtttgtggcggcaagtggagggagagaagttgtagaaaagcaacgaacacaagctgaaaaggcggagattcacttccatgtgcacagcattaaggttgttagaacatttggagtactgtatcgtatcaaataatccacgtcttttgatgttgtcctccctggcgtcattattcaagtagctgaaagctctatgttcttgtaccgtgtacacacatagatatattcttcatccccccccctctgattaagaattgcgacaagttgcattttttaaaaatttcaagaaataattgatccaaaagattgcttgattggcttgcaaagtcaaagtttccccaatatcatagtaataccgaaccagtaacccagtcctgcagggtgcgaaaaacgtacactgcttcgattctatgtggagggcaatttctagatacatgtcaatatttaaaaaaaacacacaaattgcagaagattaaactagttgcaagaagtatcttgtcatttttttaaaaaaaaacatatcgatggaagcggggaaaagagtagtttatatacagaaaacagcaaacggcatactcatctcgtcagtgatcagtcacaagacaagaacaagaacatctatgtgtagctcacatgcttccctatatatcccccccccccccctactgtatatccttttcccttttggtttcctctcccctctctcttactcggacaggaactcagtacagttggccctgttggattgcaatgttggatcgtgttcgccggacaacctaccagcaggggcgagaatcatcgtgatcatgtaaagcaagatatagttatatgcactgttaagagctagcaaaccatgtcggttgggtccatcgggcaagaaataaagttgtttttggcgcggcgcctctcgtgcttcaattcttcttcaggttccaatataatgtttggaaaagcagaaacttggagtgcatgcacaaccttttgccaccttttttgatgctttggcatgtgaacatcatctatgtgcagctaggttgcaggcgtaatttagttcgttccccaaatcgtagagactttagtttgcaagccgaaacagatttttatatatcacctcgcgctcgtttattgttttccgattgtttcgttgcagccggtaggtatagtactgggatgcatgatgattgatggaagaacgcacttgaatatcatttcgacattatctgagagaaaaacgatcctgcagcaggacgatactgccgacgtgaactgcacacccaactagctagaataaaaattgcatgtaaaagggtggtggttctccgttcttgtatatagaagagagatatgggtacaacgtatgcatatgctgcatgcaccatccccacccagttcacggccgagcgaatgatgtgatagctgttatgtttaatgcactctaactggaataatacaattagaaaaaggcgtaaacgcatgattgctgcgaaattaaactatgatcgatttggtgcgtagaatagtctgcaaataaacaaatgtatagggtttgtatagaatcgaagaataattaaatataatatatggaacaaaccgatggacatcacagcggagagtggagggggccccagccatggccgatcaaggcacatgactgctagcaaggatcgtttagatgagatacttgattaatttagaattaaaccttgcccttgtagcagatccacgatacatgcctgccttctttacgaggcctcccactagtctgacgtaccaaagcagccatctccatctctccttcatgctcagcccaccggcccacatccgcgccgtgactcgtgagtccgaagagttgggttccgtgggctacacgggctcgaattctgatggactgcgttgtgtgtgctttccagctaagcccactaataagaggatgggtaatgggttgccgttgccattacttgtagtccctcttttagccatcgaagaaaaatgatcgaatatgtctgtgtctttgcaccaatgaatattttcagcgataccaccagcggagcggatgcggaggcacggagctgtgcttgctcgctcacgcgtcaaaacagagccgagcgcgagggagcccaagggagtggagccagcag

SEQ ID NO: 4588 - DNA, 1515 bp, Zea mays
  misc_feature (1)..(100): optimal_loci_262547_G1, chr7:154433807..154435321, Cluster 28
gtgaaaacatgtactactactaccactgataaatactcctccatgcatctttttcatattttggaagttgtttggatatatctggcatgggaacttacactactagctagtgtgtatgaaaatgacgaccagccagcttggaagcacaaatatatgtgagtttatgttatatcgattcgttttcgtaagaggattatcttcgtttttttttctgaaatttaatatcttcgtttattctattgaggagacagccaactggaggctggtggaacagcaataatcaggttatattctcgctcggtcggacagcatgcatatgcgcgatcgagtggcgatgatatgatggaccggtgacatggccgtggaaattaatgaatcctccgtggagatagcaatcgagtggtgtttattttagtccaacggaatttttcagttgaagctgacagagagagcaactgcatctgaaagtaatctagctagagttcaccggaaccctttctaccttgtaaccaaactaaccgtaattttcaagagattgagaggaaaaaataattttcttgggacacgtagaccgcggagtgtctatctagctctccgttcgccagtgatcacggcgagtgctccgcactacgccactacaggctgaaatcaaacaaaacctcagctgcagagctgcaatgctgcagtggatgcggccatacggatttgtgatccgtgagtattgtgcgcgacaactgcgcgcggggcgaccgaacagatgctgccacagctcaacagctgtagtgagctagtgatcgatccatggatcggacgatcgattactatatcaaagttccaagctgatatgatattataatgctccagcttttattaatgcacggcatcgtgatttgtgacgtgcggattggacgatcgatccgtgatgcacgcacgtaaatatatactccagtattcgaaacggaattctatcgtcgatcgtcgtcgtctacgccatctctatggagcggatcagtactgcagggccgcacatgcgctcgtccaataggcctgatttggcacgcaagttcgccgcacctcgtggccttgatcggcgtctccgttgacttgtttcgcccgccgcgtcccgtccctctcgccgtcggcgtcgccgactcgccctctctgctgtagtgttatgcatgatcctcccccgccaatttatctgccgtgtatggcgcgctttgacattttagatgaaccgccttaatttcttgaaagaacgggtaatatataataactgccgttttttttcccaaaaaatgaagtgatttaagtttttgtcctaagcaccaacacgtataaacaccaaactagtttcattaatccacgacaaaatttatatgcgatggtgcatttttttttacattctagatgttaatatatgtttataaacatgatcaatactcatatcactgtctcagcttgtcctcttattgtagcctaagctcgctataataagttgctctagctttcacc

SEQ ID NO: 4589 - DNA, 1594 bp, Zea mays
  misc_feature (1)..(100): optimal_loci_263490_G1, chr7:158993547..158995140, Cluster 28
actaacaattgatctttgaacatgggaaccacaaacagaacatgctcgtcccaagatgttcagcagaactcaagttcaagctacaaggaagtagagcctcatcacaaagtcacactgaccttataagataggatagagtgtcatatgtagcttgggtaggtggtcaaagcaaccaatgaggacatcaccgaggatcatgagtgtgccctaaggggcccacgtagccaatatgtcaataaacttggcaactaatgccttttgtgttttagtggtcttccatcaactagcttatcaactcattgaacaatcatcctatcaaaatccatgaggcctcaatgatcagttcgtcacaacatgatggactatctgtcatgacaccaatggatttacaacatgcaagtgtagagaagcctctttcacctatctaaaaatatgagatccactataataatgttgtcctatctacatctaattttaaagtcaaaaacttcttcatttttaatgccccatcgacctcgttcaaccctttttctcttcattatttatatatagtatccggtaaaaaatatcaaaatcaaaatttagtgtaagtggggtctcaaacgctagacctcgtgatcaaaaaggtacttgcatgacaatacgctaagccaacacttatgctctttaagaaatcatttttttaaataacacaagatgatccaacatcataccaaaacgtcccgcaaccaccgtgatggtgccatggtggccatacatgatacatataattcgattattgcaaaactcaagtgttgtattgttatgaggaactccacaactaacatctcaagttcacaaagaacgtaaatacgcttcctagctaactaatcgctcgggctattccggtgcaaacatctactcttcttcgatccgaagccactctttccggattcaaatatggtgtcatttttcctacacgcctaaatctatattatccatatcctcgactacctttcactttccgataaaaaattataaatccatatcttcaactgatgttaaaaaactttatatctttaactaatattaaagagcaaaaaagaccttggtctagcccgcttttgcattttatatttttacttttcaaactgtcctcgcgtccttcatatcccatgacttgaactcgagcagggtaaaaaaatctcgaatgagactcggcgaaaaccgccaaaaaatctcgttctcgatgttggacgccttcaaaaaaaccgtagattttctcattatttcgttttaatttttttattccaaaatatatatataaactaaagaatctcaggagtttataaatatatttttattcaataattcatgtattgatattaaaaacaaatttgatttactctagacccgttaactaaaacccgaacccatatattctctcccaccaagaaagcagcgaaaaccatcgagaaagtggtgaaaacagccgagaaaaatgaaaaaccaatattcaaatttgaaaccgctttttcgctaaaaacccgttctcgggggtgagcgaaaaatcactttaaaacagggtgataaaccctagacccgttgtaacaac

SEQ ID NO: 4590 - DNA, 2200 bp, Zea mays
  misc_feature (1)..(100): optimal_loci_263579_G1, chr7:159412201..159414400, Cluster 28
attgttaacttctcctgttattacaactacatacaataaaacccaacatagcacatcacatggtgcaatttttttcttagaatatatatcaagtgcagaaacgatatcaggtatcgacatccacatgatccagtgaatcaatctaggtaatttcgtggcccgcaccccttgctatgtggacctaaccaaaaccggcgagcgacctcatgctcatggcatatgacaaggatatatacgcatctctaggataaattatcgtgtctacacgtacatgtcattagggtagctagggtgatgaccctagcacacactcacgggcagattaaaaaggagggcgaccaaagccacgcattagtatatatatatatatcgtgcaacactcattacttatttgaccacatggcctaagcaatgactgaagacgattatgctcgtatggctttgttttctatgctcctcatgcaacaccttttgtcccttctcaattagtcatttcttgcccctttttcagatgtgtgtcttttattggccccgcgttgtttcacctttggtatattccaagcttttagctcttagcaagtctaacatagtgtgtagtttgggcacttaccgttcactcatatagtcagcaaaacactgttttacacaattttacaccgtatattgtattttttgtaaaacgtagtttaaatataggtatgagtctaaataagttgctggagatggtcgtaatggatgtagctcatgcgtaaaaatgtcttttgtgattttccttgttgctatcaagttgaaatggcaagtaatagcggactctgatcttgctaggcgtccaggatatatacatattttcccccgttggagtttgaacttttttctattcacgtcatgccttttcttttctttttctgtttgctagctagctcttgatggagattaaactttagtacagtacaaagcatgctcctttttttctcgaaagaaataaaaagaacattcttttatgtcctcctcacccgtttgtatcttttggttgtctttgtttgttcttttctcaacccatgtttatttgtctcgttttaatttattttccacagtatatatttgtcaaagcttcctgcttgtttcactaatatccccatccgtattatataaacagactgtaattccaacaaacgaagcatatgcgtgtatcacaataaaaaatatggaacctcgatcttcttctcttctgaaatagataaataatagtatacgaactacgaagtgaaattttgttgttttctacgtaactcctcggcagtttaatttctgtaaatttcaattaagcagccccagatcttcctattttaagaaacatgttgtcttcaattactcagaatatccttatgtcatcacattattcacctacgtgcccatgagtttgagcatttttttacggacttagacatatcattctaatgttttttattagaaaagtggccggcgtatatatcactgaaatctacttatatactccgccatatataagatgctagttagttgacttgactacggctccagaaacaattaaacaaaaaatttatataattaggccgatcaataaaatacttgaaatctagaaccgtctttatttgtctgtttcttggacagtaaaccagtcaataagacatgaggccgggaggtgattactctatatgatagttggattgatagggatacagtattcaataatttcgtgtatcactagctagatagctaaaggatacgtgtatgctccttctatctttaagaaaatcgtactgtactataacgtcacttaaaaaatcggaggcacgcttcatagtttatatttaactgcagcgcctaatggtacaatgattccacataaaaatatggttgccaattccactaggcctcttatatactactactagtattatattcaaatctcaatgtggcatggatccttacccgagaaataccatggattcttcactagtgtccaattcagacgtagcactaactttatactatttttagggctaccccattttttaaagaattttaattttttagttcattttcctttctgaaaatggagttgccaaattaggtcttaatgagaaaagaatccatggttccacttccacggttacatggttgtcgtgtttcccataaaaaaaattaaattatatataaa

SEQ ID NO: 4591 - DNA, 1523 bp, Zea mays
  misc_feature (1)..(100): optimal_loci_264693_G1, chr7:165461331..165462853, Cluster 28
  modified_base (623)..(623): a, c, g, or t
  misc_feature (623)..(722): n is a, c, g, or t
  modified_base (624)..(624): a, c, g, or t
  modified_base (625)..(625): a, c, g, or t
  modified_base (626)..(626): a, c, g, or t
  modified_base (627)..(627): a, c, g, or t
  modified_base (628)..(628): a, c, g, or t
  modified_base (629)..(629): a, c, g, or t
  modified_base (630)..(630): a, c, g, or t
  modified_base (631)..(631): a, c, g, or t
  modified_base (632)..(632): a, c, g, or t
  modified_base (633)..(633): a, c, g, or t
  modified_base (634)..(634): a, c, g, or t
  modified_base (635)..(635): a, c, g, or t
  modified_base (636)..(636): a, c, g, or t
  modified_base (637)..(637): a, c, g, or t
  modified_base (638)..(638): a, c, g, or t
  modified_base (639)..(639): a, c, g, or t
  modified_base (640)..(640): a, c, g, or t
  modified_base (641)..(641): a, c, g, or t
  modified_base (642)..(642): a, c, g, or t
  modified_base (643)..(643): a, c, g, or t
  modified_base (644)..(644): a, c, g, or t
  modified_base (645)..(645): a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
cgattcagttgagcatactcagagtcgctactatcttcaaagtcctgtaatataggggcacatgctcaactctcacttgttcaaatggtattgtgtttgtcctaccactaccccgttcctggaatagcaacaagtgcatgtgcttttcattgcaagatggagcaacactcacttattcaaattgtttctttgcttcaactctagcaaaaaaaaggcaaatcaatggtgttcttttctcttcatggtttactatgcgaaactaaatcactactaaacacaaattccatactaccatttcggaaaccttaaatcgaaatgcacttgttgcttagttgatggctacctgcatgccctctttccaaccggcgaatgcccccatctacctagttgttgccctaaaatggttgaacactgcattgcaactacaagcagctaatcatcaaagtaggggaggtcggggtgactgggcatggcgggcttggcactatgtcaagccgtcggtatggtggtacagacgctacacctcactggcatttatttgtggatgctggatgtggtggttgcgaacagcacaggcacgcttcacaccacggcacgtgaattggacgaatctctagatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacatgaccgagttcagcttgattcgttattagtagattctgtgaacaagccacagaggtgcgtgtaaatcactgtgcacggcgtctgctggtttcgagtcgacgaccttcgtgtcagtctatccgttccgttccaatctactacttgctgtcgccgtcgccgtggtccaaccaactgttccaacttaacgcgcgctcgcgtcgaggtctctcacactctcatcattttcttgtaaactataagagcgcgtagatactatgttacggaacattagatacatataaaaaactacctcacacaaccttacgtattatatgagtgaaaccgtttatacttagagaaccgtactatagactttccttcaccaagttacacctctttttttttgcgcttatcctcttgatacaccttaaaatacgagttatttatattgatgtacataccctaaggggctgctaaatcatagcatctgaattttgctttgttctctaaagaacaagcagcgtccatctaatcaaaatcaaacatttaaaattcaacctcaagcttgagggcaaacactttggttagttcatctttactttcaagccatttgcaaagtaagaaatgtaaagttgtaaactattttgatttttttttgtaaatacatataactagatgcagtatatataatttcaaggcacttgtaaagttgttagacttctgaccggaggcctaaccgagccagtacgtaggctgcaactccctcatgctcaatttgctagtttttctttttctcagcctagatcgcacggacctc

SEQ ID NO: 4592 - DNA, 1483 bp, Zea mays
  misc_feature (1)..(100): optimal_loci_265326_G1, chr7:168908139..168909621, Cluster 28
gccacttatattctcattatctatggaagactcatgaagagcaactctagtgtaatagtggcttgttagagtaccctcatagagtgattcttataatgccctttttgggatgggcttattacgctaataaacatgtgaagcatctaaggttgggctcgctacaccaagggtgtaggttgtcgacaaacaactgaacctcggggataaatattattcccatctctttcccatgtggtttgcattccaagttctacttgttattacatgtacatatcatatttcattccttacttcatattgtgtagagtaacctttttttgataagtagttttctagtttttgtttttatcccctacatgctactaagaaagaagtaaagtagaactagatcaagacatacacttctacatataagttttatcttgtctcttgttcacgtgataagtttttgttagattactttttataggctattacctctccactttagccatctagatcctatcaagtgcatgttagcgagacttcttcgttcttcagcatatatgttttatcttgtctcttgttcgtgcgataagttttttgttacattaatttttataggctattcacctcttccctttagccatatagatcctatcaagtgcatggcagtgagtcttctttatttctctcctgtccaacgcaagagtagtagagacaagtcttgagactgccatttgataagtagagacaatattattaaccttgaacatgagttgaagttgggttagaccatggttatctgatggcttggaagacaactccaaaaactcagtagtcttattagagacgaactcaatctatctaggttgtttcctcttccaagttggactataaatagaaaattcgttaaaattcttgacgagaaccttcatcatgttaacatgaagagctaaaggcgtttggttctctgtactatccataaggcaattatggagtttatcgaagtcgtctgatgtgcatacctaggaaccgaagatgaaagttggaaccgacaaagttacttgcaagacttgaaattcatgacattatatggtttatcatgagaaacaataactgcaaaagttgtgtaatgctttcgtcaatcatgattatccaaaggaaactttataagaaacatatgttttttgggcccccagtacctgggccctaggcgatcgcccctcccgcctaggcctagagccggtcgtgcctgtgttggctcctaatcttagctagacctaggataccttttggccgaaaggctccacaaaggaagtattcggccacaaggatagacatgtaaaatagaagtaggtctttgcatcgtaaataagtaatagattagatgaaaatataagttagaaagtacttatcgcttcaatccctcaaggctatatatattgtaacaagtacgatcataataaatagaacgccattcgttcaccaaccaacgggtatt

SEQ ID NO: 4593 - DNA, 2235 bp, Zea mays
  misc_feature (1)..(100): optimal_loci_265542_G1, chr7:170117589..170119823, Cluster 28
aaatgtcccaaccagaagtttggaatatatcgcatataccacaaaagcaagcaagcatcgtaacacacaactaaaggatccctctcagctagatgcttaaaaggcagaatctactgatgcagttcagcatgtatttacaggacaaaaggtaaacgataatcaccctaattaggaaggtaatgatcatctcctccattgctgcattaggtttatactcctcatcaggtagacctgaagatccaggtgtttcaatattaggtatagatgccccacccggcgacattacacaaagaggttgcaaaccaggctcaactttcactctcttactcaaatcatcagcaaacgacggaacatcagaggagcgttttggatcaccaccaataacagaaggattaagcatgtcacctaattgattctggctctcactttcctgcgccactttcatctcactttgtctctgtctttcccatgccactaccaacccagcaagttcaattgcaagccttctattttccgctgttgtgttgtatggtaatccaaggcgactaagagagttgaccatctgaggaacaaagtgggctctgcaactatagaagaggtccgcatggcgaacaataagctggaatatgtgaatcatatttggaattgaatgcccttcctctacgagaactttcttggtgtatctgatccatatcggcatgcggctatcatttttttcaggaggaagtctcctaggtagggcaggcatgaggatatcgagagcttgcttcaccaacagcttgttttctggttggcatgtccgtagcagagcaatgaagacctgggaaaatgatatggcacaccttcagctggatataagaaaatgaaaaggatacaacatgaatgtaagaaaaatttatgccacaatacctgtaaaataatcttttcaggagcttgataggcctctaagaaatgacaaacattcacaaaggcccactgtttgctcgagttatcttcacgcttgagatgattccaaccaaactttatgagttcctttcgatggtgaacaagatcagtctgtagatacttcaaaagtaatgtagctagctgaagaagttctatcctcaatggttcgtcgtattcagcgctgacctagagaaatgaagaaaatgaatattcatcatccatgtgctatgagtgaaggtaatttggttgcagacaggattcatatcgttacctcttctggaggatcaagaagcttctcaacaatagttttaattatagtaggatcaacaacttcccaactttgtccattttgaaatgaatgagctagcattggaagtataagaatctgcatggtaacaactaaatgatcttgtccatattgttttgactggaaaatgttcagaaaatgattaaggatagttttcttcaaattcggggagtatccttcagcaacctaaaatgaacatgtaaagatgagacaagcagtcaataaatacacacaaagatcctcatgaattagaaacaagaaatggcattacctctatgacataaaattccttaagaaagctataatctatacgactgcggtacaagaatactgataacatatcaaagagtgcaccaacttcagttcgatcgtgtcttaagtaattcaggaagcatttgatcagcctcttgctttccatcacctgttaagaaaacaagatcattacccaaaaacagttcaatgctgccaaatacagtgttgaaagaatctagtgcagatattggcatgaaagcactaaagttccatgagaaacaataggtattagcattaaattagtaaagtataagtccgatatgtcagactccatacatgagcactgtacaaactgttatagcaattttgatggctacctggggtaaactcaaatcctgctcgttctgcaacctcgcaagtcttgcaggtgatttccaagcaagtagcaaggtgtcaaagacaacccggttgttacggagccactctggcatcaatttcacaagggctgagacaagctctaatccattaaagtaactctcagaagtagtaaccatgtttgatgaagattgtacagtaatactctcagatacagccccagtaagggcttcatcctttacagaagataattgagcagcagatgcttcactttgagagtaaaactgagaaaaggcacttgcaagtattttctgaggtgaccttgcaagtgcatcccttaggtccccagtatccga

SEQ ID NO: 4594 - DNA, 2098 bp, Zea mays
  misc_feature (1)..(100): optimal_loci_267599_G1, chr8:4352996..4355093, Cluster 28
acgcgcgttcgtgccacgagctggttcgtcgaaaggggcgtgcgttggttgctacactgtgtcaaaataattcgaacggacttcaaagaaggctctcgtgcctgaaagtaaggaaacaattcgaaataattccaaagtacctgctcttgactcttgtcattgttttcctatatactattcctcgcccttcctcactttacttgtataactatatatagttcacaattaacacaccaccatcatgcttccaaaaagaaaaaaaaagaggggcaaagttcgaacaggcctccacattgcttccaagttaaccaacaccacttttttttttttttcctaatacagctgaaacaatgatttcatgatcagtcagcgagagttcgttggcatggacaattaattaaatggcacgattgtatcactgttcagagagccgattcatgcattatttcgatgctgctttcaccaacccttatgcgggtggtggccagatttcgagcacatccttcgtatggaatatgccggtacggtgatttgcaggcaagaatcagttaaaaaaatgttttaggaggcgcaaaagtgtgcgtacttgtaattaccacgcgtcgtcgcccagctgggtaactttagttaatgttactgtctttaggttttgtttttgttaatcgatgattgatgtttacttttgtgatgcgtgcctagaatgaagatccctaagctatatatatatatatatataaccttgtagttccaatttatcattagaatcagcgagtacttaaatgaacccccttaattagcatagaaggctcaaaggttagcctaacaacaacggattattaggcgtaacaaattagaggctatgatgatgccagttgcacttagctgatcgtggaagggagaccgctcctttattgactgctggagactacccttggcttccaagagatgatgactgactgctgtttacaacagctgaagccaaggtcagattttcagaggtcctttttgtctctacgctcttctagaagattaacctcggtttacgtaatgtaatctgacgcgtgatgaatgaagcagcaacataaaacggcgccattcttttctctagagagaagtatatatgttgccttagggtccctttagttcagtcatgtactgtcacaagcctagagtcctataaccaaatagatacaagaggcaaatagattctcaaaaatccgttgtattttaaagatctgaagctaattcaaacaaaccctaatgtagcaagtaacaatagaaaacttttcttaggcgcattgcatttttctcctaagttcttgacagccgcattcgataatttctagagttttgctgcattcaataatttgcatgctagtccacctactcttttggaacatgtgagttcagtagaattatggctgcagcagttgcgaggaacaatatttgcaataaatccttttgagtcaggaagacaagtgggctaatcatatcttataatcataattagtaacatcacagctaagtagctagctagctactccatacaaacccaataaatccaaaatttctacaaccctaaattcctggatgaaaccttatttaggtgcaccacagctcaaagggctagtctatatagaagtatatatatagacatatcagcgtagcaactacatgcatgcatgctgcatgcatgtgtcctgactatcgtaactaacctgcgtctgcttccgtctggctgggtcggtcttttctttttacctgctccaccggcaactaatgagcattattgggcatatggatcgagtctgggtgaccacgctcttgacgtctgatgtgggcgtcgatcataactaacctaaagggtcatgcagtcacctagacctagcttattagccagttaaagttatactatgttgttaatacttgcatcatgcacgtttcccatatattttattatcttatattaggtccatcttatcttcttcagctcttcctcctaatctgatcttccccattgcgcgttcgcgtgagagaatcactctctgcaaacaatggctaaaagaccagcttcatctctcgtttttttaacaacata

SEQ ID NO: 4595 - DNA, 1774 bp, Zea mays
  misc_feature (1)..(100): optimal_loci_281441_G1, chr8:95782536..95784309, Cluster 28
acacctctcagctcctcggatatgtcaaatgctaaggcaacccctagcacaagcatataaattcaaaacatctaaacgtacccaagcacaagcctatgacataaagctcacttttagaaacatttggatatcgatttcatattttttaggccatataaaatttttaatttaatatatttttaaaaaggaaaagggagagaaaaacttaggggcttacatgtgacacatcctgatttgctaacgactcattagtcatcaacaggtggagctacgggtcaatgatcattgataggtttgtcccttgtcaactatcaactttgataaatcaatggtcaacatggattaggcctagtggacaaggtcatgggtcagatatggatctttgccatgtagtaagctcaaggtgcctctaggctatgcctatgggatatgttcacgacgaactagggcactgtcacacgtgaatgcatgactcggtccatagttgactaggtctatgtagttattatctttctcctagttcatgctacacttggtgccagagaaccaaaaataggagaggtgcacacatgctctcctccgccaggtgcttgacatgggtagtagtgggctcactcatgaggaggtcacataacagggctactatggggctcctatggccccctaggtcttctagggcctccttagtctcaccagctccctagttatagtggcatgaccctttaagctgtgtgttggagtatttgtgaggccaataatgtcgattgcaaccaaatttggtgtggatgctttgccaactatgttgtgggcatcttataatgtgggtatatgcctatgtaggtctaaaagggttcaataccagtggtcttggtatcctaagcacacaatagagtctactctatggttaaggattgagtatggaaactcatggcattagtggccatggcagtgcaacaagttgtgcaacaaagttgctagggctcttcatatctcagtgatggtctagataggttcaagcggcctaaggtaaacgacttttatgtagggtggaaggaccctaataataacttcttgggaagagggtttagagcctagtgggtgtgtagtcatgtgtgcaagggccctagggtgaccatagatcaaccttggggctcctcaatcgacaccaagcaggtatccatggatgtgtccactttggtgaaattgcggaaggtgtatgtggctaatgagtatgcggttgtgtgcactatggtacaatgatcattgttggtccctcctcgacgagcaaggtagctagtgtcgatgagagctatcttggcataatagtggcatgtcgcgcgatggtgtgaaggttgtaggtttgggcgccctaagaaccctcttagctacaggtaggtcctagtaacattccatggcgagatatagcctaccatggtaatttagaggcctcctccaacctaacttagctagaacctggatcattgtggccatgttttggtcaaggtggcatgcatgcacatgtgcgagcatcattctagggtgctaggggccattatgggagttgctagcattagttttatgatgtgtgtgtgttatacccagtgctcactaaggccaggcattggataccctcaagttgagagaacatagtgtctggcatggtagaatctcactataggcttgatgggggtaagataccggtgcgatgatgagatgggtccgtggaaaatagatgtaggtccgtgctgggcaattacatcaaagtattgtttca

SEQ ID NO: 4596 - DNA, 1576 bp, Zea mays
  misc_feature (1)..(100): optimal_loci_284623_G1, chr8:112702528..112704103, Cluster 28
attgttctgatatccaccacgatattacggaatggtgtgcaattgatgtgtccctccacttgtagtggcttaaggtgaattatggagtcttttagctcctgcaatacaactatctaaggcgcaaaatcaacatgggttatttttgcattagttcccaagaagtagttgtcgggcggcaaatgaaccacatagacatctattctatttggagaagactcataatcaatcaactactgttctttatcacaatttagaagttgtgggaggagtaggggcatcaacgcgtaccaaaacactcaaaggaacatctgttgctactgcaacatggaaatctagcttgaacaaattatgaaaaccgaccacgccaaccaaatccggcctaggctagttctagaaatcagagataggttggttttcctgtctcactcattttctctattcttcattgtttgagggaaaatcaatgcatctcattgaagatcccttttcacatcttgtattagatttcccttttaatttattgcattaggcttgatgacgcttgtgttgctttttcttggtctagccagaaggtcgccactttggctggcaatatctagagtctcttttgctacctacagcctcatgataattatcactaacacccatggaatcatgtcatatcccaaaaaaaaaatctaatttgggttatacatacagaacacttaataaattaagtgactttgacatttgtacaaaactttccaatattagtttaaagtttcttttgattagttacgataaactaattcttgtttaatttttttctaaattagaccagtgaacttttggtagtgtgatgtttgcttttgattgtctaatatgtcgagtgtgcaaagttccaaaacatgttcgtaacaacgatcttctctctctacttgtttatgaattgaatctaatgtccttgattttttatctttttcttggagcttccaaatatctttcctttgcattacaaattttaatcattcatcaacctatctctaaaagcttatcagaaattttttagtctttttggtatcttattcttttaccactgagcgtattctaatttttgagatatagtcaaatatttttttcatgaactctagctagatattttctgtgagtttctcgtgttctcaaatttatttggaattttttattaatttttagagcttctagagcatttttcgtatcctcgtatgctaaatctaaaatttctagaattattttaattctgaaatttagaaaatcttaatttagatagtccttattgtaatctaacttaaccaaaaaaccatcatatatatgaccaaaatgaccagctcaatgagcttgttctagatctgatatccttttctatgagattcaaacttagtcgtcgtcgacgaccaaaatagcccttcatcttctttagctccgccagaagattgttcaagatctatttatatttagcttcattgaaaggtatcatcaccttatttttctcattatttttctcatgagcttcgtagcattgtttctagatatcattctgaccttcgcgtcatttata

SEQ ID NO: 4597 - DNA, 1443 bp, Zea mays
  misc_feature (1)..(100): optimal_loci_289201_G1, chr8:138651641..138653083, Cluster 28
ataatattttaaattgatactgaagttagtattaataccgattttaaaacaaatgtccgttctccggctgtgaaaaaaataaagggagaaaaaaaagcatgcgatgcattgattggttctgctggtgcctgcagcgtacaataatgcgattcagttggtgttatctctgcacgatgcgcaagcgactatgtctcacttacttttgatccaacacaacacttgatccagattgcagagcaggcatccatagctgcagcgatgcaaattgcaatacgttcatattcttttaccgtcctcctcgactgaatttcatatactttcatatgctttcatgtttatataggagtgagtatgcattatgcatgcaaggctgtgaaagtttgtatggatactgtgcgatcggggggaaaacaaacatggttttctaactagcaatctgtagtagtgcattctgaggccggccgggtgccatgcctatgcttccttgcttggccgctcctccgtctccatctgaaaccaatgatctgagcatcttggatctgcagctagtaaagtcctatacgtcactgtgctggactacacaatttgtttgtctgtgtttgtggggggaagagagggagaggccacaactaagaggagcggtaatgatgacatataatctgctgaaaacacaaggcatcatgatcaatagcaacctggaagtagcggtaggcaatcaatcactcactgaggaaccagctagaactgccgatcgattaaagtgacgggtttaattcgtctctctctgtgattaccaatattcgtccgttgtttctcgttcttcgtcatgctgtcctgattgatgttagtgatttgctgtgagattcaaggccggccattgctagctcagggtttgtcaggcaggcaaatggacacctggcacatgagcttacctcatgcatgttcagatcaaggctagtgatcgggtcgttctcactggcctatctctgcctgtcttgatttaatcatgatgcttaccaaattaatgtgctaaatgacccggccgggacctcgcggtgatgatgcttcttcacatgcaagcttttgtggctttcagcagtgaccacttgtttaaattagccggtttgtttctgggtcctttttagtgtcaacgcatgcacttggcaatcctactgatgattaagcgatgatcatgccatatttaagacaacattctgcccataaatatataacaaatgagtcagacaaatcagtactttaattgtttgaaaatactaccactcttgagtcttggctgttttagggaaaaaaacattggatgcacatgttgcccatgggctatgcaaggatcgtgagcactagtgaggttctcggtaggaaatataatagtactgagcaccatatgcctggtcgcctggagatgtcggaccgtccgggccaagt

SEQ ID NO: 4598 - DNA, 1557 bp, Zea mays
  misc_feature (1)..(100): optimal_loci_293498_G1, chr8:160407257..160408813, Cluster 28
gttagccaagaaccaaactgactctaagaatgccctcaaactcaatctagattcttcatataacatcctttggctgacgctttttacgtctttcagcctgacgcaccagctacatatttgcaaacccctcgtatttcagccgaaggtcgttagacgaaagacttggattaaatttatacatatattgtgtacgaaagtagtgcatgtaattgattaatagttccctaacctctgacctcgagtttggccgcatcctctcgccaggctcggctgtctacactacgtactgtgatgtgtgatgttactgtcatgcatgctgctccgcatgagtctcaactctcaagccatgcctgctgcccgctgcctggtagtagctgacactgacacgaaacacaagtgcaggccccgacgcatcagggatcgggaaaatggacatcgatgcaggaaagaaagagagggagaaggctgaaaagggctactgctaaaggagaaagaagttctgcttcccaaagaaggctactactgtcaaaggagaaagaagttctgctttccaaagaaagaatatcactttcactggttgacttactgttcgtcgtccatacctcctccgtttcgtttccactactctcccatagctactacacgaggcactatattatatgccatcactattcattaccctagacgatgattattcaccttgaaataacgtaacagatctttattaattgttaagtcattgtatggtggataatcatcaactattgtaacgaattatatagagagatggtgtaaaaggaccttttgaaatttgcgtgtcaagtgtgaacctcttaattctagggggcgtttttcttcttgtcaaacggatcgggcagttggactcccccccccccccccccactaaaaaaaatatctatcaactcaacagtttaatcttcaaatcataaatattggggtactaagaaggcggccattttatattatgtctagtcctaactatatttttgttaagaattgctcttttatcatatatctagagttctagacataatgcaatatacaataaaaaactgtaatatccagaaaactaaaacatattataatttagaatggatgaagtagtatttagtccaaaaataaaaatggtttggatcatttatcaaatggatatcatttgaaaaaaaatgatgatagtttaatattttttacttaaaataggtacgttatgatttatagagaatgattaagttttattttttaaaaaaaatatatatacagaggaaaaccacgtctgaaaccacaaaatgcccaatttgtctatttttattaactccatggtcaaaagtatcttttttcgtttggttgccaaatcgaactctcgtgtagttcagtggacgaataaaagtttttatgaaaaaaaaacactttacatttttgccaaaaacttataataggaaattagaaactgaacgtagcattttcttcttgacttcacactaatccttgcattttctttgaattatttcaagatttactgatattcttttttttata

SEQ ID NO: 4599 - DNA, 1617 bp, Zea mays
  misc_feature (1)..(100): optimal_loci_293619_G1, chr8:161167294..161168910, Cluster 28
ctcaacagtatatctaagtagtagtccaccatccattagtcaactcgtgcttgagtactagtcgcaccacacccttagggatcaagatgtggatcttgtataccaccaccacacccgagagcaacaagtatagataacccattagttattcacctttatttgaggactaccagtgatttgctagttcaagagctctattaagtgtcacttgagtagtgtttttggccaagagaaaccttagagcatcatatggtttacacattggttcatgaggactttggctcagccatgagtcatagtggtatcacccttatacctcatagagtatgtctcctagaggaaattgttgttgccagaggagagcagattcatcccgccttgacttacctgctaagctcgacagatcttttgggatgatattggttgtatgttgaggtctaggttagatagtttatgcctcactttggacttagcttaaccatgagtacttcaagttcactttctaagccagtataaacaaactctatgccaacactattagagagagacttgggtttatagagtaccacttgtattcataccttatgctatgggactatggatccacccaaatgcccccacgataaagagctcctagggatagcccacatggtaggttgcttcatgccactgttaagagacgactctagatgcgcctctaatgaacttatacttgtgcattgtcttctgaacaacatcatgtggaggaccctgcttccaaggtgtgaatacaaggagtagtgactaacctccaataatggcttcttagtgccctcatgtctcaatcccggtttggcattctagatgtgatcatctcagagatggaggacacaatagcagagggtactaggtcacatagctagctttcctatccccattggatcttctagttgcttatgagggagtcagatagttagagcacttaccctattagagagttggatgagtcacctacataactcaccatctatggtattgcatctatagtaggcgaatgctaaggggctagagtgttgagataggtacatcgagaaacacgtctagtagacacgaataccattgatgagtaggatgatgccatcatggctatcgagcaatcaaagcttgtaggactttttacgttgtagtagaacatgactggcagttctaacaaggactattggctagttccacaaatgctaccgagatgtcatgactcaaaggacaaatgacccaacaaaggacgacagatcaagcttagttgtctcttagttggcaacaccaaccacctatgctctaatttagattttagcaatacttttagacataacgacaatgtcaggccaaggcctaggagcagtagagtgagtggatgctcactatgtttgagtaaattcggcaactctaggatcaaattccagcagtagctcctagctacttcaggcaatagcactgcttcgttggtggtgccacgatgggtgcctgcaccggcacccctcccctcaatcaaccaactacaatctcgaatcgaacctaacaaattccaaatttaccaaatcgaaaatccatgtaactcaatcgatgaattgacagtctatt

SEQ ID NO: 4600 - DNA, 2579 bp, Zea mays
  misc_feature (1)..(100): optimal_loci_294090_G1, chr8:163294540..163297118, Cluster 28
gttttcttttggtgttatgccaaaattatctcataggatttcagtgagtttgtccatggttaatgtagtcttagtttcttcaagttttgacttgtacatattgttccactctatgtcttccagttctatctcatttgcccttctagcactaaagggttgttcttcttccttgggacgtataaaatacaatgtagagggagttccttgccttgttatggttagtgttgtttgcaatgatatccctctagaataaagattgtctaagtatcatatacaaagcaatcttccatgttaccgcccattagatagacaactatagtggcttggctttaaaatgaatatcaactgaaggaggcttcgtcagaggaatcaacacttattttgtccactataagatccaagggtaattcctatggaggagtactcaacctattttaccacttaattaatcatgttatccataaagttgagaagagcctgttgctggtgaatcataacgtgaactatgatgtagtggatctcatgtatcaaaccttcgatctgttggtcaaagggcatagttaagttgatgccaccaagaactccttctaatgggtaaccattgagccttatggccttcttgctagtgcactcaaaatatgcaatgaacttggttttaaactcatcaatagtttcgtcataaaccttcttatgaggctcattgaggttttcataggtggctagatctctagctttcttcggtgggctcttggagaaattgctagacatggtcgagctgattgatgtcttgtgttgtcgcattggacatgccaaaatcatgttgtcatggaaaatcagttgatatgtaatcgttgaccattaagttaagagccaaattgatgttatgatcctcactttaagatgcaagtctaattctagcgcactccttcataattgtgagtgtgccacctagcttaaccaagtagccatgaaggatgtggtgatgaatctttgaatccccctacaaacaagacaaaacaaaatatcaaatatatagcctgttgatcgagtgtatcattaattaacatgaagtagaaatcgactgactaaagccggttgttgtgagtcgacacattgtattgaatggcgtaaaagcctattttatacaacctcatagaaataaactttgctttatctaagacccaaagtaggccaaacgcatataactgaacaacagaaactaagtaagaccgaagcctaaaatcgataattcaagctcctagaacatttagatctaacttaataaaagagtcaattacaacactagatcatccacttgttctcgactagactaaatcatatagatattaagcaaacttctaataaagaagtcaattagaacatattttctctattagacataataaaataaggtatatgagttataaaagagcaaatgaccttacttagcatggattacaacagaacatcgtgattatgattgacgagcctatttatatacgtacaacataagataaatatttaaatatgcaacaaatcaagaaataataaggcataaaaatacatctactcaaatctaaagcatgctgataactagcaacatctaccatcgaataaaagcatgaaaatagatattgcaataacaaataagagttgatggtagccctgacccaattgacatcacgtttgagctcataacacttacttggaataaaccattaagataggggtagtgatatgccaaaagatgatgaaagagcattgtctgtaggatgtttttcctctctcttattgatggcataagtttacatatacatatttatagttcggagttttgaaattctaagaaatatgtaaccaactaaaactaccatttacaaaatatttcctaagatatatggcatcaatcatacttagatcagattttataccgagtacaatcctttctccccttttggctcactgatccgggatatcttggatctagcaccaacactttcttacatttcaaccatcattttagaagtcaaccaaaagtgctatttttggagtaataaggattataagtggctatcaccccttctgtactgttacaaccttaaatttcagaggatgtattaaactcaccaactataaccacacgtagaccaactactaatctaatataggctaataatggacatgagtattggactcatcatctagttttacaattttactatacaaccttcttaaagctacgtaacacaactctaggctttaagtcttaaaaactatatccaaattattagacattttatgtttcttaagtcttaaaaactatatccaaattattagacattttatgtttctttgtagaatatattgtagatttatgaactcgatactacattatatgattatatcctaccttaatcattggtaccaagaacaagtggatgtgaatcatggtaaagatttaattctggttatgttatcttggcatcatgttcattggatcatgaatactttttacctgatgcaaatttgagtttttggaaatttattattatccatccactgtgttaataaatttcttt

SEQ ID NO: 4601 - DNA, 1673 bp, Zea mays
  misc_feature (1)..(100): optimal_loci_295327_G1, chr8:169067487..169069159, Cluster 28
tgagcccgcccaggccgtgctgctgcgtgaatccgtgaccgtgatggatgtagtgcaatctgcaatggtagcacggcgccgacgcgttatgctatcattacttacctcccgtcctcagattcctcccagcagtccccagttctttgatacgtagaatctggatgctcgattgcgtcagttcattcccctctgatctgaggtgaggttcttgatcgagtgtaaaaataaaataaaaaatgaagcctgaccagacagttcggtccctactattactgcttcaccttacaatttgtctgcctccaaaccagcacggtccccaacgatgggatcagctccctcctcctgaacctgaagcctgatccaatttctctcacaccagtctctttccagactgatgttagcgactactgtacagtgtttttttttagcttgcaaaggtggcaatctcggggaagatgtggcaaattgagtgacgagttgagaccgtcaccaacgcctgagcctcgaggaagcacggcgtggcggcatgctgtgccattcaaacaaagagcttatggttccatgttccagcttgcaacaagttcctacggcaaaactcagggttagctaatgccagtagcagtagttgggccggaacagattccctgaaacctgcaacggcccacttttcaggtggtttgggcatttgggctctcttcaagtctggacgaactatcacatcacatcagttgaggaactagtacaactaccttctcaactctggctcagtggtcagtggcggagagtcggagacagtggggcaagacccatacctacaatttctatagactttttttttttgcaatcgatctgcaccctttttttgtctaaacaaatttcattcgcatggattgttgcacagagggaccatttcccttaattttttgtacgccatctcaaattttaatacgaggataacgccgatcaattgctcgctatacaattcacgtaagttttccgtggtgaatggcagctacttctgtaatatatctacctaacatatgaatccggcttgtgaagctttaaaagcttacgacatatgaatccggcaggcggcagctacttcatatgttttggttcccttgcctttttgcaatcgatctgcacccttttttttgtctaaacaaatttcattcgcatggattgttgcacagagggaccatttcccttaatttgttgtacgccatctcaaattttaatacgaggataacgccggtcaattgctcgctatacaattcacgtaagttttccgtggtgaatggcagctacttctgtaatatatctacctaacatatgaatccggcttgtgaagctttaaaagcttacgacatatgaatccggcaggcggcagctacttcatatgttttggttcccttgccttttggtaacgaagttataaagccgaagtcgaagctaaaaggggataattcttcaaacaacgcttataatcatcttttattatcaccccctagttccctaccaatttttttgatggaatttcagcaaatcgtcggatatattgaagtgctttgtcatgttccatcgcatcccatgtatcacgtcttctcccgtaaagaggtgtgcaagcaactgattgttggtataacttagttggagtgtgccatttatacatg

SEQ ID NO: 4602 - DNA, 1566 bp, Zea mays
  misc_feature (1)..(100): optimal_loci_295866_G1, chr8:171634029..171635594, Cluster 28
ttaccgtttctatagattttaatgaaatttgtgatattttgattttgggtaaatttaagtctttatatatttagcacatgtaaaaagctattgtaataatagatattcggtactatgacttcagtagtttcgcttggaagctggtaattatgaaagtgtgcttgtaaattccagattaggaagttgctttggcgacgactttagctaggacaggggtgcaacgtgcgcacgtgcgtggcagctgagagatgcctcgtcagtgtcaaccatatacaatggctaagccgtactagtggtaggtttcgttactttgacaatagcagtagtaaggtatgctattgtacacacccttccaaaacacccgaagtaaattgttaaaaggacatcgttcggtttgaactgtacatttgtttagagtatatctatatgttgaaccataaattttttgttgattttcgaagtcacaaacattctaattgtattagtcccttttttttcttcgaagttctcgtgcagcttgacaacatcttaatttacttcgtttttgcgagtgaaatatatatatgccaatttgatttttatatcgttttgcacaccgtttcacaaaagaactaacttgagccttgagctacttgggaccccaagatgggcagccaatgatgagaccaaacaccatgaaaagcatgcagatttgtttagacctggatttagcctagttaagctacatgattagggtgaagtagccataatctgcaagttgatagttgcagccaagtaaattaattatagaatattttttataataactttatttagagatgttgatattaatactacttatactacttatattaaatttagatgaccttgagctagtttaattttttaccgagcgtaccacttcatccaagaaagctacaatatcagcctattcgctgcttaaagttaatattttaaaataaatttactgtggaaatgaaccatatactttattaatattggaatacgttgctaattggaatataaattggcgcacggatcagaaggaaccgatgaatttgcctccctctgtccgtgacgtacgctgcttaaactaatagtccaccgccttcactttgactgcctgcaccctgctaccctgcagccccttgaccgagacaggattctctgtggccaactcggcctctcaggtccaccgctctgacaactatgtgctttctgttcctcgactgatttctagccttggactaaaactatataaaaactacatattctctattcgctctgacaactatgcgctttctatattctctacatttttttaccgactctactgatctaaaacgagaattactgccgagcgtacagcctactcacctcgtcgaagaaagctacaattataatttaaacaagattgttttaatgttaattatccaattctatatgaagtacgaaattattgatgtgagtgcgtcactaaatcgaaatcgaatgcttgccggactgctcttttttctcgaatccaaaaggagctgcttctgaagtttattttcatccaaaaattga

SEQ ID NO: 4603 - DNA, 2276 bp, Zea mays
  misc_feature (1)..(100): optimal_loci_297578_G1, chr9:3478745..3481020, Cluster 28
ttgtttctagctttatgttgagttagaaacatcataaattttgaattgtggtacaaggaacatatatgtactcatgatattatcaccttcatccttgtgactagcagttgaacactgcggaaattctaatcattgaggctgcattctcagactaaacatctctttttgcttttagtctgtcagtgacctgctacctttctcatcgtcttttcctttgagaccactttgtgaagtttacgacctctctttcgagaatctctttgctcaaaataagggaaaagcttaagatgaacggaaagaaatccctgtacagccagaagcccataatgttcgcagtattgatgtactatcaacattcagtattgctttatttttattatatctacagttaacacttgcatgcctattattttattgtagcatcaaatccggcaatgtcccaagcccatgtaattattgtcgtggactggcgtatggatgcataaagtatcaaaaagaaaagaattattgataagatcgggggcgtaggcgaagttcgggttgtagaagttacggtttaggggccctcaatagagcaaggggctccaatggtgcttgtttggtccctggctctatcgaatagcctgagctattcatatatgcaatcttaacaaaagcgataaaattttattgtgtcgaagttaggtacagaaaccaacacacgtatagtttagatatgttcgggttgtagtgtgtgtaatactatatatcctctaagtattcattgataaacacaaaggtactcaagaattaaatatgtgccatgatctcttagctccccttttgtctttttgtctcggacgatgcaacaggggcgttggacaccgatgacagcaattagccttgacctttcttataacatgtagccttgatgtgaaaccatattttgtaatatatataatattttttcttttgcaactctgctctttttgatgtgttagctctagctcctcaacgtcacaagaggtttgctttgttcatctcatggtccctggccccttggcatgaggtagctaaattcggggatattagcacaagaaggtccccaacacagttttgagctcccgaacgacctaaggcctaggagccatgaatgatgtaggtttcgaggcctttggtcaaaatagggcctccgatggggtcttcttccttagccccaaatttggtctaggagccaaaggagcaacaccacgagtcatagctaggaccttagtagtgcaagggccctaggcgtaacttgtagccgcccccttaggattcgtgtatgttacgatttaggggccctcaatagagcaaggggctccaatggtgcttgtttggtccctagggcctcggggggatcaagatcgcaaggggagccactggctctatcgaatagcctgagctattcatgtatgcaatcttaacaaaagcgataaaatttacctgttgggagtcatcctcatgctatacttatatatgcttttgacttataaaaattttctttgggacctaggtaatgccttaggaaggaggtttctagtacgaggtcctgactaaatgatgacacaaaggaaggccaaactaggctagaaaaattgacccatcaggcagagtggaacaatatcagggcttagcccttgctaggggtgctgcttacagacatctttgtcaaaccatttacacagaagcatgctattagattccaacctgtctaggcttattgtaggatgcatgaatgtgtagaggttgaactccctaaaggaataacagaaaaacttaaggcaaattttcataaccaaagagtacttggcccatgagtagttggtagcatgccatctcttgcctttggggctcatgtgccaacaccacaaagtgcccagaggaggtgctccccaaagataggcctctttggatcggagtggttcctactccaatgctctaggagttcccaaatagaaggctccaggaaactaagtgtttctaccattataagtgtcctaaggcatggggagggggataggcacttcaatttatcatgagtgccttagggcacgtgagggccctgaggacttagaccatccttgcggactaagcctaggggcatggggggttaggtaaaacatttagtttagggtaccttgaggcaccagggcccctaggtcttaaactttccttgtgggttagttcttataagcacgagagtgccctgaacttagaagtgccctaaggtcctgggtcttgggaccctcagttgt

SEQ ID NO: 4604 - DNA, 2308 bp, Zea mays
  misc_feature (1)..(100): optimal_loci_297768_G1, chr9:4300609..4302916, Cluster 28
ctaacttagaattctggtggatacttcttccatcatagtggaactctccatctttagatacaacttccctatagttgactaggttagtttcctttcccatggaaaaatagacaccttattctgtgtcttcctagtagtccttgggatgacacatctcataccgggtagtcatccctattggtcacctataaagattcccatgaaaaaccagaacatggcaacacaattaaatcaacaacaccttctccacattagctcactcacgcagagatggtgaagcatagtgataagattaaatgaaaacaaatgttatgtaaggcaagacaagttatttgagctaaagaactacagattatatctcactatttcattttaccgtctccataaatacaagcttattacaatatacctttgaagcacacaaagaaagttctaaggttgaaccattcagatagcttcagagacagtgtgttgaacgtgaggaaagcacatggagcattaagaaaaaggtgtccatttgcatgggactatacatctatttataggggttatcggtgtacaacttcgtacctattagggacattgtcatattttcctctacaaaatgtgttgtgcaagtttcctcaatcatacttcgctcctgcaacatcaacggtggcatttgctccttctagaatgctttgtccgaactatggtgacgaagctgttacctccttgatgatgaagttgttactttgtttaggtaacagagttctcctagatgaagcttacataactaatcctgaaacaaatgtggaaatgaataatactcattagtttgaggacatttggctagaggcactcccccaacagtccctacggggaatcctaaggatcttggtccatcaagcccccaagctcttcatgattgaagtttgaagtcttcttgaatatctgagttcttgtcgagtagaatcaaacaacattcaagtacccttctcaagagaaaccatgagaagtgttcttcaaatctttcttcaaatggtgtgcactttttttgtaaagcgcatctagtggggtgcagcccacaagcctcgtgttgtttagcataaagagcttgtgggttctttttgcaatcttctaaccttaataagtccattcaaaaacattgaatccgtccattgagaacatatgtcctatagtacctagcctaaaatcgagtactgagtatatgatcttgattattagggtcttagacatccttaggggtgttgaagagtaaatgtctcttgacaacgatcaaatactgcttgtcattgagtggtttgacatatttaaatcacataacaacaacggttaaaacctttaatcatgtctgctatgatggtagagtaccacatggcgatcttacaagcccatcaatgataactatattccaaaaacttactcaactaatcttgattgtaacaatatccatgatgcataagccctcaaacatagatggagtacctaaactgattgcaatattatcttggtagagtacttatttgctagtgtaactaataagcaataaagtcaagtatttttcgcttgtgttgattgtgaactgaccaccacatactcatcttcatgccaataacaaacccctcaattagatgcgtggtaaaagatatatccattaggttttgtaatggtaaaaattctatcgttggggttgtaatggtagactccatagaaaatacacccttgattccttttatgaatagataatctcatggtaaataatattcaccttccatccttgccttttagtcttttgtacccctctccctcttgtgtgcacatccttcgtgtcaccaagccctcttgtgactccctttactgaatgagagtgaaagtccatgcatacatccacatgatgttaaagaaggcatggcaacataaagtacaagatgatgaagatgggagaatggcataacaaatgaggtcacctaaccccttcattgtctaggagtccttgaggatgaagtaatcatatatgcttgccctagtatctgatggggtacttcgggagaaagccatcggagagtggaaggagcatgctaaccatatcttccattctcctatgtcgatggagatagttgtttgtacgtaccttttcgagtgggcttttcgggctacctgcctcaaattttcttagaggcttactacattattacttgatcacccttgaccatctcaaccccaactctatcgtccctctcaatctttgtccatttctataaagttttccttagagaacctctaaacttttattcttcaattatct

SEQ ID NO: 4605 - DNA, 1656 bp, Zea mays
  misc_feature (1)..(100): optimal_loci_298665_G1, chr9:7775580..7777235, Cluster 28
ctctctttaataatttttttcatgtcattatacttccttgtatggtagcatatttaataaggatgaaacacagatgaaatctccactgggaatagcctaatgataacagaccaagcaagaatggcacaccaagcaaaaagcggaaccattaatgttgattccatatagaagggcagcactcgacactgcctcagtctccattggcacatagatgcacacctttacttaaacaagcaagtcaaaaccgatttcattgtatctgttaatggtgcttaaaccaaacaaaaaacaaatcgatttgcatatcattgcaattaagttgcattacaaaaaattgaactaaacgctatcctgatacaaggtataggattagttgatgcaacttatcaaattgattggatatgttaggaagatagattttccaaaataggcatgggatgtctgtaattttaattgatttaactagcatgagcatgagatgaataattgaattttaccatgttatgattagatcgatgacaatcatatcatacatttatgatatgataatggttttacatcatatataataagtcaatttggatcatgatcatgtgttgcaatagaaaaaatatctaaccgccttaacataggctgagtgactaacaactaaagtcaaggtggatcgacaagcaatactttatccaatgcagttctgcctataataaattcaagtttcccctttaaatataatggatttgagtcttaatagtgactttgtgaaactgtaaacatctataacataagtttttttatctcacctgtagagtgttgacatcagagtaatattataatctagcaactcaaaccacttgcagttgaacctataacaccaaacaaatatgaaacaagaaatatctagttatagacttactaattttagctactactttttttgcaagtcaaagacattttatcaaactcactcaaaacctttatggaaaatcaatgtaatattaatgacaacaaatagtgtcaaccttttaggtctgacatgctattggtcataaagtatgaaagctttctggaaaagtgcatacagaaacatttagcttgtcctttgatttttccctactgttacagttacatttagcttgtatccttgaactagtcaaagaaataccttatttgaatcagattgccaatattttggcattgtaggcacttgagatatgattcgcccaacgattcaacagtgtgtgaagcttcgagccaccccacgggccaccccactccatggtgcacatagaaccgctcttctccacataggaggcatccaaacgtgttgtgatatgttacaaccacatgatatatggagaataagttgaagcacatgccaagtagtttggggagggcagacatggttgttagtgtcataggaagtccataactccagctaccaccaagaagcattcaaggatcttggtatataaagttttcaaagagctccacctactaggaccactactcctaagaggtcattacactgggccctaccctaactttatgtaggatagaaccttgaccctcttggtaacttgatctcaagacaatccaaaggaatgacagccacaccaccaagtccattaaggaccattatgggaccaatgacactct

SEQ ID NO: 4606 - DNA, 3090 bp, Zea mays
  misc_feature (1)..(100): optimal_loci_302113_G1, chr9:26622911..26626000, Cluster 28
tgctcatcatctgccgtgtacacggattgtgcacgctgaactacttacatgtcagattaataaataacgggtcgatctagttaactaactactccggcgtgttaacagtctcccggatacttggattccctggcaaggaaggaagtctagtacgttggtcagacagacagctagctgtgggcagggggttaggttgtaattaggtcactacctgctgcctggaattgggggttaacatgtaatagtcagtcccttggagggagtgttagctcagatgggtctagcaagcaaccatataaagcagaatgatcatgtgctcacaggccacaaccatcgtcgatctcactgaaacacatgcatgtacaagacaataagaagacaactgttctgcagttaactaagtttgttaatggataacaaagcacatcaagctgcatatattattctggcacattcagaggttatggcataccagaatcaggtagcttgtgcctgttttcaggaacaaacacagacacagatgttgaggactcggaacagtttcctacatctgactggaactgaatccctctcctctcctgtgctaaaaacaactgttgctgccagtaaggagtaggaccgacatcgacatgctccgaaacaaactaatagctgacgaattgtcaacctcaccaccgcaacagcccttgcttcatctgcacgcacaagctagcatcagagttgacttgggcatgcatgcacggaaacctgcactcaatcaaagacagttaggcctgcaaatcaactacaatgctgaaggacttggttttatttatttttaccacagccttattactgaatgaagcgcacctcgctatccactgagagaaaactgtcgcagagcggcacagttgtgttgtgtgtccgtctgaccatcatcgatctcgctgtccttcagaaagcacttcaacgtacttacttgggttgagagggatacataatcatccaaacgagacctagaaaataatccaaacatagtacgcaaaatctaagtcgttttggattcttgcgttacgcaaaatctgagccgttttttggattttttggtttgatatatgcatggtgatttgtatgaaacatgcatggaccaataatgcaaccatcatcgtccccgcccccggtttcagtagaggtggtgatgtcaacagatgcatgaacccatgcaaccaacaaagcccggctggccggctccgcctaactacctagtacagattatgcgaaaaaaaactgtcttaatctttgtaaatacaaaggctagctacacaagtttcatgccacagcacttgctagcttgtcggtttatttctacaccaccgtgacacaccgtggagatctggtctgactgtgcactgcaagttgaccatctatctgatcgaagaggaaaaagaactgcatctgcccttatatacagtcagatttcgctcttgttttttgcagctatccattcattaagatccagttcttatctaatccgaatcaaataatgcatcttgcggtctaaattaccctgtaacccaagatgtcttctttcgaaaggagaagggaagcacatgtaaaccgtgatagtaacaactccctgttttttttttgggtcatacggagggagcaatagatttctttgatgacgtgcatgatgacacatgtattgacacacctgatctagcgatctgtttcccattaaacaagcaacacgttgatcctatacatatgtaactgatgatgtcaacgcgaaggaccggagcagggaactcggtctccaacactcgttgttgactggcccattgcatattattatcatatcctcctgatggcgtctgcaattaatagtagaacagtgtaccttccaactggatgcacatactattgtttaatcaagctgtccttcaggtaattaaacaacagatcgatgcatatatgcatgacaagcacgccctgattgggattcattgttactttaacgacatggcacagatgcgtgtgtatgtagagtgaagcagcagcggcgacggatcggaggggagagatctacgtagaaactttgacatgcagagatcgatcaagccacaccaaattgcaacaaactagctacagctcgcctaacggtgacatgtggtggacaattggatcgtgtaaagatctggtccccatttctttatcagattctgtttactaactgctacgatataacattatataatatgctcatcaagttgcagttaactaacatgtctctccctgttggtcttggaagttctgagaagtcacttctaaaaatacgactacatacggttggattacgctaggttatattaagagacttattaagttaatgatgtcctataatagcgctgcacaactgttcatcctctttcatattttccattacttgacttaaccgtttggaaatatgatctgtttgaatcattctctctcagaactgattacaaaatccagataaatttcttcttttatgtttctgagtactaattttggctatgattagaaaccgggaaaaataatattattcccaacgacagatgcatggaccacaaaagcacccaaagatatataggaaagtgaaagtggtgtatggtttatcacaattagaaagttgttccgccacattttcaatactgttgcttcctgtgatacacatcaattaatgatgagctgaaaacgattgtttcattgatgaacctatctatatatagggctgtacaagctgtcagtatcgagacttcctttttctgcagttaatccttctccgtcgagaactggttattactgccaacctctcttcacaaacgcagaataactaataacacaaataattctacagaagaaatctaatgaaacgttcatatcgcattattctgcagttaatcttttctctgattagcatagcatagcttgtaggtactaactgtacagttgtgtgtaggatttgtcatcatctgtgagaaggtttcggtatatattaattagtgtacaatggtacgtatctatagacgcaaaggttgccacttgctaacagtaatacgctgccgtcgt

SEQ ID NO: 4607 - DNA, 2402 bp, Zea mays
  misc_feature (1)..(100): optimal_loci_31177_G1, chr1:191863907..191866308, Cluster 28
catcggtgtggtagataatacatataatgctatatacagagagagagagccgccgttacctagcaatagcaacctaatggttctgtgagctactagctcgttccatgttttattcagaagcaacccttcgaagctacctagctcccagcagagatgtatgtgctcacaggctacaacactacaccctgtcaatgcaaaagacgagcaggcatagaataaggcattgccttgccttgccggcacgcacggccatgaccaaaatcgtacgcgaaggcgaggccatgatcacatgcatgcatggctgtgtgtacagcatcatctagcggctccgcgactacgtataatatcggtcattgagtcgtcgcttgcacacaacgttctcgtactaaaacgcatgcatgcataattaaacgacgacgtacgatacatacgacagacggggacctcgctcgatctgagcttttaatatctgccttgtataatgacagcaggggcccagtatagttaatcgtgaccgttttggctcttccttctcgacctacactgcccggccggccttctctgccgttcttggattattgactaatccagccgcggcgacggtttgaaagattcatcggagctgtgctgttgcccggcggcggcggcagtcgcttgagacggctggctagctccggacgatctgtctatctggaaatagctagcgccggccgggcgtgtccgcgtgtgttcttaactggtttggcgatcctccaggtccactgacggccgtcggccgggccggcaagtctaaagaccgagcgaatgaagtcgcaattgcagatccggccactgacgacgacgaccaccacatgtttgatgtttcccaatcgaatcatcagctcatatatctctgcacatctcctcctgtacaccacgttacttcattctgctctctgcatgcgtgcatgtgaggctctgtgagctagctcatcatcatcatacacgcgcattccacaagttcagatccaagaaattaaaccctcctagatagcctgctggttcaaggttcatccaattaaaatccagatccaagaaaaccctaccctagtctagtacataccctccctcgtaggagtaggacccgactcggtagattttggcatgtggatgctgctgtaatggtcaccgcgttcgtcatcattcgtcgggattcgcggacgggtcaaccgtcaacgctgagttgccccgtcgctgccgccgttttttttatttttatttttataaaaaaaagtttaactatatttatacacttgtgtattttaaatttcttgtttgagttgtggtctcgacttcgatctacgcttcatatctcggcgtcatagttacgatgatgaggtgctgtctggttcatttcagagagtgattaacgtaacgttaatggatcccactgttattggttccggtgcaacataaagcgatatatgtttgtttagctaatgttatgtattaacatttgcttgggagtggtaacgaaagaaaggaaatattcgaaaagacatggatgcgtatccatttacggtgtgaataatccttacggagaccaaacagaaaagaaagggaataggtaccactgtaattggatcacagacaaaaacatctaaccaaacaggctctgagatgtttgccataaggtctaacctagcgacgacgcgaacaatatctaagatgccatagatcttggcgacgtgaacaatatgtagttttctcgatttatatttagacccgtgtgttgttgcattttgctaataacaacattttttatgcaacggttatgctgtggttagggatagtaatgggttctaaatttaacactataaaattttcaaactaaaattatttaaggttcttaatttattgtgaataaatatttgaatcgtgatcccttatcacttctagttgtggcactaaaggtgaccgatcgatatgtttacaggtccaaagtatataggcaaacgagcaatgccatgcggatgcaacgcaacgaaactaggttttgactcagtgcataaatcgttccagtgggtctctaacatggtgaggtcgttcactgtccacacagcaacggttggtcaagttccattagattgattacatgtccccgtgcatggtgaacacggaccataatttccacgagcttttgcaaatgtccaccctgatccgtttaccaaaacaaactggccgcctggtgctaattaatttccttccggggccgcgcctctgtggcacgtacgtacgttctctcgagttaggcatcgggttccagctccaccaccgcctcaatttgaagaagaaaaaaactagtgtgggttttgagatctcatctgagcacgtttactggacctctctaacttgataagcta

SEQ ID NO: 4608 - DNA, 1430 bp, Zea mays
  misc_feature (1)..(100): optimal_loci_321106_G1, chr9:138747451..138748880, Cluster 28
ttacactcgaggacccagtcccaaatcttgtatgcaagacaagtgaaattcactctacttaatacatcatctggaaaattgatcagacaaacaggaataatcaacgtttggagcatgctcgattgctcgaataaacacgaaagagtagagtctctagtaagcttggcccttgagtggattgaaaagtgaagttgtgtttggttttaagcaacaacttaaccttatctagaacttaattacatgaaacactacaaaaatgaatggactatatatttgtataagactacatttagtttcagtgtaactgtgtaataagcatcccaaaacacatatttaacactgtataatgaagttacacacgtcatatccaattaagagttcaataactatacaacgttattttattacctagaatgttaccacctaaggaacaaaactaagggcccttcaggcacagttcctgtccggctctggtttgcctttctcaagccctttttctctctcttgctaaaatgaactagtagtcaatggaactgtagcaggagcctgagctaacagaaaccatgacatgcaggcactaattaatctagcacactcagatctgactatcactgaggctagttctagtccagccgacttttaccgaccaccacatcggatatcaactgcactaccgaccgtgttctcaaccatcgtcagtccttatcttccacaacgttccagtagacagtctttaccgtcagcctaccactaccccactgccatatcaacttttctttttacaaacttcaatttaaaatgaaacatgacattttattgaaaataaacgttcatcgaggacataattaaacaaataaaatttaaataattcataaaaacaactaaaatgacattatctgaaaacaatacataatttaacgaaaataaaatctaattttcatggcgcaggccctagatatgatgctccattaaataatttagagatggtaatagaccaaactagcatagattgtggcctcacattgaaggatggttgcaaagttcgtcggtgcttcgggggtgatggttgatgctacaacgaagacccatatcgtagtcgtccacatcgtataatcctccacactcatcatcaattattatattgtgcagaattatacatgcatacatgatcacaacaaataattggtggaaaaagaatgacttagactagcgagaatatagaagtgaaccttgaggaccccaaatgttctctctacatccttttgtgtgttcgcatggcatatagcaaacatcctatgctttggagtatatgggaggagaatggtcttgcaaatgttctctctacatccttttgtgcgctcgctaggtcgttaatttttcttcagctagcgaggtggtactatataggagcgctatgatatatgtgactt

SEQ ID NO: 4609 - DNA, 2230 bp, Zea mays
  misc_feature (1)..(100): optimal_loci_322066_G1, chr9:143885067..143887296, Cluster 28
  modified_base (361)..(361): a, c, g, or t
  misc_feature (361)..(460): n is a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (1397)..(1397): a, c, g, or t
  misc_feature (1397)..(1496): n is a, c, g, or t
  modified_base (1398)..(1398): a, c, g, or t
  modified_base (1399)..(1399): a, c, g, or t
  modified_base (1400)..(1400): a, c, g, or t
  modified_base (1401)..(1401): a, c, g, or t
  modified_base (1402)..(1402): a, c, g, or t
  modified_base (1403)..(1403): a, c, g, or t
  modified_base (1404)..(1404): a, c, g, or t
  modified_base (1405)..(1405): a, c, g, or t
  modified_base (1406)..(1406): a, c, g, or t
  modified_base (1407)..(1407): a, c, g, or t
  modified_base (1408)..(1408): a, c, g, or t
  modified_base (1409)..(1409): a, c, g, or t
  modified_base (1410)..(1410): a, c, g, or t
  modified_base (1411)..(1411): a, c, g, or t
  modified_base (1412)..(1412): a, c, g, or t
  modified_base (1413)..(1413): a, c, g, or t
  modified_base (1414)..(1414): a, c, g, or t
  modified_base (1415)..(1415): a, c, g, or t
  modified_base (1416)..(1416): a, c, g, or t
  modified_base (1417)..(1417): a, c, g, or t
  modified_base (1418)..(1418): a, c, g, or t
  modified_base (1419)..(1419): a, c, g, or t
  modified_base (1420)..(1420): a, c, g, or t
  modified_base (1421)..(1421): a, c, g, or t
  modified_base (1422)..(1422): a, c, g, or t
  modified_base (1423)..(1423): a, c, g, or t
  modified_base (1424)..(1424): a, c, g, or t
  modified_base (1425)..(1425): a, c, g, or t
  modified_base (1426)..(1426): a, c, g, or t
  modified_base (1427)..(1427): a, c, g, or t
  modified_base (1428)..(1428): a, c, g, or t
  modified_base (1429)..(1429): a, c, g, or t
  modified_base (1430)..(1430): a, c, g, or t
  modified_base (1431)..(1431): a, c, g, or t
  modified_base (1432)..(1432): a, c, g, or t
  modified_base (1433)..(1433): a, c, g, or t
  modified_base (1434)..(1434): a, c, g, or t
  modified_base (1435)..(1435): a, c, g, or t
  modified_base (1436)..(1436): a, c, g, or t
  modified_base (1437)..(1437): a, c, g, or t
  modified_base (1438)..(1438): a, c, g, or t
  modified_base (1439)..(1439): a, c, g, or t
  modified_base (1440)..(1440): a, c, g, or t
  modified_base (1441)..(1441): a, c, g, or t
  modified_base (1442)..(1442): a, c, g, or t
  modified_base (1443)..(1443): a, c, g, or t
  modified_base (1444)..(1444): a, c, g, or t
  modified_base (1445)..(1445): a, c, g, or t
  modified_base (1446)..(1446): a, c, g, or t
  modified_base (1447)..(1447): a, c, g, or t
  modified_base (1448)..(1448): a, c, g, or t
  modified_base (1449)..(1449): a, c, g, or t
  modified_base (1450)..(1450): a, c, g, or t
  modified_base (1451)..(1451): a, c, g, or t
  modified_base (1452)..(1452): a, c, g, or t
  modified_base (1453)..(1453): a, c, g, or t
  modified_base (1454)..(1454): a, c, g, or t
  modified_base (1455)..(1455): a, c, g, or t
  modified_base (1456)..(1456): a, c, g, or t
  modified_base (1457)..(1457): a, c, g, or t
  modified_base (1458)..(1458): a, c, g, or t
  modified_base (1459)..(1459): a, c, g, or t
  modified_base (1460)..(1460): a, c, g, or t
  modified_base (1461)..(1461): a, c, g, or t
  modified_base (1462)..(1462): a, c, g, or t
  modified_base (1463)..(1463): a, c, g, or t
  modified_base (1464)..(1464): a, c, g, or t
  modified_base (1465)..(1465): a, c, g, or t
  modified_base (1466)..(1466): a, c, g, or t
  modified_base (1467)..(1467): a, c, g, or t
  modified_base (1468)..(1468): a, c, g, or t
  modified_base (1469)..(1469): a, c, g, or t
  modified_base (1470)..(1470): a, c, g, or t
  modified_base (1471)..(1471): a, c, g, or t
  modified_base (1472)..(1472): a, c, g, or t
  modified_base (1473)..(1473): a, c, g, or t
  modified_base (1474)..(1474): a, c, g, or t
  modified_base (1475)..(1475): a, c, g, or t
  modified_base (1476)..(1476): a, c, g, or t
  modified_base (1477)..(1477): a, c, g, or t
  modified_base (1478)..(1478): a, c, g, or t
  modified_base (1479)..(1479): a, c, g, or t
  modified_base (1480)..(1480): a, c, g, or t
  modified_base (1481)..(1481): a, c, g, or t
  modified_base (1482)..(1482): a, c, g, or t
  modified_base (1483)..(1483): a, c, g, or t
  modified_base (1484)..(1484): a, c, g, or t
  modified_base (1485)..(1485): a, c, g, or t
  modified_base (1486)..(1486): a, c, g, or t
  modified_base (1487)..(1487): a, c, g, or t
  modified_base (1488)..(1488): a, c, g, or t
  modified_base (1489)..(1489): a, c, g, or t
  modified_base (1490)..(1490): a, c, g, or t
  modified_base (1491)..(1491): a, c, g, or t
  modified_base (1492)..(1492): a, c, g, or t
  modified_base (1493)..(1493): a, c, g, or t
  modified_base (1494)..(1494): a, c, g, or t
  modified_base (1495)..(1495): a, c, g, or t
  modified_base (1496)..(1496): a, c, g, or t
tcaaaggatgcgacaacggttgatgcgaaaattcgagcgggcgcacgcggggcgagcaaggacaggataaaaaatttagacgaggtagagatgcacgacgaaacttaggtgattgatgagtagcgtttaggatgatccattaaagaatagtcgtcagatgggttttaggagagagtagacaaatgatttgatccgggacgttaatttttgacagcaggatttttttgagataaaacgcagagtgtatttagcaggagcatgagtgcgtgggatgaatcaatgttgtgtacttagcttagtcgttgagatagtgatgaacaacaaacgaatcaagctgattcatcagatagatctaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaagattcagagatacgtctccatgttagaagatgttcgtagcgataaattctaacagtatgaaaaaaactggggtgagtgtacagtacatgcattgtgaacatctatgctgaactataatctaaaaaaaactagcttgacaataggaaacacgttttgaacacaagctaatcaaaggccccccatcaaaataatttgtcataaatgggcactcaatcactcatacattattggataggtctatactctggagaagagcaagacatgcatggtggagggagccggcatcatgcttcagaattcagattgcgacaatgatcgatacttctattgcttgcaggaccttcatccccaaaacgcttgcggcggcaaaacagagccccaagaagcaggatggcggcgccagtggaggcgtgagtctatctatggtctccgttcactattttaaaatatggaaaccgaggcaggtcttcggctttccggttccaagaagaggaggaagacgaccggccgaagtcgaaggtgacgaatgcgtcgacggaggaggaaacaacgggaagatgaacgaagaagatataaatgaaaataaacaaatcatttttttatgtgtaactactgacgggggataggtaatttttcactgacttcatcaaagtgaaatttgattgaaacataatttgaggaaatctacaaaaagaaatgggtgaatctaacccatagatttattaatttgatgaatctggatttcgtaaatttaacggtttggctaatttattatagagtgaagttatttttatgaatccttaagcttgtcggggttatagtactgaatagaacgtaaactgtcacgttagccttaagctgatggattctgaacactacgggtgctctcacaagccactatcgagtagcgtgcatgctcaagcggcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcaaaatacctcctttctaggctatttagggaggatttgggatgagccgcaaacaacataccgcgccacacgccgggacgcagcaagttgtgcggccaaatcgcccccgcaccttaagaagggggagggcgactcggtgtcagcctccaaacaagacctttaagttttaaaaggacggagcggcgggccccaccaactgaaacggtttccgagaattactcctaactagtagagtgacaaaatcacagccgagttctgtacggatgatttaggatgagctggatctgttcaaagagtatgagtcgtatatattcgtttgcacgttggtgctaagctttgtagacagcggaaaacagtggctcggatagcggcagccgctagcgaacaaggctgagtgaccgtgacaggaggcatcaggcagcaccagtagtcgaaagggagaaacggccatgggcaaaaagctccacgcgcggacaaggcctccagctcagcacgccaccaaaaggcctgcatccgtagcgaccagcgacgacgacgaggaaaagcaggagcgggacgggagggcaagggcaataataatggaacggcacggcgcccagagtcgctggctgtgctgccccggccccgggatcagcgcagatggtccaaaagcgcgggagggcggggaagagaacgaaccgttgtgtggcgccgctgcgctgtggccgggccgtcctctcctccacggcct

SEQ ID NO: 4610 - DNA, 1668 bp, Zea mays
  misc_feature (1)..(100): optimal_loci_322501_G1, chr9:146078534..146080201, Cluster 28
gaaaagaaacagcaagagcgatcattttgctttacttcggttctcttctcttagagaggaggtaagtgaagaagcacagataaatctacgctaacttgcttcaaagcaagggagcttgtgggcttccagtgttcttcaacctggattcaagcaaagaacatggagcctgaccccgctccggtctagggcatagcctagaaaagtgaagtactcctagtactaagacaataccgtagtatttaagtatataatggtattttagaacaaaaggtatttagtaacacatctaaaaactctgtatcttaaaccatggttgtaacaatatcttttagtattaaaaaaaacttagtctagaccaaatccgtttgctttcaccgtttcacgaagctgcagcttctcctacactataactgaaataccgtgtctttaaataggtgttgaattggactcatgtaaaatatatcacagttatgtaatgacatataataaattgtagtattataaactatggtttgaagaaatagagttttctaaacaggccctaagcctctgacctctggaatcaaatagcaaacccctcacataaaatccgtgcggacagattagaaagaactagtctcaaactttcaactagcttgtacactgacagcagcgctcttctatctgacgaaagaacggcctccaattttcacctgcctactgttgctttcgcgctaggctgaagtaaaccctgattaccatatgattagtaagtcttagctaacggtccctttctggctcatgccctttcgttgcgtctagctttctcttctttccacaaaggagggaaaaaaaaaacacgcagtatctgcttcgctttgctcgacccgtgcccagagaaaaagaaacctgctcgctttgcgttgtctgcaagcctccggtcgatttggtctcgtccaaggacaaggagacaaagctgcagccccggcttggcctctgccggagcgcaggtaaaccgtgggcgatgtcgatccgctgctggggtagaagaaaacgacatgctaattacctcgctactgcactgcactggcttctcactcagctcggaggcacacgcgcgggcacacacactgatgctgcagtgacactgtggagcagcacacgggtgacagacacagacacgggtctggcaggtagttcattacgggtacttgggaagtaaactagcgcgcagatttcggttttaaaaaaattaggtctaataatcagcattctgtctcaaaagtctactacgttatttctccccggaccaccgctttgttatttatacattactcttatcattcaggattaatagcgaacgtggtatctgtcagagctgagtcatcgaataatgtctctgctgatcatggaagggggtgatacgggaccgattggttttggttgttgttgttgtgagtggtaacctcgagttcaaatcactacacgatcgctagttcttggagtctggacatgcttcgctttcggtattaggcgatgcactcctttccttcactgatggatcaagtaacgcggacagatgcctgtactttgacgacgtttatcggtctgacaagcacacttcggtcagtgggacaaagatccagtactgggctgacactgacagccactaccaccgtcacagtcaac

SEQ ID NO: 4611 - DNA, 1620 bp, Zea mays
  misc_feature (1)..(100): optimal_loci_329058_G1, chr10:24655409..24657028, Cluster 28
aaagctcctcttaatttagtaccgagcgttgtaaccggaattaaagattgctgcctttaattattagttttagttgtccagcaccagctgagaattcgatattgtagcaggcttgttacagcggtagtgatcatccattctccagtaacggatcattggacacgatggttggtgggttttctttcttgaaacaatgagataagcttctaggtcgactcgtgtaaaaaaaaaaaaaaaatgaaacgcgtccagctgaatggagccaagctgatattattacgagtcctgctctggtaaaccactaccccattctaaaatgcatggaccagtagagaaccaacgtgctcgtcgctatcgcccgcgcggttaagtttaccaaccaacaacttgggctactctacgtgcaaatggcatgcatgtatgcatgcattctacggttgcggaagttgagacctcaaacttaggtttttaaatggttatttaatgttccaatattttttatctcttcataataattatagaaaacattggtttcgattttttagtctatagtaaatttatgaatattttgatgatgtattttttagatatatatacaagttttttttgtctgtgtcgtatttggactgacacggcacaatcattggtctatcgtgcttcagaccagaccgagtctagcttttaatatctaggtacggcacgatctagcttaaaattatttcaggtcatactggaccgaaaatgttagcctcatggatccagaccataccgctacggtacggtacggtccaactttcagctatagagccatgcacaaagtaacaaaggctgggaaatgggatgggaaaccgggcatgcgtccccctgtttctgatcaaatcataacatctcaatgctgtccaccacccgtatggagctgccatgggaatgctgcacaccggccgcgtgaagaccgcagccagagcacatgcgaatatgcgatgcgagggacacgactcaacaagaacaccaccgaattcttttttttttccggcaccgtggtctcgttcgtctaggtaacacggtactacaggtcatgcgtcaagaacagaggttaggctgtttcgagcggatctcgtgtaaaatattatttttactctaaactgcaatatttatatagtaaagtttaaaataaaaaataagatgcaatatataatttctaagctaatggagatagtcttagataatgtaagatgacactgtagagcatggcgtcaaaaataaaggttaaaactagcatgattgacgacgtgatgctaaaatagcaggccacgttctacattgctgagccttgatgccgtaaattatggtatctttttaaatttagttagctcaaaatattttattgtgtcttaaccacttgaatttttttactataattggacactaaagttttataaaactctagtgaataagttatattaaaatgccagtggataagacataataaatatgtagaggtagctaaaataaaaggctcgacactatacgatttattgtgccgggacttggactcacactcggtgtcacagaccatgatatcgagccatgatgccgagctctagccacgcatgcacataa

SEQ ID NO: 4612 - DNA, 2637 bp, Zea mays
  misc_feature (1)..(100): optimal_loci_336223_G1, chr10:73286071..73288707, Cluster 28
ccttggtgtgcttgtttcaaacttttttggtgttttctggtgatatagacctagatctgtgacagaggagagaataattaaatctagatggttatcttgttggttgtatttatatgcttgtacattattgtttttgtgagatagagaaactagatctagttcacatcatctttttatgtcattcaagtattttttgtttgtgttggaaaaagagaagataatgtacacaatttatgcattcctctcatttggatgcatcttaatatattttttcttcccactacatacaaggtattcatggaaatataagaatagaagtacaagaaggccatcatggaaagttcagaatggatgtacaagatatcatagatggcacacccttttatgaaaccagtgataaattttgttgatagtgctcaaaagaatgatttgagtgtgaataaaaaatcaatcatatcaccatgtactcacttcaagaatgagcatgtctggatgctggatggtgtttatgtcaaatctcacttgatccaatggggtttcatcaaggtatacacaatttgaaattttgtggcaaaggaaacataagtgatgtatctaaaagaacatcattaatacatgtagaacatggatgtggcatcacaatgatggattgtggtggagagggaacctcatcagccatgcatgacattgatggcaacaaccattttatcatgatgaacgattttgttgaagatatggatgacgtcagtggtaatgaggatggtgaggtggctttggttgaccccaatgacataaagttcattgaggagtttgttagctgccttgccaacaatgaccttctatatgggaccctaggtggctagacaacttcgaagagatgaactaggtgataaaggatctgatctattaggatcatgccccttttaatttttaagtagattacctaactcaatcatcttccattcattattagattagataaaccacgcaattggtcatcttggtacaccacccatatgatgtactatgtctaaccttcattcaaggtcacaaatgaaaggggatgttacaatacacatgtagatcatattataaactctcaagtatagttaagtttacaaacttgtttaacacttaatccatcagatataaagttcaaacacaaatcctaacaatataagagatcaagtagaagttttaacacatggttttgaaagatgattgtgcatgggtgtgtctctactcacacatttataagatgttggtctctttgccactcctactcctcctaggactccacgacataaagaaaccatagacaagtgcaacaataactacaaaagttaaccaatcacaaggtgagtactcaattgtactttacaggacttgcccgataaattcaaggaggaatatgcatttggttagtattaatgaatgcattttttttgcataaaggcattttatacaagaatcataaatgtgagacatatacaaagcattggcaagcatagcaaggtccacataaatgagcaacttgtaatttggatctcaatcttctattagtccttgtttcattgaactctagtttgtatatagaagtacaaaacttatagcattacaaaaatataacactatagaggggtacacattaaccccaccatatgacttgttgtacatacacgatacattgatgtatcaattgttcccaaatctagccatggatgcccatgaatgttgaaaggtaccaaggtaatgtcacccatgccgaatccataagataaccaagcacaaacaagttcttagcgtgtcacactcatatatgacaaatagtttgtatgatcaaattcacgacatactaccataaatacatgatccttaaccagttggtgagctacaccattcaagatctcaccagttggcgtgccccaacccctcaccgactattcatcttctcatcatcatctcaatgaagttttagatcttaacccttttatgtggatttagtggacaagaatgtcgtataacatgtgagtctttaaaaacccatcatcgtctcaacttctatcatctaagtaaactaagcatgagtcaaatgagtaatgaatataaataaccaacatctaagtggtgcagaaacattcaaggtatgaatatctcaagtaggaaaacttaggaattctagtcatattgcaactcagcaatgcaatattttaaccacaatcatgttatgcgattcataaagaaaaggattcataggggcatgcctttaatttacttagttgatggacttttgacaaagtaaaaggtggacatctccttggtttcaacctccttagagccgtcattatctaaggaatgcatgatgcaaaatgattacaatgcataagggtagatgatatgaagtgatatgcaatgatatataacataacatatgctactaatatagtataggtaacatgtgtgcatagtttactatcattgtgttatccacttgctctacagatggtctgtcagatcattagattgtccatcaaatcaatatctttgagcaactccagaaattacaagtgttgctcactacagatggcacaagcatttcagactttttgatagttggaacttggatagttttatcga

SEQ ID NO: 4613 - DNA, 1593 bp, Zea mays
  misc_feature (1)..(100): optimal_loci_338621_G1, chr10:85591341..85592933, Cluster 28
ttgtcactcggggcacgcagttgttgatacgtcgtctactagctagcagctatatatatgaattttgccttcgtgaacatggctgtcctttttcgttttttaagagaaacatagctacctagcttaatttcattgctagatggctttgctcttttgtttttttcactcaaaagcagctggggtatatatactttgtcgggatatgtgtttctctttagcttcagcctttacagtaaaatacttgtgacgtgcgcgacgacaataacgttcacacgtatcgtctgcagctttgcgtttgattatatagctaggagccaattgaagaggcacgttgtagtacggcactataataagctagcatccccaattgtcagtgtagtaacctaatcctaaaaagtacgttggcgcctagctagcttgtccctgcaggaaccttatcgacgtgtttgcatgaacccgtctagctagtaagtagtgttggtgaatgtgtgagcatgcaactttttctctctctctctttctttgcgattttgaatttatgggtctgattaacaaacgttttttttttcctgggaagaagggggagggaaagtcctgctcagcctttaccgctaattactagttaccatgagtccatgatgatgatgatgttatattcgtggaaagcttaattattagctgtgcgtggactagtgatgacacacgtacacgctatcgacaagttaagtacgtacgtaggactagaagaacaagtaagtaacattgatctcgtcgatcgatcgatcgccaatcaaaacgaccacgtgtgacgaggacaaaagcaagacgcatccatctccacagttaagttagcagccgccccccagttgacacaaacatgtactacgacaaaatagtttggactatcggaatctgagatgagttcgtttgttacgttattcctccctccctgccgcaagaatccacgtgatgagcactagtacatactagtagtagtaggtagtagctaataatgtattgtcgtatactcctatatatatagagagagaagagatggaataaacatgcattagttaccatgatgatgatgatgctgctgttgatgaagaagctgtaggggccgggagtgcgtgcctactgtactttcgaacgagaaaaaaaaaatgcatggcagcacacgcaaggaaagtgaagtgcatggaataaaaagcagaatgcgccgcccggccggctgctatatggggaccacacacagagatcgatgcgtgccagccagcgtgtggaagctggagccggactttgggagtggttgggagccgggcttgctgctgtgtgctccatctggacacgggataaacatgttgcgtgttgcatgctggagaataatcatctctgagtagggatacattcatttgtaattatatattcttttatatacattggagaaaaccccgctaccttttccaatctcaagctatcccatgccttcatcttccaccaagtactttgtcactatcggggttccaccacgagatgaccaatcaacgtggttaattaagggactcaaataaggctaaaaacgatgatgtacac

SEQ ID NO: 4614 - DNA, 2846 bp, Zea mays
  misc_feature (1)..(100): optimal_loci_3430_G1, chr1:17682971..17685816, Cluster 28
tgacatatcatattctagataaccaaagatttataatagtaggatttaaaatatacgaataatgacgtgttcgggaattatgacggtatcaattcagaagaagaaaaaaaaccttatttattattagtacatatctaaacttttccctagctgtaagacaaaggaacaccaaagatcgtcccacgagacgatcgatcagggaatgaaacagcaaacggccaaaaagactagtacggggtaagggcagcttattagctagctaggttcggtggcaatggagttgcatgccttcaaggatttgtttttagggaacccggaaccctactttaccactcagcagccacgcgctcactctcctgtagactgtagtacatcatgtcgccctcacctttatttatttatttattttacctctcgctcactcgctttcgtcgtgccaatcgtgcgagttctagatgagctgggagatgatgagatcgatcatgagccagccgatcggatcagaccggccaacgaccaacggcggagttcttcgatcgccttttgtgtttctcgtacactggcgcccaaaagagacctttagctcagctgtaacctaataattccaaatgccccgcgtgtctcctcagagggcagaggcacatgattgttagattgaagacgcatgcatgccctttgttcagcgttctacattaatttcatctagctatatttaactgttggatttattagtttgacctaagcttattcagttaaaattaaataaatttttaggtcaagattaaacgctagacgcaacagagactgtgtacaagcacagcgtcggcagaccggacaacaaccacggcggtatatggtgctggtggactggtttaatcactttgagctgattaatggcaggggttaattatggatggtggatgaatttcagtgtggtttcatgcacatttaaatagtgcactacgtacatcggattttttatgacatgtcatatatagcatttaagataattgagttttatggaaaaaatagtttcatgggatgaaacaatgccaactcgtttctaaagtcttgaaaaaaaccgtgtgaaacctccattggaaataatttatttcatcttcatgaattttactggtttctagtattggccaatgaattgcagcatttagttgatatgtttgtctatgtgaaatagtgagatgaaattttgcattgagagggcattactttgtttcattcttagtttcataatacctttgatggtgtggcagtgttggaaagagagtgccaagaaattgctattgagaatagcctcttgatcatggttatggctgtggttagtaactcctatgattatggcccccgttaatacactaactttcatgtttaattatagttgtatcacgtactagtaacttctgtgtttatagcagttgttattagtaatcgacctcgcgaatgagacacagaccgccgcaccttcttatcacactgttgagttgcacacctgactacctgagcttctccgttccaattctttgtgcacacggaggattgcaagagcaggcatctacaaccacgcccggccacttctatgacacatatatgcctgagtgtgccggccaattgattttttaggagcgtctaacgtgagtgctcgctgctgatctaaatcgtcttcttcccgatgttctttaacctgcaacgtctttgctgcgtcttcttcctggtagtggtacacatatatacatgaaaactgcaccggtgcctttgacatagatcttctatataagtcgtatacatcgatctgttattcaatagaacatttgtcgtcagtgtatttgtcatgtgcatttttactatttctgcaagcagtaatatttcatacctacacatatttgccgccataaatttgctataacgtttctaaattaaattaaacatgaggaataactaacactaataagcctaatatagctccgaaactcacctggtatatatacagtgaaatacatacgtatataaggttcctttttctttcaatcctttcgaaaagatgttgtcggccatttacccaaaaccaaggtccattattgcacaccacatctaagccaaaagagagtatagaaccggtagcgtttggagtacgacgtaggatagctagcatcatcagatatataaagtgcaagcaaagcagaacgaagctactagctgacgatcagcattttcctttccacacggcaattaaagaagacgaccattaattctcctttcgacgaaacaggcaaccaaagcatatatatttttcaccaaacagttctatagtagcatgatttggtagaaaggcagcagctagcagcagaggagtatcagaagtggtgtgcaagcgatttttacgagaccttagcagagccccagcgtgtgcatgcatgttccagattcacatgtcgatcgaggtgagacgtaacgtcgtcgtcgcaaacgccgacgatccccagacggctcttgaacgtccagcatgtatagtactcgtctgtgacttgagtagtagacgggtcgtctgtctcccaagtcacagatgctgacattattacagtggagtaaagtctctctgtggaagtgccggcgggcgccgggtacgtaccgaaaggaacggccgggcaaattaaaaggagtacacgaagaagatgatgatgaaataaaggaggaaacaaagcggaaccaaagcggggagagagagagaaaaagcaaggattctctgaagcattagcattatttggcggcccaacctaatcggtcgctttgccccgtttgctaaaacgcgtgcgtgtgtgtgcattcttcct

SEQ ID NO: 4615 - DNA, 1775 bp, Zea mays
  misc_feature (1)..(100): optimal_loci_343542_G1, chr10:113172063..113173837, Cluster 28
atgaatcccacgtctatataggcatgttggcggtggacctgacggagctaatgcatctcaccgagattattctaaccctatatctaaaacacaacaaactcatacatataatatgtatgcttgtttgtacaacctaagtactagatgtacctatgcgtcaggttgtgtagaaaatgatgcatcatttagttgtgatatgccgatcttctacattatccaagtttcatcgttgtcttatgaggtggagtcgtgttttgttatccctatttgggtcctgacaacctatctaggacatacatgacactttccatgagggacatgtgctcatgcaagagaagcagaagtcgtaggagttctttttctgtcatgtggttgtcatgtggtcagcagagagattgaagagaaaatgactagacaacattgggttataggatggcttacttaaagagagcattcatgcagctaaccatattcttttacaaaccaatcattggtcgaagtggttcttccacattgtgcaacatatacacattgataaagtgatgatctatcataggacttacattgacatcttgttattatgctgaaaggtgaaggaggatgcatcaaagaacatgcaagttcctcatccttcttacatgtggtggctagaggagacattgtctttactggtggatcttcatgtgtcacttggggctcttttgtgtttacctcaaaggcaaaatagttagcataattttcaatggttatggtaaaggtggagtctttaactatcacttgtgtatttgacatctcttcgtcattagatgcatcctcaatagaggtgatggtctgtagtaaacatccatgtcatctgaacagaggaagatcctaaggtcacttccatggctcattgcatgggtattttttgggtgaaactctatgttagatgcctttgaagccactatatggtgaacttgttaaggacatagtcaacaattttagaacatggattgttatgcaacaaacaattaggagcaatacaagtcacatcaagataagcgaggattgatgatattagagagtgtcgaaccagagaacaagccaaagagcttagccacaataggaacgaaagaatgctctacacgtagaatctataactaatcaaattgttcatctttcctctatctgatataaccatatgaccttataacacaatactcttatagttattttattatacctttgtctaatatactttaatcacgaactgcaccatattttgtcatccatattttagttttccaatacaccacacctccatttgcgttaatctggcaaatgatcaattcaaactcttgcatatatgatcatctcttcctatgtatacatggtgtaaatagtgacatacattatgcatgtattgagatagttttcaatcggtcagtgctcggggaagccatacccttgattgtcaccaagacacattcaagaatcttggtataaaaagataccaccgagcccacctactaggatcaccgctcctagagacctatgaccaaaggacctagtcccagccaggacatggctttgatatgatgtaacttgacattgaggcttcccgaataaataactacaccataaagtcatgtaagaagccactaatggacccaggacccaccgggcctcagagcactccaacgcccaaggcctctagtgccctacgacgtccctggctaaaatgatctaagtcctagggccccctctatccctagggtgctcatgagtcaaaattc

SEQ ID NO: 4616 - DNA, 1825 bp, Zea mays
  misc_feature (1)..(100): optimal_loci_347272_G1, chr10:134048269..134050093, Cluster 28
ggacagccttatcttttatccgcctgaagatatatgttttgagctaccaacttccaattaaaacagcaccaaatgccagagctgaagcgaaaggtgagaaaatgcagaaataacctctataaattagcggacgttatatgtaaaaaatcaataggattgcaacattctgaaacaaatccgcctgaacccagtaattaggtaaagtcacttggaaaattagcgagaaatgattgttttttacaaataaatgcaaacctaaaacgtgtttacaggtactgtttaggggaacacaccagcttagtgactacaagaaggaacgctgtattcaagcctgatgtagctagaggctgcggctatatgacttttcttcttcttcttctctctctctttcccatgtatggtcttttatgtttgggattaaagattaattttgtggccgagactgtgaatgtgagtttgggtttacttgcttgggagtgtagagaagcttggcttggactgattcctctcctaggagagactgtgaaaaagaggcatgtcaggcgttagacgatcgagacatcgggagtattattagaaactgctctgaaagtgagtagtaaacgtattctctgatccaaccggcccttatcggcttcgttcctttcttccaagggaacctcgacgagcttttccgagaacgcgatctctgtagaaagataacatacgaggatagcaccaatgatctgacggcttgaaagagaggccaggcgacgtcctgaatagtcaaagattcagagagcataaaatgattagcctggagctctgaaaagatatactccatacagacgaactagctagtactgcatgaaagcatcaagagcgtactgctacaagaaacagctttgcgcgcgcaacgacgcaacatacaatactccagaaaaaaaagagatcggctgttaaaaggttgcaggaacaaggagcagcagatatcgatcgatccgcctgatcccgaccgtatgcagcgccggccggcacagggacaattcgttcgccttggatgcctcgtagcatagcatctgctggcactataaggggtttttggagaaagaagagcacgcacgcacgcatatgcgtactgcgtacataggctgccactaatgatggcctcgaaagaaagatgaggcgactctgcaattgttaatccttctgttcgttgtaggggttgcacggatcggagatggaatcatcttactaatcaaaggtgaggcctaggttattagatgctacaggtgtgtaggcattcttgatggtccctattagcctgccttttggaataggggtacgtatacaatgcacactatatcgtatactatatattgtagccaaattaactgggcatatgggcatgccactttcacaaacaggtccatatgggcatgccactttcacaaacaggtgtagatgtaattaagatcaagatgcatgttgcatattgtaatgtgttgagatttatttaggctctaggtcagagatgttgtggattctgtattgcaatgcagtgcttataagtagacgtgtgagggatatgtatgtagaaagtgggcaagagtggcacttagttgatagatagatgttcattctctgtctttctttatgtgttttttactagatgagtttcactcatttctgaaaatcacaatagtattacatgataagggatttgcagcaacttatttctctaactaaaagatatagtatcgcttaagcaatggagaatagataagttaccaacaatgcctttactcgacgggggaaaaaatccttccacattttccagtgaccc

SEQ ID NO: 4617 - DNA, 2157 bp, Zea mays
  misc_feature (1)..(100): optimal_loci_348656_G1, chr10:141346633..141348789, Cluster 28
ataatctgaattatataaactcggaaggaaagaaacaacggctttatcccatctataatctgttctagcttctctgtttcatcatatgctgttgtttataattttgaaaccatactagtcatgcacacatacagtttgatcaggaataaatttagaactattaactgaaataccaaacacgagtatggatgttcgactcatatctgccttatagaaaatactagcattttttatcttccaaataaaattgcagggataaaagggacatcatacaggatcggtgaccaatctttgggcagggtaagcactaatcagcacgtgagatctacaccatttcctagaccaatatatagattgacaaacaaacaatatgtttaagaatttaggtgaacaatcgacacgtcatcatagaataattgagactgattttcaggagaagatagatcgtccgacttgttgaaaaacacgccacacgcactgtactagctactagttagagtaatatagggactgatgcctcccttcgattttcttccatcgtttcatttgtctgatgccatgtccaaatccttagttccgatttgaatgcattttgtcatcgaagtcatgttccattttcctttcggcggccgttgtgttaaacccttctaccttgtccaaccggtaaaaagaaccggagcagaagtcgtttggtcaagggtatattcgagatagttttaccggcctcattttcataaaaaatagctctatttcataaaaaagttagttaaatggataaaatctacaagatctagattccaacacggcaacacctagtggcacttagatgttaaattgtgtaattaagttcctatcttaatattacaattatctattctaaatctgactgtacactttattatgtctcgatcggcaaaataaaacagcgtaacttatatatttgcttataacacattcttactcttttgtctttccatgttaaggattaaactatcgtttctaaccatcactgttgttggtaataatccacaactattattgttcatcctttatagccaccaagattattttcaaagttactgttcactcttaggtgtagacttaacctagttcattaaaacgctgcagtgaaatttagtcgactaattatctcagttatcaaaatgatacgtggaactttcacctctaatctatccatagtgttttttatagtaaatcttagattcatatctacagtacttttttatagtaaatctcaggtttattttagatttattagtgaagctactctatggtagatctgaaaaaaaaaatctagatcccttttttaaacgacaaagcttttaaaagtagaaaaatagcttaaatttagaaccacttttaagtgctgtccactttttaaacgacgggagttccaaataagaagtaggcctaactgctttcgaaagcggttggaacggagctaggacacccaagtctgaacccccacgagccgtagccgaagagccttttcggtaggaaaacagaggtaagaaaaggcgtagccaaaacttacagacaaagcatagccaaactaagcgcacgttcaaaagcattgtaagtacgtgtatacaacctacagaaaaggcgggcaagtgaattgcatcgttcgactttgaaaaaaaaaagatcgtgggatggtggtgggccggttggaatttttcgcacgtaataaggcaagagcaagatcagcatatcgaccgaacgtccaaagcgacgatgcgctggtagcagcactctcgagacgcttgtagaatgcagatcgttcgtcatcaacttttatatattccttctcccagccgagagaaaaaataatactacttggggaagcttcgatcttgatgaaccggaccaatctcgtgatgacgtgggtgtggattccggaggttgctgaacacacgcgtcgcacttgtcgtcgcggccgggtcgactagagtacacgtgaaacgctatccgctgtggctttctcacggaatcgtcgctgtggccggccactgtactgtacgctaaaataagaatgtcttgcccgtaagcatggtttctctactacatgaagcacgcgttattattagcgcattatcggctgctaataacaggtcgcgactcgcgagtggttag

SEQ ID NO: 4618 - DNA, 1866 bp, Zea mays
  misc_feature (1)..(100): optimal_loci_349951_G1, chr10:148595097..148596962, Cluster 28
tgaatgttgtggtcccattgattcaaaaatctcagataccgcatcgtgacgagcacaaatcagatgtctattgcataagggacgtgttaactgcaagaacacattatcaaagaactatgaaagaacagttgagataaacataaagcttttggggttgtcacttgtcacatttcatattttgcaatgttctcacatttagttggtgtcaactgaatgatacaccatgcaaacatttttttgaaggcatagatactagatagccttacccagtttctaagcaatctagacccaaaagatgtgcatgtattgttcataatttggaacagagacccttctgttgtaccatctgagttgttcctgaatacctgaaaacacattagttgttactccataaattgaacaaaagcgaagcagcagttcccgagaaaaaaaaactctacgtgtcctgttgattatatgtatgggagaatgaaattattgtagtttgcttcccaacaaaaactatccacggagctagaggtcaagaacagacctgagaaagaattgtaataaatatcaaaacaggaacttttactttgaaagtgctgcaaaagactacctcaagttgttgaagagcatttgctgataaggaaaattctgcatcagcagaaaatggaccggaatgaagaaccaaagcatattatcctttccatgccaaaacctttgagataccgaaccgataatgctaatgcttgaacaactagctctggcatcgccatgataccctagttttgaacaaacggtagttatgagacatcatatactacatgatggacaattgatgtctgaggtaggatgataaggaatacaccaaaacgccactaagaatagaatagaaaggctaacagtacctcaatcccatgaaaattgttgttatcatcatttgtttctatcagcttcctatcatcttcagccctagaagcattgtttacagacttttcaaataaagttatcagttcagccaaagcagcatctttgccaaaccattcacatgatacacgctcaacccgcacattagaggtgggtcccacatatgccatcataatctacacaacaagtagatgccgattcagataaatctgggagagaaatatttgctcgattggcaagaccttcaagcagagtatacataaaaggaaaggaagaaggtgtagggtaactgggtaagtagcacattaaaatccaccatcagaagaaaacatttcttgatgatggacaactggatatgaacttggcatcaattgtaaacaacaggaaattgcaacggtgggggcagaaaaggtgtgctatacatactactaaactacactacagtgaattgtttgtgattcttgccaatcttcaaacaacaatagcatcaaactcaacatgtagtgtcagtattcctgaattaaatgtccatataacatggcatcacaactattaagctataaatcagtttatcaaatggacaagattttagttaaaactctgattattttcctaaataactgcaggcttccattaaaaaaagcaaactggccatgaaagataagtgacacacaaactagaagaaccaacagaaatatataaccagcaagtagaggtcaattatactgagtaaaacatcagctacagctatcatgtggatagaaaaaaatctaagaaacctacaacataacatgagcgcatgatggtcagggtcaactaactgataattcttgtcagctgccttaccttctctgtggcaaaagagagtggtgtcccgaggatgacctccacgggcgccaatccaagcagcaaagcttcgagtccgctcctggagtcgctgtccaggaactccccgtg

SEQ ID NO: 4619 - DNA, 1635 bp, Zea mays
  misc_feature (1)..(100): optimal_loci_37353_G1, chr1:224921504..224923138, Cluster 28
aactgttattacgtagagcccactgcgtcctcgctagctcatgatgattgattgaagatttgcgccgagacgatggtggctggaataacggagtatattatgcaatcatgagctccaatctgtccgtaccgggagccggccacatcggcaggtgtcccatcatcatctgctaaacaaggaaagagaggtcgcagcaggggccgcccggcagtactgtggctgctgtgacactttgatttcttttcaggaaaaaaaaataaagccctttgcagccctcgaaattgggatattggtccccatctcggggatcgtgaatatggccgcacttggcctcgacggtacgtgccttgtcacgagacataaaacaagggtcgtacagtaataaatctagagaaactacctctttccctgaataattgtatattcttacctcagatattcatatataaaagaaatatatctagagaacctagctttgttatgcacttaaatatgcattgtatttagacacatatatagcgaaaatgatatattagtaaagtcaaatcgtcttatagtctagaaaggagagagtaatatacaagaaaaaaaaaatactttgattataactttttccttgcagtcatgcctaaacacatttgttagggggggaaagagaaagtatacaacatgtgttttcagtgagcgcagcctaacagagaattgcattacatcagtttcagcaggaggttttatatgagttctatttgtatttagtactatatataacacatcagaagatttggtaactttacaggttagttacggagaaaaaaaagatagagatattttcgtaggatttcatccgaagaatttgttgttgtggctaccacatataaaagccgacatgacaaatcttagtaaccgtgtcataaaactctctcaaactggtcttttcgttgaaagcgtacgtagtatctaatcaataataaaaccaagttgtcagccgctaaactggcggcaacaaaactgaagcttcaaagtttttgccaactacgtacattagaggttattgtaaaacagggtatgctataaaaatttacatcgtccctctataagggcatttctgaccacgtggtggagagagaacattaaaaaaaaacagatagctagtgatgagttattaatcgcgcctagttggcacgattgcccatgaatcgagtgtctctgactgtgtgcagttgacaattgcaagaatataacggtggtgagctgaggtcgattctgacttctgagtagcagttctttaagaaaagaagtgctgagacgtacgcaggctagctagctgggcagagacgaccaggcctggcttcaagcaggtaatctgaccccaccgccgtgacctagtaatgtcttaatcggaggaggaataatgagcgagagtgatgaggccctggtgccggcgtgcaatgccagtgcacaaatgcatgcatgagatgagagagagagagagccgttgggcagggagaggtcgggtgacgacaaataatctctaatgcggaagagaccagaggtgtaactgtgtaagtatatgtactactaccaccaggaatttatattgtttctttttagaatttatcttcttgcattcaataa

SEQ ID NO: 4620 - DNA, 1411 bp, Zea mays
  misc_feature (1)..(100): optimal_loci_37883_G1, chr1:227246991..227248401, Cluster 28
ttccattttcattcatgttattccgcattaaatgaagagagtttttgccattagatagtgtcatgttagcgtttttatgacaatacaaagagaagaaagcgcatatatgcactctccaatatagcaaaatattgtttttgaaacaatgtattggagctattttatctacaaattgtactgcctccgctaaaattattagtcactctttgttttctagcatgtatctagactagttacacgacagaattatatatctagaataaccaaaatgaattacaatttagaataaactaccttctttctcatgtgacacttctaaaacatgttccctactttgaatggcataacatttagtttcaacctctcggctagcaaaacatttcaaaatcaacatgtgttggtttatttcatctatattttttcaataacaattggaaatcaagccacatatgtagtgttacaaatagcaacaacatatgtgaattggttgtgttcatttcttacccgagtatcactgaatttgtttattcataccactgatctaactgatgtgatgatcctagctaccggtgtagtattatgtgccaccaacaaataaataatacagtttcaatcactcaacataacatggtgttgtggtaccagaagagatccatggtcccactttacaccaacttccccaatcaacgacctacatggttgtaacaacataagatgggattgttggattgatctcatatgtctcggtcaagggatagagtcaaactgacatctagcatcttgattagcgacataacaatcttatagttgtgactccttttcacaccgcataggttaaatagaaaaagggctgacacacaaaccaatgtttgtcgtaccctctctcaaacacacactctaaagtctaatatgtctctacacgtagtgaaggaaagttcattaacatcaaccttgttgtccttgaagctgactctacccatcctaataacgtacccacaagcacacctttttatgttcatgcttctagtggctaggatttatgagcaaggtctcaaaagttcaacattggtgctagagccatggtttaggctcaaacgctaagcctagatgttcacaatctttggtttaggggtaaatctaagaaaagcccccttaaaggcttagactcatcaattagcaaagcaagtataaggagagattgaacccttacttagttttcctcgaacccccaaaaccctaatcctaactcctaaccttgagcacacaaagaaaggaaaatggagtaatatggcttacttggccgtcaacgggttatgaaagagggttgcaaccaccaagcttttgtgtgatggtatgcatgggccttagagagccactaagaggtcactcaatggtcaccctaaggtgagca

SEQ ID NO: 4621 - DNA, 1539 bp, Zea mays
  misc_feature (1)..(100): optimal_loci_38789_G1, chr1:232183138..232184676, Cluster 28
cctttggaaggaattttagtaaatgattgagcatcaaggattcaacttctaaattaatgattgagtcccatgaactcagcgttcagtgcccacagggggacttttgagagatggccacatcatgcggactcgacctttcagtgcctgcagaggggcttttcaataggtgactgggtcacaaggactcaaccttctggcgcctgcaagggacttcaagttgttgaccgagccataggagctcggccttctagcgcccacatgggaacttccaatttgtagacgacaatagagctctacaggtagtgttgcaccctccctagagggatcgataaccagggtcttgtggacttggtattcttatgcccatgcagggactttcaatgtgcatacgacaatagagtcgtatgcgtactactatcgccctccttagaggcaccttaaatctaccctagtacaatgtccaggtacatcgtcagtgtatgcagtgtctggtacccttagagtgatgaccaagcctggggtgataaaagtaagggttggccaactctatcgacaactagtcagatccttgaaacatagaggaccatgtacccatagcaagtggccaccatgaacctatatagcataggacacctgagatgttgggggctactgatgattatatattaattcgacatatagagtcattgaaaaagttgatattaccatatcgacctgttcttgaatttttcttgaaggactatcgattatgtaggaagcctaagtttttgtaaggtcataagtcacttgactggaaactctcttaggtgcctctctgtcagtatgcttttctgaccaaggctcaatgtaaaggttatttaattacaaaagcaacttagttgttcatagcttgggcatagtcatattcatctcgtaattggccaaaaccctaagaaaaacttgtccaaaggaaattttataaccatccttgtttgagttagtcctattgttgattctagacaggttggactcggtatttaaggaaatcaagaactttttttggcaaatccttttagatggtaaaaattattagttttgtgatgacattaattatggaaaatggaagatgtgtccataatctttgaacctcctcttgcttatggacaagcaaccgatgtcgagtcttttgctccacatttgtagtgacatgtctgtctatctttcttttcttattgttactaccatgaggctcaattcttagttctttcttctatttgtcccttagatatgaaagttggcgttgcagtacttctcttttggtgtacttactagcaacttgaaacatagaggcaagagtgacatgagccattcaaataagcttctgaatcaagttatggttttaagtcccttgtggaaattacagatagttgcttttcagatatgttggaaaggttggcttcacactacaccatctctcaatataaccgcacaaagactcatcctccatctagataactcatttgaggtcataccgagtcatgactcaatcatgggtcatac

SEQ ID NO: 4622 - DNA, 1786 bp, Zea mays
  misc_feature (1)..(100): optimal_loci_3976_G1, chr1:20416144..20417929, Cluster 28
aatagtttggttgtcacaaaattctaactttagagtcgcacgggtaaaatcaaatatggacaatagttggatggccaaaaatcaacttatttgtaaatcaagaacatggatggattatgtcgagactgtaagttagacgaccagtggcctttgccactacggcgtgagccccttcgctacatcatcatgttatttgtaaagaatagtgtaggccaaaatggtgccttcaaagagaactggaaaaaatatatataaaccaaagagcaacgacttttccattaagataaaaaattaccaattcatctcgtcctacttgcatgcatgtactataactgagtaatggatccgtcgtcaattcgtcatctcgtcctacttgcattcaactccaacaaattagggagaccaacccaaaagagtttttagggtgaaaaatcatcttccgaagcctccaacagctcccctttcacttctcaatttttctgtgttcccaataaggagctcgaaatattggcgagagagctgcccccaatctcctcagttggcgcgttatttcctcgtctttagcataaatatttaaaagttcatggaaagtttcagcatttgtgacaccgtataaacaagacaacgacgtaactgcatggcaacatggctgcatcgaacctttgaccagacaatcagacattaaccgaagttcagagcttgttcatctattacaaaaaaaacgaaacaaaaaaaaagaatcgaccagtaccagatggatccaaatatgctgatgtatcatgtatagataagattttggggaagtattttttagtgaggccccaatacatagtgtttgggaatatttttttaggggacgagttgctcatatggcagactggggagcgatctggaaccgtttcatgcagatgtgattgcctctgcagaggagcaggtgatcttgggatttagaaggtgatactggagacagatgccgcaatggtggttcaggcagtctagaaaattaaaggaattgctaatgccgcaatggtactggacaagcagtctaggaaattaaaggaattgcaaattgctaatgcattatactccagttctcatgtagttgctcttagtccacgctcttgtaattttggtagcccatggtgtagcagccttaggggcaactgagtccggcgtccgggtaatgtctcggtcttggacactattccaaattgtacgtatccatgacctggtggccgaacatttggcctcagtttatgcgtaatggagatttccatgataaaaaaagtgagtaatggatcgatccaacgatctaacaataacagacattaatgcacaatggctaatttttgaagagaatcaaactacatctgagggaagcataaacttctggatgatgagattcagtacagaaagccaatgtaaataaaatacatggattattaatggtattatatagtatacttctggcagaccaaacctctagtaaacagactacagatgaagattatcgtcaaacaaacaggttgcatcagaagatcatcctctatagcactaacaggaggaatatcttctggaagttacattataatactcagtaccaaattccatccgccacatcaattttattaaccaaagaagatacataatcaggcaacctctttatgcgagttaatacaaatatagtatttgcagacatacaagagccaaaatctcggccatcgcatcttttgaggaaaatgatctgagtgttttttcaccagacacttgggctaagtccactgcc

SEQ ID NO: 4623 - DNA, 3429 bp, Zea mays
  misc_feature (1)..(100): optimal_loci_4162_G1, chr1:21696963..21700391, Cluster 28
ctctttgatctctcctgtgacatctactactcacctgtatttcagttttacagtttctagttgtttatgtcctctaacaaaattaatgactacagatagtgtgctccactgtttattttcctgttttcatcctttcttattacaccatcacccggtgagacataaaatcaaccggaataccaatgaagaatcttgagttttctaaccggtaattaatttgtggtagtttgtagctttgtatttggagttagcgacttgctaaaatccaagcgcctgaactttagtttttgttttcaggctatgattagtacatataattcataatgaacttatgttttcggaaaaaaaacatagaaacatttatgagcggtgtcatatatttgtgaacgaatgtactaatagtttttaatccacataagaacattttttttgtacgacatattttattatagaatcatgacgcgtcgtcggtcgtcgctacgggacagtgacatacatacgagcaggggcgccagccaggcacgtacacgttacaagtgtacgttttggttagctagccttttttccggtgggtgatcgtgttctatttgatttgagtttgatacagcagtggacgcgcgcgcacaccacctgtaattatcgtgcttgatctagactcccccatacatacgtgacaactaaccgacacgtacaatatagctagcgtcggcggtgttagggagtaagctaagcaactttagttgctgaagcaaccccgctgtacgtacgtgcgcgaattggtgtactcgtgaatacataagcatgccgtcacggatagctagcgtagcatgcaaaacagtgatccaccagatgatgcgttcattgacgaagcctctcaactcatcatcagtctcagctactcgatcggtctactcgtactatattacgtaccacttctaacaaaaaattgactcgacacacacaaaacgcgcgctaccgcgcagcgcgcgtcaactgcctgccgatcgagggccgatcaagtcagagtcactagcgacatagggatactagctagctagctgaagcacgaacacggacgcaccgaccatctgtcacgcgtgataaacgggacaacaacaaccgcgacacggctgatgactcgtcgacccgcgaggagagggaacgtgccactaggctactccgcgtcgtctctacgtccggccggtcctcccacgtccgagtccgaggacgccggacggtcgccggtggacgacgtcgacgcgcgtacgtgcgtggccttgggactttggcaggccgcctgccatttcccgtgtgtgctcgcgcccgtgcagtgggtcgttcgcggtcgtgtcgttggcgttgcaggtgctggctgccgcagcatgctttaacgacacgctgccccgtcctcctgcccccgcaatacatgacccagggcgcggtgccgccgagtttggtgagctgtatttgtccaattacacttgcccaccacaccttcgtcgtttgcccgccatagaatacgtacattgatatcctatacatccatccaagagatagtttttttttcatttaatatttgttaaaagtatcctaagacaccacataagtatatagcataaaggtatatatatttttaagaaccaaagtattttaaatttaactagattatttaattattctaatgccacactaggcctcatccatgtggcctgttctagaatgcagagagtccatagtgatcgaccaatgtggagagttcatagtttactcaataaattggcatgtgatcgattgacgttcaggctaggcctcatccatgtggcctgtttttggtcggaaaataaaactactgcctcgtggtttccaaagacatcgccaatgtggttggtgtgcgccctaggctaggcccctagctagctagacacccacttgatcatcatcacaacaaatttaaaatacacttagtcaaggtttgtacgtcaacagtagtagctgttcaatttgtattggacaacagtctcagactaagcagccgagtgctatattttgtccttaattttaatttatacgcgtctgtgcttcggcgcaacgagttagctagacgacggagcatcgtccacaaagacagttaaattcttaagatttctcacgagacctcttatattattacatcatgacgacaatgcaagctcatcttgtcgggcaaataaatggtcggaaaaaaaccccccattctttttctgaattactgttactcaacagacctctctcctacgatttgacttcctcttacaaatatctctagtgtgatgcctgctggacctcacaagacgctctcaagaaaagcaggggcgttaggaaggttagacgctaagcaagcacgcgattaggaaaaaggaaagtgcccgtctgaggacgactccttagcgagaatactatagtctcgctcgccatgagacaggtcttgggcaggcatgacataagactatacgagagggattgttgtagggagctaagctaacacagctgcaaagtgcagttcgaagctactgtttacctaaaacccaagaaataaggggcgaaattgacgttcttattatatgtgctgcacgcaacgaataattaatctcccggtttctgttagatttagagcatgcatatatagaattaatgcatgggttgatgctttatatattgctgtccatgaagaaaccacaagtttatgaattttatttccttttcatatacagcacacagtcagttatcataattctagcagtcatgataacacttttctatatacggtgatcttttctcattggtcagatgtaactggtgagttttgtgtgtgtgtgtgtggtggcaatatatgtgctgactttctagggtgatcctttctcgtggcatgggtcacataagcaatcatattgcaaaatacccgataattaaaaaaagtagttgttgcctatattaaagagatcgtccagcacacccaccacctgagaattcccgagattcagtacaaaagctccagcaagagaactcacctaattaaaaaaaaggccagctttcccctgttgttttcttttcgggtgcaatccacgcctgtattttattattcgtgcagaaacaagaagaaatatactatatacacaatcataatttagcctgtcatgtgtttcaaggtactcttgttgtaggtcatcttttttttccggaaatggagttctgttcatatcgtttttatatgttatgtgatatgtacaacaaagcttttgtcaagggtatgcagctctggtgggtcatccatcgagggaaggttgggttctgattaatgattatatatattattcaataattgtgatgtttaatctaagtaagctaagaccggttcaggaattgagattagggatgtttttagttgcaatg

SEQ ID NO: 4624 - DNA, 1915 bp, Zea mays
  misc_feature (1)..(100): optimal_loci_42908_G1, chr1:253009382..253011296, Cluster 28
ggattaaaggagatagatgtaataaacgtgtaacctacgaagtgatagacatacgttatgttgatcactccatctttccatcttcttgaaacttatgccattacatcgtcctttcttcggcaagatgagacgtatgaaaattcatcacatgatcaacctctcactactaagtcaagttgcatctgaatctttccattctaatcttctccatggggtgttaggaaaggaggcctccaaaatcatcgtctgcatctgctcggtgtgcgtgcgattaggttttggcgagtcatcgtgtgactgctcgctgatcagattagaagattaccttcttcctctttttttctcgtggatgtctgatcttcttctttatggatgcaaatatcttctcgaacacataacgatgaggccatgagggtgcatacagttgtctcctttgtctcgcctctctgagttgcagttggtgtgagttattacccgtagatgcaaaccacataataataatctaggattcgagaactcttcaactcaaattcagaagaagaagaaaaaaaaaatcagattatactcttttgaattttgaatatacgatatctgtggaatctgattagttagcttgttctaaatgtttatatattcaaaaagaaatcggattgttctagtagatgttagtgtttggtttccttggtgaagatttcctcgttactatgtgcagatatgatctggagggcacctgatgcgtgcttgatcatatcacaaacgcccagttgtcggcagcttctcccctctccactccaaaaagcatattctcttttgtctcctttagcagcaaaagcaacggtcccaatcagctcttgtatacatttcaatccgattatgacccaccgagccatcccattcgcgctactaatattttcaacaaagagagatccagtgctgtctgctagctgcgtgtacgccttgttacacttgcctgctagctagtcgtcgtcgactgtcggtgtatagttgtttattgtttagacattttaggttagtgtctgatgagtaaataagctgaaaaccagtaatgcaagtcgtgtcctttttatgttttttttggtgtgtggttttggaggaagcacaagcacaagcacaagggtgtctgtagttgatgggaaagtaacagtttgatactactggtgtgatggggtgaatggtgatgccccagctaatcctgtcccaagaagacacaggaacagtcagacgcatgggggaggggagggtcttgggacaaaaagcctgagtgcctgacgaaagccatctttacataaacaaacaacccacgcattcagcaaaccagggaggagatgagatggctgactgactgctgctttgagtaaaacgctgttgttgttgctctggattgcaggcaaagcaacccagaaaaaatacacgagcacaacctttttttcttcttcttattcttcttctagttcagttcagtgccggatggatggacaactggacatggagccctgcccttgaaacaaaagtctctataggtatagagagcaggtaaagctgcatttggttcttgacaggacgtgcggcgagtgatttccagctaccaggagtacgggcgagatcgtcaacccaaccgtgcagtgcaacaatgacggacttgctaggggctacagttgtgccgttatttctggagtacagcgcccgcccaactggaaccgcagggcccacatattgatctcgccgtatataacgccactacactacgacttttgacctgattggtcgtaataatcagcgaacagtgatctccatgaacaaattaatacgcctgcctcgctcacgagccggccaaaaagagctaatcattctcgcctcacgcctatcatcacttcatcagtcactcgcttccatt

SEQ ID NO: 4625 - DNA, 1558 bp, Zea mays
  misc_feature (1)..(100): optimal_loci_43621_G1, chr1:256656896..256658453, Cluster 28
aaaggctcttcctcgcactcgaagggtctctacagctctcaaaatgaacaacaagacttcaaatagacaaactataagagtatagatagctccaatgcaagaaactagatgttgtccctccactcagctctcatggggtaccaggcatgtcccatgcacaccaactctatgcatcggacatgttcgttgcaactccaagagaaactagatgttactatactggtatctagtgctttgttcagtgcatcactagatatatacaatgggtataccactcaaaagtatagtttgtaaacctctatgagtttgtttgtctagtgccatatttagtacaacactgaccatgttcgacgcatgagtaatgagcctcttagacatgatttataacattttccaggtgtcatatctagtgacatatccagtgccacaccggatatgtctggtgattacccattgtcttagtctcatatacgagctctctgggtgccccgtctgatataatgtatcgagtgcacaccaatatgtcgaagctaagccaattcttaacctcctgttcagtggcccctatctaatgcccacggtgggtaatcactagacacgtttagtgctactgcaacatcgccaagtgcttgtttcaataggactaaatacaaaaaaaattggctacctaattactgatcatctagatgccatcctatcacaaataaatgtcctttattccacatcatatttatatttcttgctcgtttagatttgaatcattagcacaaaacttgcacatgagaatgatgtgcatataagttaacagattattgtgaattgtggttccttatggttggacgcgctcacctgaattggtgtcctcgaatcaagatgtatgctcatatatttttttaaaaaaattattgtatgaatatacaactctatttatgtgaattgtgatagagcctagagaacatgttcatcaatattgagacattgtgataatgtcaatctcaatatttgtgttcctatggaatgatttgtatatgtgattttataaatgtgagtgtgcatgtgtgtacaagtaaaatacatgttcatagtaaagaggatcaagtatatatttgatagttatatagcatttgcattgttttttaggccacctgaactcctagagtacaacatagttaagtcgtgaacatagactaattatataaaaaaagcatctactagcaaataaacactaaaacaccaaaagaccgtatatgatttgaataattctcaactagacacaataaggtccatgattttagatgaaaaaactagagctattttcatatttttcgaggtaaaacaatttttctataaatctatggtactaggattaaataaaatttgggctttttaattgcataactttttagaaaaaaacatttggatatattttttgaaaaaaattatataacattttccacaaattatatttcatcactcaactattgaagtactaatatcatatttacctccttcgtggttgatacggtgtcaagtgtgctgtccactaacacagtacatt

SEQ ID NO: 4626 - DNA, 2739 bp, Zea mays
  misc_feature (1)..(100): optimal_loci_46397_G1, chr1:271763515..271766253, Cluster 28
tttctctatccggtttaaggttcgtattcgataatattcgacaaaacagtaaaatgacacgcttttatatagtgttttttttgtctgtgttctccccacagctcatatatagctctcgtttgtactcctaacctacggagtttctctgcaagaactaaaccatcttatcctgaccatctctctcgcgctctctctctctctctctctctagctaggtacccacaaatggtgtgacaaatataatacggccttattttgcacggtgggaaatgaacctcttcgcgtgtagcagtcaaccctggaaaaccatctcccctaccatttttcacgataaaaacacggagcaccctgcaatcgagcatgtgaaaaattaagatttcgcgtgcgccatcaagccgaactggcagtgagctgagattctgcgttgaccactcactgcccttcccccccgccgaccagtgcaaccaggaatcgtcggacagtgctgccacgtcaagtccagcgacccgccgtgcaagtgcgaagacatgcatgcatcagccacccgtaccaggtaccacacacacagacacacaggtccgcagacacgactgacagctgcaagtgtaaattccaccggataatactgcggtcgctttcatccctctgtcaccgggataatattttactcgatctaccaacctctaggttcgctggacaaaccccgtatatatataaatggtgcatggtcctaaaaactttcatatctacgtactaaaaattttcgagatcatatttaatgtggatttgtttgctcggaatgtgttattatgacctcacttcatattatgtgtgttgtagtaaagatgaaaaactaccgaatttaaattaccaggttatagatctatagatacataatgtctctatacaacttaaagaggaaatgtcttcactctacagaaaatcaaaaggaaacgatgatgaactcgtgacagattgtactgttgcttcattgacacagagcaaaggaaacgatttttttagaaaaataggaagccaagagggaccatcgcccacagcccccacatatatacggcgggcggtgggagcgagcgggggagtagggagacatcgcgtcgcagtcgtgcctgatcctggtgatcacgggtatcatcaagatcaagatcaagctcagccaaaagataagcaatcaaaataaaaagagataagctaataatcgcccccatactctcatccatgcatgcatgacgacataggacggagcacgtagtacatatataccgctggctgtactaataataacactattaaagcagagccgcagtcgcaagcgtcgtcaagggttccaagtatagattaagggaaaagcgcgtagacaggtcggtctattttcggcccttggatggagaccaggaggttgcttgagcacgtattaatgtaggaggagtaccgtacccagcagctggtggatgacttggacacgcacgcacgggacggcacgatctgggaagcttcgaaccaagcggaggaggatcggagaccgtgtcttggccaccacccatatcgggccggcctggggcctgggtgggcgactgggcgttctcgtcatcgaaaaaaaagggcaaagtcggtggacaaaactgtgtgctgaaatgtgcgaagtgcgactagagggatcggtccccgtcctagccccctctctcgtttcgttggtatccgtggcaatcctcgccgacaccggaaaattgagtactagtactcctacaactcgattttactaaagcatactacacgggagtctgacgttgttggtgtctttttttcccctctccattcgtttgaccatttggtttttttaaataaaaaactagtacaaggcaatggtaaatcacttttgctgacattcttcccgctttacttaactacaagtaaagtaggaatgaagcctgtaccactcttggaggaaataaaaaaaaatatgcttagagctaaggaaaaaatttctgcaacactcgctcgctcaaggccgggctactcaagtttgcctcattcatgtgtcgttagacgtcttcggtagaatgcgtaaaatagtaacgtgaaactgtagataatactgtttaacactatttataaagagagaatttgaaatagggaatacaatatgagataagataaggatgtgctcgagaaagtcttagagcttagaccccccgtagagggtcacgagacaaaatagcaacccttgtttatctacaggaagcaaacgacatctttaatgttgtgttagttgtcagttttgtaaccaccatgagctttagctaacatatgtatttatattagcccagcaatttacgatatctgtgtgttatgaaattctgttttccaaacagtctaagctttcgattctattccttcatgtatcgtctaccattcttatatatgttttgtattcctctattccgaacacgtcgacgacggattcggccgcgctccagataggtgaaagaatcgggtagggctcgctagtcggcagtcgctactcccggtgatgtcacgggtgcgtagcttgtgaccggccataacattcaaattttaatgttctgctctgacgaaacaaatagtggtgtattgcggtgaataatgttcttcatgtacgtaatcctgtacagcagcccacgatatacaagttcttcgctagtactgaaaacggtaaaagttgtgcgtagcaggaccggcgtt

SEQ ID NO: 4627 - DNA, 1565 bp, Zea mays
  misc_feature (1)..(100): optimal_loci_47886_G1, chr1:280084463..280086027, Cluster 28
aggatgggttgcttctgaagtctgcgctgtggtgagaactagagttctgttatgaatatgtcccatgtaggctggcactgtataagatggattgatgtaagctggaggaatgtagggccaaaatattgagggtcctatatctttagttggaacatagccagggatggtaacaacgcgggacagggtcgggggagtgctccccgtcccctccctaatccccaaaatctgttccctgccccgacctcgatatgcttaatgaggaggatttattctcgtccccaaacggggacccaatccccacgaggaacctatggggattaattgttgagcataaatattatgatatcaacaaataaaccatgttatcatgtaggcgagcgacaactgagtgaagaaaatgagggttatggttagcgagtgggaatgttgtatctttatacagggtcacactgagacgatttgttagattcaaccttcatatcttgcgtggggaggatctgactcttaactcgggttcccatcaaatccttgtagggaaaattcatccccacccctgcctcgttatgttttggatccttgccccatcatccccacggggaaaatttcagccacatcctgcccccatggggaaaatgtcgtccttaaacatagccataagaaattcccatagtgctgagtgtagtagtcctcctactgccactactcatggtaactctccataatcctatgaggtcatgaagctagtgcatctagaagtgatggaggagctagaacatcaagcataatatgagcattcatatctctaagcatcagatcatgtatcctggtggcctatctagctctcactctcgcttggtgccatctcatttatgtcactaactctcctgcacaacctgaacacaatgttatacatctttctgataggagacggtgaattgtcactgtgcctagaagacctctgcctctaagtacccaactgctatgtggaagctacactagtagtcccagttgaaagtggagttgcataagtagatgctcctagtgcgcttggcacaataggattctttagacaagtagtccttagtggtttatactcaacatccttcaagtcttatttgtaatattttaatcatcaacatggcatacggtgcatagccataattctataatcaaaactcagtaattgactttatctcttcttaaagaaaatggaacacacctaaaggagttgttgtgggtgtcatactgacgaacaaattctttgtataaaaattgatgttctcattatctctatcttttggtgtgagtgtccttataaacattcaattgagagatgtgaatagaaggaatgcatgcctttgactataccgaagttaccttgcacatttggcagatacttgaatttcatttgattcacaagtaaatggctctcactatgaatcctttgcttgttgaggtctctcctatcaaattaaaacatcttgctaaacctctcatagatcacttggtgccatgtaccctcaatcatccaatgcataacccgcttctttatgtctccatatgag

SEQ ID NO: 4628 - DNA, 2498 bp, Zea mays
  misc_feature (1)..(100): optimal_loci_50325_G1, chr1:292524386..292526883, Cluster 28
acatatatttttctacttgtttcattctagtgcctagcgcgttatgggcaaagttcctataaagtctaacacgtataaattacaatagtatctatctgatcatagctagtacgaaatctatttttaaatatactgtatcagattagataacgcaagatgtaaatcccgttggaatatacggcacacggatatcttcatatatcagcgtacgttcgttatgaaaaagggtacttgaggacctcctggacagcatgctaccaaatctggaccattcagttcgttgcaagatgaattttgccgatgaaacactactgggtctgggaccgacacacgcgcacaggagtcgtggcacggacctaacaccatctattcagttgaaggtcacgcagcacattgcttcagttaaacgtaacgaaaacttttaggtgagcgtctcctgggcgtcaacaacgtaacttgaggcacaccgtgggtgccatttggtgtacctaaaatgctgcgttatccggcgatacgaccgcggacgatggacggatgaaaagctgaaagcgacacgatcgaccaacgacgcgcgtcagtaacatagtttttttttttcggagccaacgtctccgtccagaagattttggagagctaaatagttctacatttgattgtaatttttcatttttgaaccactatgttatatataaaatcaattcaattcaaacaataagttaggaagcgaaccgtacctcagaaccaaatgctacctaaatcacctaaatcaaggggacttgtaacacaaaaaaggcctggttttcttttcctttttcttcttccgtgtgtcttgcaagcaaagtctatgtttagatcatgcgtggctgaaaagagggtttaaaaggtacggcgccggggcagttggccaatgaatatagggtatatagcgacaccgtgtgttttgcgtttggtgagggtttgcagttggtcgtccatgctccatagtagtgattaattagcgcagacgattaaaagccagatcccattaatcatcgtcgcaggcccgatcgatccttccatgcgtcgttattattagaaaagtaataatggagctgctggatgtcctggataaagcaggaaaagaaacggaaccgacgatttgaagccttacgtcagcttgatacccgttgatgcatgtcggatcacgcgtgtacgtagctaatacactcttggtcgacacatgatcctaaatacaataaagaccgtagctcaaattgatatagagagaccggtacggaggtagttataggatcgacaacatcatctagaacaccgtacgccaaattttgatgtggtagacgtgacgaacagcaagatagagagagaaaaggattaaaaaaagctaacagatgtatttttgatctgttgaatgttggatatatcgatcgatcgtgatctctctaaaacatatagaggggctagtagtatataactcaaacatgttttttaagttccccgcataaaaaagcgacgagaaaacgaattggtttggaaatctggagaaaaaaattggtctactgaactttccaagttgattaggtcggatttcatggggagcgatagagaatactcttgggagagcatatattccattgatcacttttgggagagcatatatgaatttccaaattttgccatccctacttggctccctctcgtgactctgttgtataccgtgtatccttccttggcagtttgcatgtaccccctctggacagatgtgggccccccagatgcgttcagagagattgcgaccatgtttggattggatatagttcatgcgcatattcattttctagatcaattacaggagtttattcacccattgcccacattccatatgtttggttgccccgtgagttcaaccaggctctccacatatattgactagacctcgttctgtgttcggttgtctgtgtacgaaatagacgacacttggatgtgctgatgcaatcgaagccaaatcatgcagcatttcctccatccgtggagacacggttcggacgcgtatcaaccagtcaggctgcaacgacgaccaacgagacaaccaatcacatggattgtaaagtgtccaccatctaataaaataatttgcccattcttcaaattaatggtgtgtatctccctgcacgttggtcccgtggtccgggcgctacttcatcgacgacgacgccattcgagtttccctatcgctagccattcgatgttctcagtctactgaacttactcgatgcaaggtttgtttgtttgttgctgatgctggacgcggtgaaaagacctagcatcctggcgatttctgaacgggaaggtttatgtgctggtgacgctgcaggcctagcatatatatatgctggcagtatctgaaggtaggcaaaaaaaaaaagggacgtcgcattgaaattttaagcaacacaattgcggcagcatgcccgtcgtctccggcgagtgctggcagttgt

SEQ ID NO: 4629 - DNA, 1443 bp, Zea mays
  misc_feature (1)..(100): optimal_loci_50411_G1, chr1:293001006..293002448, Cluster 28
tctctaactttctgaaactgttaaaatacctaacactagatgtaaaggaaggaagcgagtaaaaaattaaaagggaagaaccttaaagaggatatacaaatgaaagcaacataatatgcattaatctgacttcaaatatatgatgatacttttgtctcaataaattctggaattatgtgtttttcttagtggtaccgagtttatgtgattttcctgaatgttgtgtgatttttttgggtttctgtgattttctcggtggtgcatgagagttttcctataattttttgggtggtgtgtgacagttttatagatccaatataaaggggaatactataagaaatgttgatgatgtatgagagtttttagatccaatctatcaaataatactatatgaaattgctcgtggtgtaagaagaaaaatatgctatatatatttttttactaagaacatgactttagaggattgattatggtaaaagagatgcttgattatgatagatttaaatgatgatagaagagacgatttagactgattacaacgactttatatgattgattacatgatgcaagaagaaacaactggatgattaattatgatataagggatgatcaattatatacaagaagagacgctttagacgatcaattacgagacaaaagatgattgattatgatacaagagacaatcaaatagatggttgattataataaatgcaagaagagacaattgattacaacagaagatgctggtcatctgctttttactatgagtccaactttagacgactttgcttacaatacaactctagacgactttgcttagaatacaagatgctagatatctgctttatgatgagcctaatacatagatgctagatatctataacccaatatccaaatttaaaagactcttgtttagacgactgggcttacaataccaactttagacgactcttcttacaatacaagatgttgtattttttacgagaagtctaactttagatgactatttttaatggtgagtcgaatgttctatttttacgatgaatcttctaattttttattatagtctaactttagatgactccctttttacgatgagctaaatgataaatatctgttttttttatgatgagtctagcttttaatttgtcgaacactaaatatatctgctttttatgatgagccaacctttttacgatgagctaaatgctaaatatctgtcttttgtgaaaagacgatgagcataaatttcaattcgtcgaatgctaaatatttgtaacttttgaaatgataatcatgtgctttttatgatgatcctaacttttgatttgaccaatgctgattttacgacaagacttaaatatcttttattttactttgcaattctgattttacggttttttcaaatgctaaatatgtatttctttacccttttactct

SEQ ID NO: 4630 - DNA, 1511 bp, Zea mays
  misc_feature (1)..(100): optimal_loci_52428_G1, chr2:3591506..3593016, Cluster 28
gatatatactcgtcgttttcagagggaacgcagaggtcagaacacgtacgctagtatagtatagtatagccaccaaacatcgcagcacggtttccggggattcccttttaccgtatacatcagatacaggactatggctctatatctgttcacctgaagttgtattttcatattggagtttttttaataaaaaaaatgcaacagacaaggctcctcctgctgtcctgcagagctcaacaagctaccaatgcaagtatatacatacaccgactgtcctctgcaggtggtactgtctgctctctgttgtacatacgttaacaagttgatgctttctgtttccgactggcctcctacatacgacgacaacttccgtttcagaaggaaacaaaacaagcgcaggcaggggcctataaacatttctttcattaccaggatatatgattattattattattacgataacgacacagataacccagatgagttagggggtgaaccagagaagcatttgcttgggttctttgcagttcgtctcacctttgcagttcgttctctgttgtcctaagcttttctcatcaagctttcaccgaccgggggatgggatgggcgaccatcaccatcaccatcatcatcatgttcacgtggactctttgcggtggtggttagttactggtggtaccaaagttagtttttatggcctgcggattaaattatgcaggctcgactcgactcgagcacgtaggtgggtgagtgaggctagctaaagtacactgttcatgtcctaccgactactagtactgaagctgacactgaaggcatgcatgcctcggtagttacgccccgactcatgccatgtggactctctctctctctctctcttgcacacaagcctccagaattctttgagttacgaaatcataaaaggccctagttaaatgcggcgctaatggagtcctacagattactaaatgcataaccgtttatcaaccaacctactagttggactaggacttgtaagacgaaaattcttttatcacagacgcgaaaccaaaaaacaaatctgaactaggactcgtattttccatgaatcatgcgtgcatggataatgatgctcttatatatgcaccgacatgtccgcgtaagcgacaagtgtgcaagcataaccgtttctactactgattaagcaacggccaacgcggtttcttatgagcggtgacaaaatatagtgacccggcgcacgtttggacatatccacgtggtcgaaaagtgtgacaaaggacgctactagtactgaagtgctttaaatgcacttctaaaataaactagtctaaacaacacggtcaatagtttagctagctattagctattttttaggtggatacatccaaacactctcgactaatagtcctgcatcctcatctacgcattagtttactataattggttcaacccagctaaaatcaattagtagttaatcaaccaattttagtagcactttttagccaatttaa

SEQ ID NO: 4631 - DNA, 1641 bp, Zea mays
  misc_feature (1)..(100): optimal_loci_53483_G1, chr2:9270275..9271915, Cluster 28
cgtgagtctctttcggagttctctctcactaacatcgtcaaaaaaaaaaaaaaaaaccatttcactccaaggattcaccgcgcgcaactgtcccggctgggcggggtagcttcggagcatcgccttctgacccaaacactggccgcgtgaccatgtccatgagtgagcgacggtccacatgccgagagagactggatagcactgctgctggtggtggaagtggaagcgaggccggcagagtttcgccgtcggcgcttcggccgtgcacctagcgcatgtacgggaatctggcgcaatgcagcgtgcatggcgttaaagttggtgcggtgtggtagtggtagctggccgctgcccgctggggctcttttgtcccggcgtgtatgtgcactagtgactagtgagtgagtgacagtgctttttaagcctttgacgatgacggtgcgtggcagcgtgggtatggttcgttgctcctgctgcagagttttatcagttgcttaacgcgagcggaaggacacgtgctcttctggctgcagcattcgtgtcccttttcacttgtcgctcagtaatggcggctgattagtggccaaaaactaaccacgggtataatattgtgctctttttctatcggttatttttcagagcaatttattagactggttttcagcaacatcttgcaaaacgagcgcaatatatctttaaaaaaaagaatcagtgcttagctagtcactcttccttttttggggaagatggactgtccccgggagtcttgtgattctttctcgcttgtttttatttgctttgttgtggctttctaaaaactagaagacgtgctcgtccgacaactcatgtgtttacaaccagttatgatgtcctattatatttataaataagaacttttaaaaaagagcagactttgtaaggtatagagtcgtgcacgtatatatactataaaaagaatacaatacttttaccagatcacttaatctgagattatttttgaagaaaccgaaccaataaagtttcatatgctttccaaaaaaaatattaaacaatatacattttgtgtccacgcctttctcagcacaatggtctgtaagatgccaataaacgaagagaatatgacaacatatcaaatagcagtgctcttcagtaagggaggctagaatgaagtcaaacaaatcaatagcagtcatacataactatcaaagaatcaaatagcctaggttcaagatggtggaatccagacagtccttttgttgaagcaagtgaagcctacttttgtgatttcagaccataagtagtgtaaacatataatcagcccaaacagtcctttttgtcagagcaagtgaagtctacttttgtaatttcagaccataagcagtgtaaatatgttcgtctctataattttcaacctaaacactgcggacctttttttctctctcccaatggttgttttttcatatcacaaacaacggtttcaggccacaagaaggtgaatttagttaccttgcaaacaagaattacaaatcacgcaaacaacttaatacacacatcaatttaacttactgaaaatgacagcatatggtcacctaaaatgttaagcatgctatgtattatgacattatgacttgatcggttgct

SEQ ID NO: 4632 - DNA, 2104 bp, Zea mays
  misc_feature (1)..(100): optimal_loci_54083_G1, chr2:12246102..12248205, Cluster 28
gttactagtactaggagcatatatggctggctcatcgtcgaaacggaagcagagagatatatacagttgatgatgatgtggtcttcgatgtttgtttgtttaattccctctggtctaaaaagcacggcaaccgagtcacaccaccctctaaaagaaaactggaaagtgacagaacctccaacaaaaaaaccactacgtacgtggcagactagcagtccgtgtctactggtactcctctgacaaatccattgtagttaaggtttatttcgtttaataaaatggtactcgacaatatatacagctctgaacaacctctaagtttctattagatgtttattattacactgccaaagatacgatatttatgatgacaaatatggttgtgttgacttgaggggacaatttactcactacgtggcaaattatatctgcttggattgcacaaacagatctcattcaaattgtgcagttttttaattactagtggcgaatgtacatttgtatatactaatgacgaatataaggtatgtatactttgactgtgtgaacaaaagattgaactcgtaagcctacaaccacaaacttcactatcacaccaaaggccattttcatcacttctaaaaaagggcatcttaacaaaaccacatatgttcagtaggctataaattgattctacacaacatctcttctatgaaagaaaatattgtctaagctttacaaccaggacaattttttatatatatagtcaatgtgtgattgttgcgtaataacatgttctattgccgcacttacgataaaatccatttaatagacaggtgattgattgtgtagtgtagcgtggcactggttggctaagttctataacgcggcagcaacaataaccaatgccaaaatcgatacataggttatgctatcatctaagctttttaattatcatattttttttaaataaaaaacaatatatgtacagatacttctatagatggtccttaagaaagataaaagttacattttgtgttgtccagtaagttattctaaactttagctacaagatagcttttgtaaatcaggtttgaatgcttggaagtactgctcatagatttatcttaaaatataacttatagatatgtattttctatacttcatagatatactatgataaaaataataccattttggaatagttcacttttagacaatcttaagacctcaattatttgtgattcgaggaagtagatccatcaccatcatggaaaccaatccattggattacatcaagattttgttatagtctttatgacacatcaatcttactttatcaatgcaagacttttaattaagttacaacattattatttttaatactaattttcactattgggtacaatacaactttgatgaactatatcaacaggtagtggcatgtgcccctaagagttaaattgcctaacaatggaccctaaacatacggtgaaggttctatgcaagcaagacaaagttattagctagcacaataagaaaatggcatggtaacgacaaaaatgctatgtaatcgatgtaaaatggtcgtgggaccacatgttctagtgttgcagcttacaacaaaaagtcatttgccaaacatgtgagtgattgtgtagcggagtgtggcgttgattggctaagatatataacaacaacagttataggtaccaaattgatacatagaccatggtattgtataagcttgataatcatcatgattttattaaaataaacaatatatatgcttttctaaatggtcctgaaaaagaaagattatgttgcattttgttttgacaagtcaatgataccaaatttggatacaagaattaaatgctcggtagtgatatagatttgtctaaaagatagcttagaaatatacattttctatactttatagatatattataattaaaattagtaccaatttaaaatatttagattttagaaatccttaataatttagttatttatgattggaggaactagatttgtcacaatcatggagaccaatccactatactatatgaagatttagttctagattttttactcaccaaccttaaagttattagtggaaacc

SEQ ID NO: 4633 - DNA, 1730 bp, Zea mays
  misc_feature (1)..(100): optimal_loci_56952_G1, chr2:28124484..28126213, Cluster 28
acctagcatacctttgacttgtagggccatttgtttagagatgacagtcaaacctatggtatgtatgtctatggattccacatatattaggtgtagacgtgagtgtcaaattagatatttagatctatagatagatatagtacggtgttaaattaaatccacgggtctattgtgggtgtggattttgatttttttaatgatgtgactgatttaaaagcgtcacaatatataatggaatctcttagttgtctcttttaattgtaaaattgatacagacacacccaatattgtacatgctcttaaaaataacaaaagagcctagagatatattttattaaccataggtactaagcaaaagttctaatacttaagtatgtctttatattcagcccttttagaagcacaacttgatagagtagtaaatactgtaagtttcagagaggcaaaagcagtttcaaaatctttggcgtggttccgagtactttatcagacatttagactgataatagaagtttgttttcctttgagttgaaaggcgtatataaatcggagctgaattaaaaagagtgatcaccaaagcatgatagctaccgtagtgctgtagttcgatgatttggtcgttatctgaaagctgcacaccaaccatgcatgatagatagctaccgtagtactgctactgcagttcgatcgccaaggcaagaactgaaaaacgagcaccatctgacttttagtagcgcataagaaataagacatgccatatccattggaaaacaaaaacaaaaaggtaggagcggattggaccgttctctgcggcagtttttccagtaattccatggtcaaaagaaaggacaaagctccgagatgaccacagttccgaacacacagtttcgtagcgacaaaacccagaaacaatgggctaatcaggaaatcaacgagcaacataagctagttacatgtagatgtacgtagtgtgattccttctcacttgtttgaccgaatcagggcggcagcttcgtagaagaagatgattttggtcgatcgagcaggttataactacacttgtagctgactagaacagttgcagctgactagaaatacagctctggtgctagtagtttgacacaagttttttatgcattaaccaccagctcacgatgatcaacagctagtagctctggtggtagtcgtacatgcatgtgctagcggttgatcatcatgagccatgtgaacatgtgatccatctatgtaactattaatctctctctctctctatgagttgaacatatcagctacaatctaaactattggtataacccgtacaaaccaatataagaataaagagaccttgatgcgcggcgttggtgacgccgtctatgtaagaggcaccattgacacagcaacgaaccgcctcaggaatacactcaccgacaacacacacgccagccactcgatcgagttacagcctttctctccaacttctgttgtcggaccgcagacggcgctccgtctgttttcccagcagagatacacagggtgacaggccggatcaatgtactccgtctgttttaccacccagagaatgtcaagccgtgtgcctcagctattttcagcaatcagacgtgtaaactgcagctggaaaaaaaggattgcagggatcaggatacatataagatcagtattcagtagcaaaagccaaacgggctgaggtctgaaacccatcgcatctccag

SEQ ID NO: 4634 - DNA, 1709 bp, Zea mays
  misc_feature (1)..(100): optimal_loci_58275_G1, chr2:36084154..36085862, Cluster 28
tgagttttaagtttaaaagtttagttaagttttttgctacaaatatttaatttgaaaatattgaaggatgttgatgctaagctatttaaaattgttgttttgttctaattttgtataaaggtgttttaaaactagagtaattattagtattatgcattttactttaaaccaacattgaattttgcatgcatgctaatttaggtttgtttatttatatagcatcagtgtctaagataaaatgtcctaattgttgtctcttgactagagctactaaaaggcaccaattatccctcttagagggacaagataaatatgaccttggctttaacagagatagactatctcattgacaatccaaatccgattggcctggtgttggcaacagaaggagtgtctgaggtagaaaataatgttgacttgataatggcatatgacctcaaacgcataaagtaggagagatcaaataaaaagtgtatgatggtcataagaagcactggcaacgtgtgcaccccaaaccaggtcagtagcacatggtgatgagtccatccatcacatttatcacgaagagcaatgttgtgatcaaagtcatcattgtagccacacctaaggtcgtaggtgtatccgcaagcactatgcaatatatgtgccttcataagctactaactatatcatacttgttggcatgggcaatcataccttccactgtgacatgtcacactcgccactatggcacacgagaggcaccctctttgtacggtacaacaactataataagataggactagttggacctatggtaggtagggattgttgtccatgtagggatataactctcttgtaccttgtgatattaaaagggaggcatagagaaacattgaaatgtcttattctctcttaggcttctctctgggcgtgaaggctagagggcaatcaggctcgctctgtcgctcgataaacattgcacgtggaagctagggctattctcactggctagctcgaacatcatctaagtatgtaagctctatcggtactcgcatctaatcatctagcacacaaaggatgtagggtacacttaagaggcctaaacctctctacattgtacatgtcgtgttgacactatattctagcagtcccaggtctatgccctctttgagtgtgtctctaattttctatgttgtcacatcccaatgacacctatactcaagaattaaatataaaaattatcctccacttgagctatcattcatccatttgcttaccacattgaccatgcataattgagggtcttaaacacttctatctttgagcatgtcaaccttcaacatgtgatttctgttgaaggtttcatgtcactttcatcatttgatttgatccttgatattagtgtaacttttaatatcttgattagtacatcaagtaaatgtaagtctatttcttttccaccttatctaggttctatggtcccccaagccattgcttgccctttacgcttactcagtgccttgaagacgtttcattgccattttcactttctcaagcaatcatcttgttttgcttcaaattataattaagcatataatgaatatcattttcatttgcactattctattctgcttgaactagattgttttcattaataagtgatttaagcattgacaactaacaatttccatcatatttgatttgtatcatacaagctcttatagttg

SEQ ID NO: 4635 - DNA, 1539 bp, Zea mays
  misc_feature (1)..(100): optimal_loci_61504_G1, chr2:54760511..54762049, Cluster 28
cttttctcggtccttctcttctcatccatggtccccgtgggacaaggcaggcaggccccgtccatcatccatgaacccgatggagctcttgcctgcacagcgtcctagcttggcattagcagtgccaaccaaaccggtcattaattttgtttcatctcagtgtgtatttaattttgtttgtcgatctaagtagtaggaggagtacataggtagctctagatagtctagtccacttttaactttaactgctcgtcaacccaagttaggcctatctgatgagtgtgcgtaatatataaagcacaccgtctatctagagagagaggaaaaaaatcttacgtttcagttgacattatctttaactgatatactaccaggttgccaagagctaggtatcttcgctctaaattagaagacgtcctgattttttaaaaacgattagttttttcttcttcttctatacattagatttatacataatacaaataatataaaatctggaggaaaaaaattctaaagtctaatattttgaaacaaaaacaagtacctcttataatttagaagaactgtacgagtatcagtgcgtgtcttgcctatcgtaaatactcctgctctactcctcatatataccatatataggacggtttttttatatgttttttttgccattccggaaaagttttagggacagatggcaccggaataatgaaggtcaagcaccagctagctgtcactaacgcatggtttgaaaagacccacgcggcaaaaaaaaagttttagattattttgacctaataatacgagtcaatctgaaaagcgaagttacggggcagatgtacatgcatgcagatcagaggaagtcacggtcgaagacgggtactcagatcacgatcgaaatcagatcattaaccatgctatacggtgcatgtcttgcctaacggtaacggctagtacacaacaacagtcagtaaaaaagcccgtacgttgtagggtttggttcaccttttgaccggccatcgccttcaccttacacaccttcaggctttcatctacggcctacggtggcaggtggcgatcaatccgacgacgtactggtaccctacatagttttatataaactctgtctgcacgtacgcggcccctttttctcgtcgatgactgctcatgttgagcacagggaggacaagagccacgttaccgctgatgaaagcgtgctttcctttctcgtgctgtatgtactagtacgtactaccgccaccagtccaccacgcactggttggtcttcacgtgtcagtcattatcacacacaccgcactactcccactgcgttttgttcctgcagtcagagaagacactagaaataaaataccacagcaaacataagtatatactccgtatatctctgacatccatcgatatacccatgtgagcatgtggccaccaaggccacaccgccactccgaaagcgattatatctcaactcaagtcgaccgagagcggcatataaattcgtgcgaagatatacgattagttccggaaaaa

SEQ ID NO: 4636 - DNA, 1561 bp, Zea mays
  misc_feature (1)..(100): optimal_loci_85971_G1, chr2:205933532..205935092, Cluster 28
gatacatggactcggaattgtatagtataatctcttaactttttgttatgtttaaaaaaacagatccgtggtctcaaggttgtgtgtatgcattaagtaagatatattcgaaccaacacttatctttcttagaaaacgccacaggatatactactcatcacaccaaaaaatcaaattttgtttgatgacttgaaaaaattatggccaccatagaaaacgcatgacaaaaagacaaaatgaagaaaaatggacttacaacaaaatatcaactccaaaattcaaggaaaactctggggatctaaaaaatctgcacgagtttgaggttgtcttcacattttttttttgctgaactgcttaacctcaagacaaatcgatccaacctttatcgatgcatctgacaactacgagctcttcaagactttgattcgtcctaacacaaactttgtgatgacgtcacgtgttgccttccattttggatagagcttcaattaggttttgaagccaaaacccaaaaaaaatcgttcatattgggtccaaaatcactgaagtcctcatgattagtctatttgatatgttttctccacgatcttgagttgttgacacgtggcatctttggtcctcaaatgttcgatcataaagttccctaatgtctttgctggactttggtcaaccgtcgtcttgacttagtcaacacatttcctactcctcatatacttttgcaccccatttagatgtaggcaataaaaattatagctggaattaaagtttattttcttagtattggactataactagaagttgtcactcacaattcatagcctagacccactgttttggctgaaattataattccaattacatctaaacaacagtacccttgtacttgacgatgttcctaattgtcgctcgtatacggtcagcgtgtcgggctctttgatttctcgctttaatcctcatagcgtatgagctcctagttatcgacatgaacatgtttcgtcgtctttttgtactccgcacccatgagccataaaatcaaaaggcatattacatgtatcacaaataccattaaggttagtcaatactaagcatagatcaattatcttatttgacgatcacctatgctatttaaacacgcacccacgtcccaccagccgtcgtgaggctgctggccgtaaaaagcgccggtgcagctggaaaagggacgccacggccactcattcacacttcgccgtctcgctacgtccgtgagccggcggatcgcgtcgtgcgacacggacaccgactaggccgtgcgtggcctttctcttttggcggagcgatttttgccgtgacactgactgcagcaccagggtccaggggcagcagcatacatgatacatctgcgtcgctcttatggcatgcatgacggataaacttgcgtgcgctttatttggcgaccagcctacggcctacccgagtacagtacccatgcagcagcataacgacaaggagaaaccccacccgtgacggtttgtgagcccggcctgtccagcgaatcacagtgatggaacgtagtagccgg

SEQ ID NO: 4637 - DNA, 1931 bp, Zea mays
  misc_feature (1)..(100): optimal_loci_86326_G1, chr2:207693337..207695267, Cluster 28
tttggtcttgtttgatagagtttggcttctacattgacatcatagcatgtgaaatttattatcttcagttacgtagaaactacatttgtcagctgactgtagcctataaaaaattgtttgtctaattttcgccagttgactgtaaccgatgaaaattagcttattattatccattaatttgtaagaacaaaggctgacaaagtttatcctatgccgttgaaaaatagcgaatttccatgggtagcacgtaattttcaacggtctttgatcggcgaaaactattcagattactgttgtgatagttttaatggctgatggtgcaacgagacagttttaaatggttaaaaaaaatatgtatctacaattgtcacaaatgtcacactgaggttgaaaagtttatttataggaatgggttatgggtgacgtggaattatcgacggataagttctgaaaaatccttagcgactaatcgttcgtacgtctgtaacttctcctgtaactatagcttgtattaccattactatttacattatatttcgtgaaccaaacaatacctaattcaagcgcacaccgcggcccatgaacgctgataaatctcatactacactctagtggatatgatgcgaaagaaataacagaaattttcgcaaggagagcagaacaactccttgccttttctgaagtgccaaattattcaagctggagcagaacatcttgtcggacaggttggtacgcagttgagcggagtaacccacctgctttttttttaatccatctccttccttcttcgactgtctgctaactggagatgtgggtttttgcgcaaagaccattcaagtattgcacgcaaagacgacgagcgaaagccgagctgccagcagaaagtacccccattgttcagctccctgaaccaccttcctgatgaacaaagctgaagttggtgagacagagagagagagagagacggtgctgacggaagacgacgtcgacgcgtgcagtgcaaaagtgcactactcggttcgttccagagcttccgccagaagagcaagggggagtaggtggccatgctcgagcctttcgtgatgtcgtgagggtcactcttcctctcgaaccaatccgcattcctcctgttcagagacagctagcgtccaggaaactgatggtattggtaggcagaaccctccaccagacatgaagggccaggcgtcgtgacctcgccttcactccagtgttgtgtagcatagcatgcatgccctttgctgatgatagtggcaagcctatgcctaccccaacttgacaggacagctcgtgaccgttccacttgcacggtgatctgatcccgccggcgccactcgattttttttttgaacaccatgctcgatctccttttattccccgccatcgttattgctaccatccgtcgcaaatcttgctcagaaatgtgattctggacctaaataagattattatccgacgtccgtacgaccacttcaaaagaatcaattgtttaaatatttggtgacgattgtacgtaaatctggtggtaataataggcaggggatatagtttagtttattgcttgttccccattcgattctgcaaacgcaaatggaggatttacacttggttgataatcgaaatttcagaatatcaagtacaacaaggagcgcaggggggctaggtggggcacccccaacaatatatactactaatcccttatcagctctttaatattagtgttaagtagctcatttatgaaggttttccttcctcctcgattgaagaagaagttattaggacatgtatgacccacgtaaatgacttatatattaagagatttctaagtaagtgtaaaaaaatacaagacatgtatctcgatagaggaacgtctctaatatggttctctgtgtctagatacagtttcgcccata

SEQ ID NO: 4638 - DNA, 1476 bp, Zea mays
  misc_feature (1)..(100): optimal_loci_86453_G1, chr2:208219015..208220490, Cluster 28
  modified_base (390)..(390): a, c, g, or t
  misc_feature (390)..(489): n is a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
  modified_base (489)..(489): a, c, g, or t
agcgagagttggcgcacgggaaccaaagatggcccatggatggacgcgcggaccctagctccggagattttttgcaggcggtctagggtttgggggcgtcgccgacatggggcagggcccgggggatggatggaaggttggatgtgcgagttaagggttttcgtgaggaccccccgaagatgagaaaccggagattcacgtggggcgtatgacccttgttggcgccggtgaacgggggctgctttgtctccggcgggcacgggggggactgtctcgtgtccttacggttcgagggcggtgtttcccccggttgccttgaacggcgtcttctgctttctcctggggttcctgtaaaaggtcgggggcgttgggggcttaaaggcttctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccgtctgatgaatcagcttgattcgttgtggaccttttagcactttgtgtgtttttttattagaacagaattatattatatgttgtgcacaggaaaataaccattcattttactgcagatggcatatcacagggagataaaaaaatgtgctgcatctgtaaattttctttattactttgatgcctatgatttgactcctatcatgtatttttatccttatattttgacagttgttaagcatgcttttagattatactcccttgttgctgatggtaataataaaaaaatctgtctgtttcctttcagacggtgcacccaagtaacccaacatttttctctgcagattgacttggatacaattgaagttagcaatctgaatagacagtttttgtttcggcagagtcatgttggtcagtcaaaagctaaagtgagtttcacatatgactagaataattatccatgtaccagtttttcttgtaatcacccaatcgttgtttcttttttcttactctgttttacaccgctggtgttgccaggttgctcgggatgctgtattgaaatttaggccaaatatcaatataaacccataccatgcaaacgtgaaggattctcatttcaatgttgatttcttcaagcaatttaatgttgttctgaatggtcttgataacttggatgctagacgccatgttaatcgcctttgccttgctgctgatgttcctttggttgaaagtggtactactggttttttgggacaggtaaggcaacccaatactgcagttgtagtctgggctgtttttttttaaaaatatagttggcagctctattgcctgatttgtttcaaaaagaagtatatgcttatagatttatttcatattgatgtattctttgtgattttagttcatactgatggcttataactttattttatttgtacgaagcatgtgaatcctgaggtgtttacttacatctatcagtaacaaatgt

SEQ ID NO: 4639 - DNA, 1672 bp, Zea mays
  misc_feature (1)..(100): optimal_loci_87395_G1, chr2:212795401..212797072, Cluster 28
gcggttccgacgtaaagttaccgctgtgagttaggattatgatctttacgtagccctcaagcccatataaccatatcactgaatgcataatctataacattcgagaggagcatgggccaccatcaattcgaagcagagcaatgctttaggaagaagtcaaccgcttctcagaatttgcccggacgtttcgttgaatctggacagcgttattagttcattacgccgtgagtacacggcaccattttcaatctgttccatttcctttttcaggttcaggccgcatttggcgacccaagacgatatgtctgctgtggctgtctttgtctgtcctttctatatcgccgtccggatttcggtccaaatatatcgcttgtgttagccattaacgcatgatctaaaagtcaggcaacgttcttatcgtcgtctccaggtgtcaaacttcatttatgaatccataatactaattgactagcgtcaacctgattctaaaactgttgcagctgagctgattgactcagagagaactgcaatcgtctggaattgaaggacgattcaagtccacaaataaagccagccagccagcaccagcagcagcagcaggtggtctgaaactagttccagggtgatcggcggagattttaattgggtttgcagtttcatacggctccaggaatcgactgactaacgaactgaatgaatggtcagtagaagcatttcagcgctattactgtcactcgcggagtgtgcaattcgtcagagttagttgttccttcatttgccgccgcaaggccagagcaagacagcaacagctaacgaggtcaacacaaacagcgcgctgaatgaatgacttgaccattaatgcttcaagagaatttgctgatagtgtagtttgtcaagccttttttttaatatttcgagactgaatttttcgagacaagtacttatgaacgaaacatgatatggaatggaagacatggcatagttggacttggacagcctaataagccaagaagcaggtttttaagtggttaagcatagtagaaatccaagctggagctgaagaacttgtggagaacaggctcattacgattacagcaaggcgataacgagctcactacgattacagtacagcagaaagcagtaccgttgcttcgtcatcgaggagaacaggcccaattattctgaaagcgatgagtcgtgtggtcttcgtggacctctttgtcctttgccggctgcggctcgccatcgttctcacggagaagatgctgacaggaaggatatagccgcgtaaacaaactcatcgtcaaatcaatcatcaatggcgctcaccaggtcatccaacttgccctcaactgctgcaccgattcttgtcaaatgaagatgcagggaaccaatagcaaatcgagtagtctggtaattttaactctgaatctgtggttgatagtagaactaattatacatggtgagcatctccttagaaacagcagattgcagcactgtggttgatgagtatcagtcaaccaattctactacagaagttatgtgtcggcgagaagaagtggaagttgagcactgctgcaatcactgtcagtcaaaaaaacttactcattgcggtttcggaactggacaaagaaaaaaaaaacagatacagaataaaaaaaggaaaaaagac

SEQ ID NO: 4640 - DNA, 1442 bp, Zea mays
  misc_feature (1)..(100): optimal_loci_88529_G1, chr2:219800649..219802090, Cluster 28
atcaattcgcatgagttggcatcatataagcgtggcgttttaattgtctttcacggcaagacaaatgacggcaatttggtcccttcgatctatctatatgtcgagtttcaagtgatgcaaaatagataacgtttctgtgttttagatatcatgtttagctatttgattttttttgtttctttgtgtaaataataaaataaacgtgccattgctatgatatctctattgataaaaatacgttctaaaaataaataatatttacacaagaatgttgataacctgaacagtcaaataaggtgtttgaaaataaataaataaacgccatgtattgttagacggatgtgacacatatgctatgcaaaactcgtataatgttatgtctgtagctttcattccagacgagaacagttacaaatgattcaggaacacacaaaccaaaattggcggtgttgaaggaagaatcctcgctatgcatgcgcggcagaaatgtttagtcagtagtgtggtcatcaggatgtgatttagtaagggccggtggaatagattctttgcacatcatgcatgacttgcatataaaaaaaagcacccttctccggccgcagagttcgtcgtcaaactcaaacgtaatagcatctgaaaaagtcagaagtcgtccctgcatcacggtgccggccggaacggctgctactgtacaccgcccaagcggaatcttcctctcctctgcacagcactacatagtatagatagtgcattatttacacatgattttctgaaggaaatcaactgcattgatcttcctacgaccaaacaaggagcgttggtatgaggcccatgcatgtcgactttgtttgaacgaatggaataaacgcattccttcaatataagcaaagtacgtacgtacatgtggggagaggaagaccaagtcgtttggagtatgcggctgcctcaccctctgctgcaacatggtccctgcatcttaccaaaggtagaagatagatcgattatgaagaaaccaaaggggcgagagtcagagaacctccctaatgtacaatataaggaccgaaggtatatcacaaaaggtccccaaggtacgtcgtctacgtcagaggagtagtaaccttcgagaactcttgaaagttatcggcagtcagcacgggaagcatggaaaaagtccaatatgccgagcaatactgtggacatcttgtaaatgtagagtctaacgtacggttgtaagtgtggaagttgatactatttttttcaaccttcttccactatcatatatgccttcgtaatacttgtgaaaggctactgttctcttgatccttaaagccagcatcgagggtcttggaggaagcttttgccacttcaacagtttggctctgtcatcgtaaacactctacgagatccacaagcctctatcacaaatgtacgaacacctagag

SEQ ID NO: 4641 - DNA, 2056 bp, Zea mays
  misc_feature (1)..(100): optimal_loci_92391_G1, chr3:1563312..1565367, Cluster 28
tgtgtcatgatgaggtgagcgtaacccaatcacacgaccatgagacatcagtgatgagcagccagcccactactacgtacaaggcgtacaggcagcaacgcattatattacgagtccctgccctcctgctactggctcccaaatctgaatgcatgtctaaactaatactaatacaatgccccccctgttagtttaatttgcattgggcaccacttgcattggggcattaagaaacctcctgacattgatgtggagatggccggggtggtgtcatgctagctgttggatttgtcgtttgccaagggggattacattacattacataatacaggctctcttctcctttcctgcctgccttgtactcctattgtcttggtggtcacccatcctttgtttaatctcatcagtatgtaccttcctagtctagcagttatatatatatagcctcaaccatcataatagttgggcaggtttatgcactaagcagtaagtactgtgctcattactgcacttattagctcagacgaatggacaggttcatgcatcagcagcatctgatctgggggaacaaatttgacctgctaactgtgttccataacaagacaagcggctgcaaacaccagagacgacaatcctacaatttaatgtacaaggctactcatttcatttgcctgtacaaaataatgtttcagtaacattcagcaagcaactaattaagcttatttattcattcagcttgaaggctagtttagtcggttgtttgtcatggatattgacgactcgatcggagtcttggcaaggaagatggtaccagtgtcgtctactttttctaagctttgaggcaaagcatacatcactatatatatatgcatgcaggcaggcaactactggctaacgaatagagacaggcaggcaagtaaattaataaagcttctgttgcctgtagctgtaggaaagatatatagtagctagggggggtaaggtaaggataggcaggcaacgaatatgccatgcaacttgctgttaatcttgaccggatttctttggtacgcagatcatgctccatccatccgccggtgatgatgcttctcctctcctacatacctagccgactttagacagaatgtatatcccatatggttatgatagcagagatcacattcttgatccaaagcagcagccacttactcccaactgtcaataaactagtttgtaatccgtctcgcgcgcgacagaataacatggctagctagtgtgatccatcgatcaactaagcgattctctcagcctcagcctcatccaatgacctccctctagctagctcatttgcaattcacttggcttccttccaagccttcattaattaggtgctgttgtagtacatatatactagcattaagaagaagaagaaaaaaaatgttctctgtagtggatggggacttgaaaatgcatgtaaaaagaaagagaaggagcaagcaggttgggttattaggctcctctaacctaatggagaattggatctctgacggacgaccactaatggacggatggcttcaggcctttggatgtgcgtgcgtccacctgtcgacgcgcagtgggatgctggctcatcatcatgtttatatatttcattccacaatggcggagtatatttctgcgcgccagaataaagcgaaagacagacgccttttatttatttacttccttgcgccttcaattcattcgcctctgtttctgctaatatattttatgtctttccattgattcctctctctctctttttttgccttccattcagctcaagtttatttatcatatcgtcagtagagaagtgtagaccccctcacaggcggcctcagcagtggatgctgataagcatggactgggccaaggaaaacaccattggctgcagctgcagtccctgcaccaaaacgaccttcctctatggacacctttttcttctgctataaactaactgccaagaatataatctgaatgttggatccagcaatgtgtgcacataaacacacagtcattgatcggtcccggctcctac

SEQ ID NO: 4642 - DNA, 2096 bp, Zea mays
  misc_feature (1)..(100): optimal_loci_94104_G1, chr3:10077794..10079889, Cluster 28
ttcgaccacttctataaaaaaagatattaacatatattttgtatcaaatgagtataactggatcagttataagatatatttttttataataaatctatataaagatataaatattgatattctcttctgtaaaatggatcaaactttttttaaaaaaaaggtatgactaagcttgaacctaaaattgtaacgattcgaggagttagttgattctaactctgatcatcagtagataaaacacatcaacatattttatatcaaacaaataacattagattaattataaaattatatatttttatagtaaatttatttagaaacatgaatatttttttgtaaaatagtttaagctaaagaaaatttgatttatcttaaacctattttttcggataaaagagtatgtattacattggactattgtagactacactggactattgtagcatgtgcttcatgagtttacggccttggggcaaacaaaagttcagaaaacgacttcgtagctactcaaaccacagtctgacaatgaactgaaatgatttggtattgggatgtcaagcgaagacgaagccatcattcgcctattcgcctttagaagaacgaagagtgcaccatcggtttctcaactatagaacacttacttctagagaagccttctatttatttattaaaaaaccttctacttctaatgtgcataataaaaaatggttaaaaaacatatcatcgaagataagagttggtcaaacttttaaaactattgtctatacacattgtaacttctgaaatatgtagttcaaaaaatatgcaagatttacatataaattgaattgaaaaatgcttgcatatattgtatcaaaaaattataatattttaagaatatgttatagaagatattaatagtcaagatatacattggaatattgtatatattaatttgtggcaagtattttttttatcatatacctttgtgaggaaatagaagtgatgaactacttttgttattttagtttgagaaattggaggctagggggggggggcaagaggtttgtttgttatctatcaccttcttacacattgcattgttgttttgcttaaggggatataatgtgttgatccatcaccatctcatgatatgtattcattactaacacaagtacatgaggatatagtcgtcacaatagcattgatagatgaaattataatgggcgaccccactaagataagtattacttaaactagcaccaaatttgttttcatgaatgcacttagatgctccaaataaaataaaagtataataatttccaatgcatgagctacaattataacacaataaatatcaccatcaatgatataacttgaaatttcatgttactatgttgatgtttaagatttgctactagacctttagtcagaggttgaaactaccctaaagattagttatacacatatctcatgtagaagtcgaaatgaaattccttttttaaaaaaactaaacctttagctcgtatgttgatgttaaactcaaacatcaccttatgtaaaataggtgactgatccaatataaaatgagtggagcctagtcgaagacaatcaagtttcttgtgcaaatgttcatttgagtttaaaacttctgtttagatgggtgctcatattttagctaactagcatgacccttatttagaaggtgaaagaaactaaacactaagtcgtcatgttggtacatttgcaatgttcgtagctttgtagtggttagagcacctccaaagatcaagctatcttaacaacttatatcttgcctacatcatctaaaagataacacgtcgcccagctattctaactatactacctagtccctaaattacatgaaccaaggacaataatgaatccaatgtattcattttaccaacccacttccttctcgatctcgcctaatccaaagatagtaatagccctactcgcatcgtactaccaccaccgttggccctattgtctagtaagttaccacaacaagctactacaacccaccactgttatggatgctattgcagatggagcttgcgccgaccatcgttgtgactcgctttggatgctaccca

SEQ ID NO: 4643 - DNA, 2260 bp, Zea mays
  misc_feature (1)..(100): optimal_loci_94402_G1, chr3:11626065..11628324, Cluster 28
aaggtccgtttgtttgagctttctaaagtagattcgatgaaaaaaaaacagaagtctcaactaaatgggtataatagtagaatacttttttaagaaataaacacatttctccggttcaatttagagtcactctgtacctcatattttttagattcctgccatccatcatgctcttacaaaatctacaattgagagttgtttcaattaaatatattttagtttctcgcaaatgtcagctcgcactcattttctcatagctcataatagaccctaaagaaacatgtgttaactcttttcgctcaagttgatagagtggtgattgggttccacttgcacatcttttgtaccccttccatgaaggaaacgtttggcacttatacctcatcatatcggtggtaacagattattctgtttttactcttttctaagggaaacatactatttagtatagtttatctactgagggaaatggtgatggaagcttttattttgcctacttttgttactagaataaaattggtccagtttatgagaaaaactagacccagattcatacaactagtaaggatatgtcatatttctctagacaacttggatgaaacaacaaacaaaggtaactccaattcttatggaaagaaactaggggaagaaacttcataagcactgcttcatgaaaacaatttgaataggataaaccaggcaagagaaaactttagtagaggttcctcaattcgatctgttaaactgaacaactagtggatcaaagatgaccccgcaccaaaacatgctcatgaaaacaaaaatgacggcatatgaaacaaccccaaaaaatgatacaacaatagaataacaacccataacttagtcatcattgcctaacttgttgcaagcatctcacttctagccaaagtgcgacactagacaactgtcttgtgaggaacccgactcataagatctagaatttccaagccaatgaaggaacccgactcaaagaacattcaaccatatcatagatttttgtaaacaaatggcaataaaaagaactaatgatatttctaaaacattgtagtgataagttgtatggcaagttaaaaggactaacacagaccccataattcttcaattgagagactcttcgactagttaaaaatattgaaataagattcatattttaacattctctctattcattttgagtttatgaatgtggtaatatcaagaaggatcaatagtaagtgtgttgtgggtatccatgtgaccaaggacatcaaacataaccgtagaaatcacaggagagaatctaagttctatcccttcatgtgctaaaatttaagcccgaagttacgtgggaatttctagcaatggttcttttgttgtatttatttttgtggttattccaacgtatttcttttagtgttcattatgtagaattagtgacaactttctaggttttggaaattctgagtctagtcaatttttttgagatataactacacattcacaataaaaattagttgtggatgggtaggatgtatataccccaacatcatctatcatctttccctcttgaccaaacttaggacaacaaccataactctcatatgttcaccctctcaactctctatcttttgatttaatattcttgagtgagatctagtcaaaacttgtgattatctccaagagcctaattccattcttgagcatgcccaacattggtcatttggtctttgatttgttactcttgagttctttgaatcctagatggctaggaatcacactgaatggatctagaaggcttgagggggtgaattgattacaaaaaaatctctataaaccacaacactagagaaaaatattgattggtacaataaaaagctctactagaaactactttgcactagatgtaattcagtcaatacaaggccctacacaattctactagcttggtttctaatttagagaacacaccacacaagctaaactaagaagggctacattagagagttgataaaagcgagtaactaaagctagctactactacaactaacctactctagctcaaggaaataactacgcacacaagcaagtaagttcaaagtaaaaaaatatatatctatgtagaaggcaaaccacctaggacaagtggtgacacaagatatatcctcgaggtttagttagttgtcgacaatctatgtcattattgtggtgagtcccaaaatggtggttcataagctaactagcatgaaaagtgaagggacca

SEQ ID NO: 4644 - DNA, 1431 bp, Zea mays
  misc_feature (1)..(100): optimal_loci_9680_G1, chr1:51393269..51394699, Cluster 28
gtataaaagccatcatttgagtggccaggcttttataccctgttgtggacgcaactgagtggcacgatctaggttagattatgtatggccatatggctcgtgctcgcaacaattacaacacgttttttttttgaagcaacagagaagatatttatttccccctttttaaatcgagtaattgctaactacaggaattaagaggtgaccacagaacatggccacttaaccagcaggggtcagtgggaatggaaactcttgttcattagctagagaagaggcaaggctacagacctgttgagctccggaacagttgacttgtttgacgcatgcagactagactaaagcaagcggttaagataaccgaatcttacaaccgcgtatgctcctacgtcacagtaatctctccgtactgaaagcaccgagcaccgtcaaagtcctgacaagactgaactccgtcgaagtcctcacaagtagtaatcttgtcagtggagtgtcctgcgcaattaaacgcctagctactgtgtcattcaattcccgtggaatatatcgcgccgtttcacactttcactcatgatttgtccagctattaaatcaattgatttcgtcacgtttttttacttgctagaagtagctgcgctcttgaactcctgatccacaaagagaacaacaatgactacagttttgagagagagagataggaaccgttcattaaccaatggttgattagtagttttggcaaaaggggaggggcgtcaacatatgcatttagctggtcacaacagtgcacatcgtttgagttcagagtttggttgacagaagaagtgaaatctatatcaattgcatcataggtagagtactttagctaggaagctccagagaagccatggacttgtgcttgaagtgcctcatgccacttggagtaaactctaggccgggtgtctacccttgaatagcacatgccatgcacacattaatctgcatagtagattaattagtttgcctcggcgacaggaactaatcattgcctaaaaatgggcaagaaagtagtaaacaaaggcgaagtagtacatgcacaactatgaaacaagacaagagcagttgtggactcgatcagtaatggacatcataagcactgagttgtggcctcatcagacttagcagttagcactgtgaatcactcacaagtgtctatagtaaaaaaaacaacatgttcaaggaaaacaaaaaaaactagcaaagcagattggtaacaaccaaagccaaactacaattagtctaatcacattgcaaagaactagaagagaaatacagccaagctagctagaagtttggagaagagccaaactgttgtgacgacgaccacaaagctacaaaagaatatggcaatacaaattatggagccacctcatcatacttcacctttccatcaca

SEQ ID NO: 4645 - DNA, 1681 bp, Zea mays
  misc_feature (1)..(100): optimal_loci_97648_G1, chr3:29610313..29611993, Cluster 28
tacagtttccctcgtgaatcgtcatgcacggttgagacggaacggacacagtgcgctggccgcctggcgcctgtcccgttccatttttgtcgctatcacaatcaagcttccgttacgatgtgggcctccaagctgggctgcacgtgggcacgtggttgggccaaataggcttgcactctagttgggttgcatatggttagcccgactaggctcccacttgatccagtgtcaagtttaaaattttcttttcaaatctttttataagggatccaggtttcgctttccctacttctcctatatttcaggtcattagttttttaattgatttcatgcaatattcctatacgaatcaataagtataagtaactattgcttttatgattatgatttatctttgtattatgataaattattattttttctttctccaactatagagataattgttaattctctttgcgccaatacgaataagattttgttgagtttgtaattttgtctaatagatatttttgttaacgaaaccgaaaattatagattatgcctacgtaaactggatctgcagaatatatacaactactatcatcgctcgaaaataaaactcaaactcaaacaccgaaaatttaacaaatctctttgtctggtggccttccgtacttttaacaaagtgcatccatgtctttcaccttttggacctcagagttttttcttcttctaacgaacagcagtaggtcagacctgaggtcagagtcaaccacacgtttttttccctactagacagaaaacacatctcgttttcgtgatcgtggccgtacagtagcatagcagaacaaagcggttcattatattccatgtctctatcctcctcccgaatgaaagaacaaattaaaaatcgttttaaagaagcgagcaaactaaactcgtgtaaagtagacttttagcgggccacgcgtccgcataacaataatcaataaattaagtttacaaagtcccaaataggacaatagtttcctccctttcgaaaagatagaaaaaaacgtgaacaagcgaaactcgactaattgtttccatcttttattgacgctgctatgtatataagccgtacgtagatattgttgtttattggcacctcatgcacgtgggtattatatatatatatattatgcacaaaacgcaggatatacagatgcagtatggacttaattgattatccactttattttatcctgaattatcgcgtgcgttgactttgattgagtatatgtttagttacaaacacacgatgaatctagactaaataagcggatacaaaataagttattttaaaattatttacctatatctacacataccacaaaaatgaccgtatctagttaggctcgtgtcggactaggtgtatcagcgcaatgcgcaacaaaccaatcaagcgctatatggtgggtttgggtccttgtggcacgctggcagctgataaggtgtttcttgctggagcacggcggcgactctaatgtgatccgagtccgccgtccggccgccagataatggacgtatactgctgcgcgaagacgaccaaggtaaacaccacgtggttcgatgagtgtgtatgcatttggaaacgttggtgaaagtgaaaacgtgaaagcactgctcgcgtcatatactcatatgtgacgatggacgg

SEQ ID NO: 4646 - DNA, 1173 bp, Zea mays
  misc_feature (1)..(100): optimal_loci_244324_G1, chr7:40299412..40300584, Cluster 29
atgcaaagtgtgcggctgctacgccctaattgtaaatttatccctggtttaggaaacgttgatgcccacaaaactaagtgagtgggcagtttatcggttaccatcacttatcagctgccgacaaaaacagaagaggttgcggagtaacgatttccaagagctacttggaccggcctctaccttttcggttgagatgtctaacgccaaaacaaaagaaatattattatctttttaagatgatggttgggtacctttcgttctttctaagacgatggttgggcggcgcctcgtcaaaaaaaaaaattgtttttttgaggaaatttgtgctactgtaccgacaagtgcgtcaagtttccgggtatcgtgaaagggcatgcatggttggtccgagctgtctcacgtgggtttgtgctgttcttgccaagttgccaattgccacgtacggctgtcagatgctgcagctacttcatgtatctccgtatatttagaagccagctagttgtagtttagctaacctaataagattcatctggaggcggtcctaatactacacattaattatagtaatagcgactatgttgagtaccaatcgatcggtatcggttctaataattaagatgacagttggttcatgagttgctgcaaatcaaatgccttccattctctatagtacactaaaatctggatttgatgatgtacatagatgatacctgcgaagtcactgacagtcggtcaaactcacctcaaacaggctttattagcatgagcttatttgctacacctcagtttcactggtgaagcagttctttctttggtttcgtaaaacagtttgacaagctaaaatcgttttaaaaacgtttggtaataaacatagcagtaagaaaactgaaaaaagctagcatttctagcttcacctaataaactgtgtgtgtatatgtgaaaaagctgaaaacaatttggggctgttgcaaggttgccactgctcggcgatacgattttgtttttaaacttttatttcttaaagtttgcatgtatgctcttttttttaaaaagaatggacacatagtttgcccctattctagtatcagcactaaacaacgttaacttagtccgcaaaaaaaaacgttcatatcgttgtaccattacccctccttttataagtatttaaaaatt

SEQ ID NO: 4647 - DNA, 1291 bp, Zea mays
  misc_feature (1)..(100): optimal_loci_101090_G1, chr3:49544684..49545974, Cluster 29
tttataaggaccttattacctttgagttcttgttggataactataagacaaaggaaatgtaaagacacactagaatctagaaataaggagtgatagttgacttactcttctttgccaaggcagtgtccttagctttattgccaaaatttgatttcttagccagaactttttctgtggctctatcttgatctacactattcttttaagcagtcaaacatttctccatattagcaccctttgtcttctaatattactttgaagaccctagagtaccttaggcatgatgccactagcttttgaaagctatacacaaaagtcagatatttgaaacataagagactcaaaatcaactagaggacttggctacataccttccaactcgaccgaattagcctcaagccgatctcgtaaggactcgattgtttatttgctcagagttgtacttcttatcttgttcaaggttgagcctagtggactcacctgtttgcaatttcttctaagttagcatttgaagaagggactcctcttctaactcatttaggatctcctaaaggcaatattatcaaaggcagagtttcacaagataagtggagacatactaacatacttgctacaatcgagggaactcggccacatattgagaggctttttgaagctgacgtaggtctccagctaaatcaatatttcccatcatgtgcttctagaacttctaagagagctaattttgagctatctctaagatgagttccctaatgtcttgatggccttctttaattattggtctataaaattcacattggtcatgaattacgcaagaaagaaattcaagatgttgattgaaagagacaattaccaatggcttgttttgttagggttttttcctgtacttgatggggcaacaatagtttatgcacctggtattgcttgtttaggattgtcttcacatagcgttgtaggcttaggatgttttcttcagggaccaagtccttaggggctccgatggacatggcaccagttggcacactagtgaccaaatacttctcttataggacaaaacatatgttatcctttggcaattctgttgctttgctaacaagatcaagaattacatcacactcttcttatgaaaggaatattggataaaaagaagatgtaccttgttgatcacttgagtctttctcaggtttagaactagcgattgagtcatcaagagttttgtcccagtgatagagctatagaaaggtcatcattatcgttgttgtcagcgtagtctactctgagttgtcccctt

SEQ ID NO: 4648 - DNA, 1260 bp, Zea mays
  misc_feature (1)..(100): optimal_loci_114499_G1, chr3:139156010..139157269, Cluster 29
ttgctactccatgattcgtgaacctgttcatgtgtacgatgatgagccgtgaaatactactcctagtttggattatttcgtctcattgtctcggcattatgataaaaacaaaataataaaataaattcaaacacgaataaaactaggcctgcaactgcgaggcgtgttatatttcagcttgcaagatgtatctataatatgccaatcatattttatttaaatagacagacggacatgtttggttcgtggctcctgtcatggtgatccactgtgcctctttcagatcccgtgagatttttctttgatcatatatcctgaggtggtggttagctgaagattacggttatcatcaacacctcttgatgtttacttccatgagattttcttaatatcatttctttctctgtttctcacgtgagatttgatttctagtctctgtgataatcgatcagggggatcatcgcatcctggctgtacatcttgctggcacataaaactaagcctgcaagacgtgttatcttgctccagcttgcgatatgtatccgcaatattgccagccaattatatttgttgtatttaaatacaaggtattcttgtaaagatacaaagacaaagcaaaaataatcaatagacgtcagacgttataagcatcttttttttggtacctaggcaagcacatatacatgaccacgtctaacttaacatccactccgatttatacgtgcatatctgtgccactcgatttatacgtgcatatttttgtatgtgccatgtagacctgctcaaacattgggttagatcaagatcgggtcgtgatagtttcgtacggctcacggttgacccgtgtttagtgtcgggtcggattggccgtaccaccctgttggacatgtcgagacagggttttttttggttgggtcagattttttcggattgagtcaggttttgggttaaaaactatggcatgtgtccgacccgtgaattattgctggtcagaaattacggtctctacctgtccgttgtattgatcgggttgggtcggattggattgatcaaatcggacgaccatatgctcgggatcctgctaggtcttccaccttatatcttcataaaccttatcaacaaagcaatgcaaccataagttaaaagtgaactcagctgattagatttttttggaatctatccatctaactttaaattctcaatgttggtcacctatctggttctctgtaggagaccaaaacaacacaacacaattaagcc

SEQ ID NO: 4649 - DNA, 1034 bp, Zea mays
  misc_feature (1)..(100): optimal_loci_114666_G1, chr3:140143407..140144440, Cluster 29
cattttttatcacagattttttttattaattctaatttttgagatctagtgttttctctcttgattctacttaccggctattataacagtaatatatatgaacaatttcaatcagtcaaaggcgcatgaaaatgacgtattgcttatagaaattaaatattaattatttgtctgtctctaactcctgcagattaaacaaagagaactaactaattgccatggacaacacacaaaatcatagctaattaatttctatcagctacattcagcccatggaaataagtcggacaaatatattttttccacatcacaattaaactcatatccatccatatcacatacattcacacatatcaatccacatcacaaatcattcataccatattttgaattcataagaaaacttcaagtagcattagtttttcaagtctaaaccgtctcaaataacataataagtaccaataactagcatcaagtcggttttgtcagatttttaaagttctcattgctacctagagtcctgttgaaacaactgtttaacaagtgctactaattatggaggagtctgaaaactatgcaaattacaattacctaaagttgaactataatgggtactattagagtacaacttaattgactatttttgctagaatttaagctaatctgcctaattttgtaaaattaaccaagttcatatataattgagctaagttggctaattttttgtttgctaaaattaagctagattagttacttttttattagatttgaggtaagtttgctaaagatacgatttctagatgtccaagcattggtggagaaccctattgtggtagtggcgtggttgtggcatgtggaatacaggaaaagtgatgtttatccctaggcgatgcaacactgtgtgtgaacgaaatagataaaacaccattagctatattgaatgctaaaaatgatagttgaagatcagtcaaacttggtttaaacgtcacctctactgttgtgttatgtagttggaaaatacttgccgcactgca

SEQ ID NO: 4650 - DNA, 1244 bp, Zea mays
  misc_feature (1)..(100): optimal_loci_11552_G1, chr1:62898778..62900021, Cluster 29
atgaaacttctagttcatcatttaggtaaaattggagcactcctagtatatttcatagagttcttgcatcttttgacactagatgagtgtcttggactagttatactcccattactcttggtgaatattgccacctagatgcatagagactagagtttatataatcattgagtggatattgaagattgttgttgtctccatcattgttgtgaggggctcttgtgctcattctccatgtgacattcgcgaagagcaactatagtggaatcatgacatgttagagtgcctccgtagagtgattcttaaggtgtccttattacaagcatgttgtgtgatgccaattagcacacaaatcatctagcttagactttccataacaaggatacacggtaagcaaccgaaacttgaggattaatattctctcatctcttgcctcatgtggtttgcacttcatactatttttgaaattacttttactatttgtattatattagtctatctagtctcgtattctttataatgaagtttcatctcttgttgagtgagtagcttggctagttctatacaataccattttatagctactagtttcatcagaagatagtttaaagtaaattagcattggagcaactaagatgttttcatatattcaaaccttgactctagttataactatgatttatgtagaataagtttataagctattcaccctcctctagccatcttctggtggcgtactccggtgcattctaaaccatgtttctttgcatattttaagcttctttcactttgatgtcttaaacttcttgcttgtcgtctagggtatcaaagcaactccttggtccctagggttttgatcacatgattatcatcgtggcctaacctaagcatatcctcatatccaaaagacaaaaaccttgtatacccatgcacaacattagtccacataatcattctatcactaaatcaacaaaagcacttaatggctctaactaggtgttatttattgtatcgatactccaaaactgttgtagaccatcagaggagacaaggataagtagtagcttaagaagtagacaaaatgcatttaaagtctaaaacttcttgtaaaaagtatacaaaataaactaacacaccaacacaatattttcatattctatatttattaatgctaaaatagtaaccatttgataatttacagaaaataagtacaaccatccttcatagtgtgatcgtgtcttttc

SEQ ID NO: 4651 - DNA, 1020 bp, Zea mays
  misc_feature (1)..(100): optimal_loci_116936_G1, chr3:154555229..154556248, Cluster 29
gatgtgtccaacagtctatgtaaatagatcaaagagtttcaaagtatgttgaactagtttgtcaatgaccattggaccatacgatgtaactgtagcagatatggttctccctacaaggtcattaccagtggcgtcattagaccaatgagtaatggttcaaccacctctattaagtgagcatagaggtttttttcgagcgtcagactacggggggcgtcaaaccatgtactcggtgtagttactcaaacaactagttctgaattctgacataggaagtacacaattacaattgtgtctctatatacactagcatataggtcgtgctaatgctatgatcttagggagaggaggagagtgtcgcggggggagggttgagagatgaggaataattcaaaataatattatatattagatttgagtgggtaacggagatgaagttattcagtgctctgaaccgtttattttgatgatgcattaagtttgagtgtaattcgtttggtgaattagtgaagattatgggtgtgagagtaatttgattcggtgaattttgcaacgtttaaattgctagattatatggtggtatggataataccgtgaaatttattagacggagcgaaaaagaaaacaagagtaaatcttttttttaaagaaaaacggaccgtaaaccctaacaactagggaagtttgctacttcagaatgaaaattgttctccattcagaagcactagttctcccttgttatttgcatcgtggtacagtcggcagcaacgatggggacagctgagtaccacatgcgtgcatagcgatcactgagaatagttgagaagaaacaagcgatgcaggagccaatgatttgtgctcaaagtacaaatgacaagaaaaaagaatggacatttctgaaaccacaacagcaagatctaggactactactgtcctttcttttcctgagacaggaaaacaaatctaatgccacactagtgatctcttgatgattattggcatggaccccgcgatcccaaa

SEQ ID NO: 4652 - DNA, 1103 bp, Zea mays
  misc_feature (1)..(100): optimal_loci_119517_G1, chr3:170452128..170453230, Cluster 29
  modified_base (316)..(316): a, c, g, or t
  misc_feature (316)..(415): n is a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
taggctcttttttttcatcgtggcgacgttgtttcaacgacatgttgaagctgcaaatgctgagatttaacctacctctaaagctgcgcttttgcttggctagactctcgatagcttcttatctcgacttcttgttccgctgaatctaatgcacttcaaagttcatgaaatccacactgtaggctgcattcctggagcttgttgctatacaagctggactgacaagcccttgccgtccagctacactattcgctacttactaactgagcaatcatgaacttatttttcagttccgtgtgcattctacgagcaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtttttgggttctatcgagaatcagcttgattcgtatattataagatatatttgccatggtaccttgagtagggaacgaagtatactactgctgtataagcaagcaaatacatgatagtgtgtgattagtgaggctaagctacgaagcttcccggatgcagtgtagtgatgtacaatgctagctcgggcgcgtcttgttcaaactgctacgtgtacgtgacatacttactgactgtgtatttttgctcttgtttccaatcttcgcaactaccagcaactgcaaaaaaaaaagtaccgtactaggagtactagctaactgtccactccacaaacgaccgaacaaaaggcctctgcaagtttctaattcacggggatggtttcagtcctctgctccgaagctggggggatggattcctggtaggcgtcgaagctcctaaagtactgggacgctgcacgcggttttagttctggtgttctgctcctgtcatcctgtgattcagacccctctacatcctaatgcggattaggtcaggggcttcgggacggagaggagaggcgatgggagggcggataagagtagtagaacccaatttgaagtacgcaaacatatggaccccattcttgaccggtgggaaaagcacggcccaacaacccacccatccccatccatgctgcacacgcgcccc

SEQ ID NO: 4653 - DNA, 1251 bp, Zea mays
  misc_feature (1)..(100): optimal_loci_120292_G1, chr3:175543055..175544305, Cluster 29
caaaagttttatgttgcttgtctatttcatcacaaattgaacaatgacaattaaaggttaggtttcattgttgttgatcagtttttgcagacgcataaaactatttatcgagacgagcaacatgtccacctcaaatccttcacctttgttaataacaattttcgaagaccaacactatgcaagtctttaaaaataaaacacaaaaaataaaaaaaaaacatttgtgagcccaaacctactagtgacatcgctaatgaacccatcggatccattgctgccctcaccaaatatattgacaacatcgcttgattcattatcgccggtgccctccatgaacaccacaacgtggaggatcccactaccatcttcaccctctaggatcccaaatagctgccataagggaggccatgacccatggcaaggatactgtcgtactatcgcttggaaggagttgcgaggctaccctatcgttgtctccatgtgagaataagggatgcaagttactagagtggaaacccaataaggtatgatggaccacgatttccatggatctgactagtccaggacttattaacagatacacgtttcttaagaggttcatatatgttctatttttatagacaaacattttaagaggcatgtttttctaattcgattcaacaatatggcatctttttggtgcattcgtaaaaaatgatcgcctccttaaatcatctgatattttggcaaacacaattctctccttctgtaatttaattccgcaagataggcatctttttgtctatatcagaaaaaataggtcatctcctaaaatgattctttggtagtgtttgacaatatctcttgaatcatgtaccaaaattacaatcagtttgtattataatatttttccaacaaaacatgatttaggttagatatatttcgtaggaattgctaaacttcaggcgtctaaattttagttttctttaagcaatgattattgcatatgtttgtattgaaattgtagaattaatttgttttggtatgccaatctataacgttcactttcaagaacaaaaaactcattaaaaaccacaaaacttataaaatatgatttatgttgacacaaagataatataaatttataattgtttatatggtcagataaggataaaaaatgggtaataaattacacatgataatatacttaccctaattaatgatataatggcgttgtctagaatatacaaaaagtgacattttattgagaaa

SEQ ID NO: 4654 - DNA, 1043 bp, Zea mays
  misc_feature (1)..(100): optimal_loci_120787_G1, chr3:178302126..178303168, Cluster 29
cattctgaagcgtcgatcattagggtttatggcccctattcgtgaggacccaagggtccgcacatgtcagaatgcttagcaaagataatccttaaggacttcatacatggcaaacatgactgtatatctagggccatgaggatcatatggatattgggccccattgtgaaccatatgaagccaaaacatgtactccaccttaagtgtggcatgaagatgtgtagaaatacaatactaggtcagctaggtatatgatacaatgtatataaggtgtaacatatgatgtagatgatgtgtgagggcgtgtagggatgctcctaagacaacaatgcaattgagagcactaggagtaggtacactaagattgcatggccttagtaatatgcgaataacacaagattggtctgaaaagaaaaaggaaaggcacaagtataagcaacatggtcataacagagaagcccatgacaaagtgcaccaatcgaggaaggggtatggtctcgatagtgctagggatggccacaggaggccacattaaatacatcaatacacatactccaccacctgcacaacacgatacccatagcattatgcacaaatatagtataatgcttcgtggcataggaacaagcgtaatacgatatgcaaggaaagtctacatcaacaagactaaacaactcgaacaaaatgatatggagaaaagtatgaagaacattaaataagaagtgatagaccagtatgatgtcagaagacccatctccgaaaatgcatcagacatgtctgctagcataagcagagtagttgggtcaagctcatagagaaatatgtatgtaatgcgtccaccccttgaactataaaagagatgttagagcacacatttattcatgcacatagccaatctttagagaagatacttcaaagcaagatctatacctaaggctagagtagagttagcttgtcgaagttcccagtttctcatgagcaaaccatcaacctcacaactgagcattgtaacagtctaaactccgaagttttagaaacccgat

SEQ ID NO: 4655 - DNA, 1239 bp, Zea mays
  misc_feature (1)..(100): optimal_loci_121306_G1, chr3:181073724..181074962, Cluster 29
gatggttactcttgccacccgcttttgcaattaattgataccaccatattgacgatagcacatatataatttgactccatctttaagatgtcgtacaatatatttaaatggacatgacggtgcgataaacttgtagatctatttaaatggtagaaatttttttagtctcatgtctagctgtgatactagacctctcccaccaattttggctcttgcagtgctgtagcgatattgtagttggagcagtgagagagaaaaaaaaaaaaactagcttaaccgactgtgtgaaaaaaaagagaaaaaaataaaactactgaaaagcagctatatatcactaaaaatcggaaacctctcccaagtgaccctaacattaactagcaagcgacaacgcgacaagcaaattcgaagcgaccatttcatgacgtgacacgcgccttgccgagtacggtgtacacacatcatctttgtgcgcttggaattgaacacgtcgccatccaatccaagttgccatgtttgccatcacgtgaccagttaatccaccgctaatcgagatggtaaacaaacacgtccttggaatctttaggaggccactaatgtaacccgaagtggcataagttaattgtattattgctcgctagctgctagctgcctagctcaaggcccaccgctgccgttttttttttctctcccctaccaactgccatgatgataagagaggagggcgataggttgctttagctttcctctgcttgataaataaaccagtaacgtgcagcgctggctaaacaagataagaggagggccataccgggggcaagtcaaagctgaacccggccacattgtttacaagttttgtgtatccatgggcgtacatgtttgaccttgttgatagatctcgcatcccaacaatcgaacaataggggagcatatatagtattgtttccttttctttgttctgttttttgaacgcaaaacccttttctttgtttgaaagactgtctatatatgttgtatagttttatgactgtgaatcattacttagatgtaagtccaggagctatagtactgctagcttgtttgaatcagctatagaatgtattttatgaagacaaactaaaaattatgtcgctctcgtccgaatagtccatgttattatgcaactaataataacccaacggcataactagatattgtaatctcataagctagcttcctgcagttattttcatactatgtccg

SEQ ID NO: 4656 - DNA, 1377 bp, Zea mays
  misc_feature (1)..(100): optimal_loci_125141_G1, chr3:201559653..201561029, Cluster 29
ggaggaacagacaagcgcagggaagccaaatggccatctgaggcatcgcgcacgaatattccaagcttgtcgttttgtaacgggaataaaaaggtccaggctacaggccgacggattattcaatggtttagatatataggccaacgttttggttatctatgcgcccagcccaactgagtaagcgacaaaacagcatcggactgagcagcatgacatgatattcctcgtccttcccctcgcctgagtggtggttggttgcgagctgtgacacgataacgccagccgccagatgggacatgacgagcattttggaaggagaagatgtcaatcgcattactccggatctaagaccaaaattgagtgagggcttataagcattttttttgtctaatccgcgagtggtgaatccagaaatggttcaagaaaaaaaaagagctaaataagactcgaaatcgtaatagctatgtaagttctgtttgagagagcttcattttaaaaatttctctattttaatttgttctatccaaataatttcagctccaagagctctagcttaaaaaattgaaactaaagactaattttataaaattttcgaagctccttaaaaggtgcttcaaaattattgttttcgtacctccttgtgaagttgcaccaaccaccgtgttattagttacatgacctatccatctctttctccacccgctaatcatcaatgataattaagaaaactcatataaattaaatgtattatagaaactaaagtttatgtggaagccaaataattttgaacctgccttgtcaatctgttgaatctgtgctgctgccctcctgcgagatcggcggtgcggcggtttcgaagtcgccgtcacggcctcgcggtcgcggggacgggctgcaacgactcgcgagtcgcgatagcaggaggctctgctcgtggtgggctgcggcagacggcaggggctcgtgctagagttcaccaggaatcatgggctgggctgaaagatctgctccttaagaataaagcccacgcgacggggaagggctgcagccccctggatccggctgtgcaaaacggcataattccccttgtattgcaaactttggtgaaaatgtccagctgagcatgactgcatgagtgtactaaattttagtcactcaatttattccattttcgtccataaattgctaaatatagagactaaaactctatttgggtttccatatttagcaatttatgagctaaaatagaataaaatagaggggctaaaattatttcattcaaaccaaacactccctaaggctatcttcaataagtacttatatttaaactccaaagtctcaaaaatatatgttttgtgtaatttactggagacggac

SEQ ID NO: 4657 - DNA, 1339 bp, Zea mays
  misc_feature (1)..(100): optimal_loci_125555_G1, chr3:203488520..203489858, Cluster 29
aacagtctaacagttaggagaacgaatgggcaggtcatatgacagatcggcataatttttgggtttcagtagggctctagggtatgttatgttctaagctggcaagttcaattgattcgagttaaaagccattttattttagttgtatgtagaccacatgaattaccaaaaaggttcaaagaataaggcagtgagttcactggaacgggtggaacttaaaatcctggttaatcactttttgtttaagattatttcttcatacatttgagtcacaaaagattttatcttagtttcatataaaattgtatgttaattttatatactcattgctctcattccgtaaaatatgttctgagcaacagataggaagaactaaggtattcctgagggctggtcaaatggctgatctggatgccagaagaacagagatgcgaaacaatgcagcaaaaggcgttcagagtcaattccgtactcatgttgctcgtgagcagttcctagtactacgggacacatctatttatttgcaatctttcgttagaggtaaactctttccgtatagccctgggtgtaaaatgcatgcttatggagtcatagtggagccttgtacatatactaagatctttattttcaattacagccagattggcatgtaagcaacatgaattcctgagacaacaagcagcagctttgagaattcagaaaaatgcacgatggtattttgcctggaaaacttattaccaactacgattgtcagccattacattgcaggccgggctaaggtccatggcagctcgtaatgagttcacctttagaaagaaaaataaagcttcagtccatatccaggtaggttagcacttatagcaattcactgctattttcacttattatactgcagatggatattaatctcctgtcagaagtcgctattatgtgttctcaattttttttattctgtttgaaccatcaatatgagattcctttcctgcagtcccagtggcgatgccaccgagattactcaaattatatgaatttgaagagagccgcactaacatatcagtgtgcttggcgaagaagggttgctaggaaggagctgaggaagctcaaactggtacttgaccaactattatagtattcattctgtaaaatttcttctaagtttgttatgggatgcatgctttttaggctgcaagagatacacaggctctaaaggtggccaaagagaaacttgaggaacgtgtggaagagctaacaagtcgcctggaccgcgaaaagaaactaagggtcaatacttggtcttgaacaatatttaaatacttgttatgtgtgcctattcttttaa

SEQ ID NO: 4658 - DNA, 1044 bp, Zea mays
  misc_feature (1)..(100): optimal_loci_126831_G1, chr3:209536268..209537311, Cluster 29
aattctaattgaaggaatacttgaacaaccatgtatggaattcgtatggggccaagtagcagtaaccttttggtacttgtttacttcttatgttttcattgcatacctcactgtgttttttgtggcatgaaactatttttggttttatttgtaggggacaattctaatttagatgggaggctaaaatattcaagttgtctactaggatgtagtgacactagttgtgaatgaagggttctatgtatgctgatagtagggtatgtttactcggtggaacaatagtatttgtattaggtgattgaatactttgttcttttggttaaacaaattacctattgttaaagacaattattgtttcatgtcatattatgtgtcctaaaacttacatccatagagtatgcatccaaacatcgatgcttactagactactatgtttgagcgaagcaacaaacatgaggtatgtattattgtagaacaaatggggtattataaatttagaactcaaattgatctcatagaaaaaaattcagtacacaatgacattgatacaataatatttaaagaaatggttcgacaacaagtacttgaaaagtctaataatgcatacacataggccctgatacattggtaaacaatcaagatgcccctccacttgatcctcctgcactcagacttgaagttgcaatcttcttatgcttgttgatgtagtactccctacccatggtggcatttttttgacatccattgtcatgccctctcctcaggttcctccttttgaagcttgagcattctttgatggatctcaagatttgtcttctacatacatatcacttcttgtagggctagattttagtctgaccttgttgtcatgatgcttggttcctcctgcttgttgcttcctgcctctcttcataatctctatgctatgttaatgtcttttgcagcacctcaatgcacgtagttgaagatgacaagttgttgttgcacatatgcttctttgcacgttatcttcccatcgtgcgtgcaattttgggggagtagctc

SEQ ID NO: 4659 - DNA, 1362 bp, Zea mays
  misc_feature (1)..(100): optimal_loci_127732_G1, chr3:214191122..214192483, Cluster 29
agcacgctagccatgtcttctatcaggctgagtcctcccctggccctcgtgaagccaagaggtaagtggcctttgatatttgattgctttatctaatcatttcaaaattcctattgctctgattcatcaatcattacttgcactctagaccccttattgaaaagtccttcctgactgtaaggccccagtgtccgatgaggactattgggccattgcgatctcatacggggattacttgtcgatattgatatagttgaagatcatcgacacgtatagcatgccaagcaacacattgagcaactccataaaaattataaggtatgctccttttcttctatttgcccaattaatgttattagctggtttctaacctctctgttggtaggtcatcataaaggagttagccgagaagtcccttcttctcatgttgttgcataaaaaaagtcaagctatcgagactatggagaaatatctttccaaggaaagagtcgccattatcgagttaataggacatggttaaaagatgtgagatgatcttgaggccaaagctcttgagctagagtccaaaaactaggaacttgagggtatgatccttatctcagcaacttccccactctcaagattatatgtctctgaattggtaattataactttgcgacatacaaatcacttggacttactcctaaggtggccaaggacatgaccaaaaggctaagttcatctattgaagctagggacgtagccctagctgagaaggccaagttgatacattaaatgatgagttggaagactatttgggtgagttcaagagaaccctcgacaagaagcgggccactaagatagccataaaacataaggatatagttgaataagaatttattaaccataacttgatgttttttgcatagagtagagaatttataaagttgtataagcatgcttaaaggcgatgatggtcctcttatatagttttgatggcacaaaggactggtcggtggtccagaagttgaataaccttctggagcgcatcaaaaggttcggccaagatatcatgcaacaggccagcgttttaacgcgaacacttacatagtctcattatcctaatctagatgtgtcctaggtcaagaaggagtcatcgtcgactactcaaacaaaaatctcctagagcttactgaaaagagcaagtctatgatggccaggatcatcttggatattgacatctcaatttgatgtgtaaaaggatttaagaccctaaaacaccttttaggaatatttgtgatatatagctcaaaattaaattggaattcaccatttgtctttagttggcacttgtggcatctgtgttgtcaaccatctcggtag

SEQ ID NO: 4660 - DNA, 1240 bp, Zea mays
  misc_feature (1)..(100): optimal_loci_127954_G1, chr3:214894678..214895917, Cluster 29
tttatctcctcatcaccccctacctagctacgtatgatgctaaccagaggttaggaccctcagttcaaaacatcaccgtagtgctcaccattatcgttgagcttgaggttgtgtgtgaccagagcacacgtcgaccctctttgccctttctcttctcttgttcatagtctctatggttagcacttgcacacctagctggcttttggacaattctaccctcacagacatcaaaatgatgcatgttgctaccatgaactagtcactgagccaccatgcacgtgaccagaacattttatagtgcactcaagtcccaaaacctaaccctagacctttatagctaccctttagatccctagccaagctcagctcaaaccactaccattagtaatgatcggtacctcggtcatcatcaccgctgagcgaccattggtgttgttggcgtgcttaatgacctctattgagccaattaaccccctagatcagtgtgagaggggatgaagagtacataggtgctggtctcactatcgacaacctcaccaccaatgaaatttagctggtcaaagccatctcctgcctatgcatatgatagtggggtcaggttgaccaattgccctatggataagtgcctctatgtgcatagtccaagtgtgtaggtttagctagggtttagttttgttgttcatttttattgtggaataaaatatgttaaactttaaaattcataactggagctacaatagtctaaaacacatgaaaccaattttgttagttttgttatgatgtgctctacttgtgaaaaacataaaacttgttgattgaggattgtttataggatgtatcttttctcaagaaaaatgctacttaaacttgttaaatatgtacattaagttaggaatgtcataaaatataaaataagttatgttaactttattttgccatgagcaagctaggaaaaatgatgaacttgccattggagcaccttttcattggttgtatatatttattttgggtgattatttgttatattttgaaaatatgtatgggagttatatatcaaaagttgtgaaactaattttcataacttcctgataacatggtatatgcatgaaaagtatgaaatctattgtctaacactattaagtaggccaaactatttaacttgtttaaagcttgttattttattactactattttatatatctaaaacttctgaacttttgtgtgtaaactatttaccaca

SEQ ID NO: 4661 - DNA, 1308 bp, Zea mays
  misc_feature (1)..(100): optimal_loci_128128_G1, chr3:215776953..215778260, Cluster 29
atcaacaacaagctcaccaatagtttgcctggcttattttcctttctttgtatgttgctctagattggcttgataatttttaggtttatgcctctcagcaactacctcttctggtgtcttcagtagcattgaactaactaatcttgaaggcttctgagttgttggtttaggtgttgtagaaacaacgaatgatgtcatgggtagttgagtacttttcttgtttgcttgcttatactttgtcctagaacttggttcaggagctcattcctcttcatttgcttattcaccttcttcatcttccacattgatcacatgcacaacccttggatcctttctcagataagcaagtacctccttggaaactaattcaagaactcttgcatatttaactatatcactggaaccccacaataaggtgattcttgagtcttttttaattcctgctaggactatcttcagacaaaaaggcattgaagaaaatccttcttgctagggtatgaccgccacccaaaagtttcaacctagatcttgtgatatggcctttctcttacgatcaatagtttgtacaacaaggtcaggcggtagtgctaatattgccttctatgttagaaatgaaatatctggagtggctcaagaagcagaggcacctcctccagtagtgctgccagcaacagatgaagccttaacggtagaatcatctcctacagacttaggcatgatcttttctatagcttctacatgaggcatgagcatggcgttagtccacctctacagaaaaggaattggttcagaccaactttagactttagagttttagttcaacttcaacactggaaaagagaggagtgcagggcaagatttcatgcaacgtcgaaagatagaacataatggcatagggactcaccgtcggtggagttgctcattgtcgaggaggagaagtgtagaacagggacacatggcatttgttgccgagaagaactactatagaacacactgctagggaacacaccaccaaggagaacacataggctaagtgtgtggtggctaatgatttgtttatattccaaaccctaatggtctagaattaagggcttgtttggatgcatatgaattggagggaattgagggggcaattgtatagcaaaggattatatgcccatcaatcctattcaaccccatgcatccaaacaagccctaagggcctcactaggattaccagtttatattcgaacctgaccgttctctcccttggtcgggtgattagactagttgaacaactcaggtcgtacttcctaatcaatgctgcta

SEQ ID NO: 4662 - DNA, 1272 bp, Zea mays
  misc_feature (1)..(100): optimal_loci_12883_G1, chr1:70716035..70717306, Cluster 29
aaggtgaaagtcaagtttctggtaagaagtgaatgtaagatacaaagaagcaatcaacaataaaaaaaaatcaaaattattgtccatgtacctactacaataatggtatagcgtgtaatgatgtgactatagtcagatcacacttgattgtgcgagtttttgtaaatgactacacagtttatattgatcatggtgaaacaacagttaattaacataagacatgagaagcataaactatagcagaagagattgatgcgcttatagatggattttatagagaagtgttatttactagtgcccataatttttttgtgttggtaatggtggtcgacctactaaggatgaagcccatgggagcaatggtggtgtttgggtggggggcgggtaaacctagcggcaataaagaagtggatgatgtgaggaggacaaaattgatggtgattatttgaaggaaattctttaggccattggacctgaggtgatactcaagagcacagaaattctgaaaattttggaagagataaaaaggaagcgaaggagagtttgtatggtgtcaaaatatgttcttatacactagacaatgctatgttttgtgcttggattgctcatcctaaagactaagtatggttggttgtcctgttgttccatttatatgttacctctcttgccatggttgctcccacaaccaaactcacttctcgtcaacacatacaaagcggaaaaggttaagttcattaacaatgggggttgaaaaaatccatgcattcccactattatttaccgtggaaatatgttcaagtcactagataattaatccacgtatgatgccagtcgctatatgaacaatgacctttacaacaaggacaaaccctccataggaaaaaagagcaagaagggtggggaaaaggcggtacaagattctcaaccccaagagaacactcttataggcaacaatgtgaagcagtggataatttttgccttggtaatgtagtacctaccaatcactgatctctttgagacgtatgttggggagaaggtccatggttgaaggtccatactaacgatatcaaagtttaagacattttttcagtataaggccaaagaacatacgaagcttaaaacaatgtttgtcttttagaaaagcttgagcaacaggcaaagccaaagaatataagaagtcgaagtgtatgtgaagacaaaagctacatgaagccaagctgaagcaagcagaggtgaagcttcagtgtctttagaggggaagtcttgttggtt

SEQ ID NO: 4663 - DNA, 1116 bp, Zea mays
  misc_feature (1)..(100): optimal_loci_129653_G1, chr3:223658880..223659995, Cluster 29
cacctatatacatgacctaattgtatggcgattcaaagttcctctaaagatagaactatcctttgaatttttgagatattggaaaaagtaaacttcatccctaaagtagaggaattagaccataaatcaatacagctggttggcacactcaagcaaccaaacaaccaagccctagagtttacatagcaatcctaaaaacaaaaggccatccatgagagacaaaaaataaattatcgcggactctataggttagtgaacacataggtgatgagtgacttatagacatcattatgctgcagttgactccaaaagtggaaccaatttgaccctcttaataagacctacaaaaatgttttaggcttgcaaatatcaaacacaacattgtttcttgataaccaaatagaccaataaaaattgcagctcctattagtaacaaaatcttattttcttaccacattatttgcaccaaccaccaaataagttcttcacatttaaaggtggaattaatggtctagccaatttaaatgcaaaagtgaactaacagtctacccatggctataccccttatctaaattttctagcatcctaatacaagattgaactagagagcaactggggctccgagctagtgagaactcatctaaaacttattataggttgggtcaaacaaactaagctactagagcacatgcaagcacacgggagctcctactcatactagtttgaaaatggtaaactagtaagccatcacataaggcacaagctcaacaatacaagctcattatattgcaatgaagtaaacctatgttgagatatagaaaccatagttaagtagatggcatacgatgtttttcctatggttcaatgactttctgatcacttagtacatattgaggtgagttctaagatcgttgttactttcattagctccaaagcctgcaagcttcgaattatgccttgaggtaggctccaatgtgagcattaaatcttgagcttgacaaatcaacttggcacgcagataagcctcgatgatttgccttcctccggttaggatgagctccatagctcctcacaaagccttctctagagctttatgatttttgcatgtttaattta

SEQ ID NO: 4664 - DNA, 1182 bp, Zea mays
  misc_feature (1)..(100): optimal_loci_130353_G1, chr3:227078554..227079735, Cluster 29
tcctctccccggccctcttcgagatcacatcgttagcccgagctttatgttactatttgtaaggtgaacactattgcttctcgggataatgacatattagaactcgttgactacttgcaagtggaacaagtgggattgagattgctactcatttgacggatctgaggacgttaaaagggaaggtcaatgttgcttccaattgcttttgatgttgacctaagttgactgaaactggctttagaacctatttggatcagctagagcttgttactagttgggacaaagaaatagctcaaatttagttgagttctctaacaattaatttaaggcttttggctgaaaaattagtctacatattagtcctatataagttttcctctatttggatgagctaagattaatttaggatattttttagctagccaattgacaattaactcttggtatccaaacagcccttacttgctttactccattctaggttactacgtgacctccctgttctagatgtatccctatcaatgtctaacttctctcttctatatagataacatgcgtttctggcttccagatatgcaattttcttctctctttctaaaggtgcgcatgacaggtccataatatcatgtctatggatagaaagttgacattccgagttgggttttagaaatgtggaccatgccagtttcagtccacatgtattggaagttgacttccccagtttagttttaatcttttggatactcatagtttgattttcgagatactagttctgacttggtcgagtgttttggttggaagccagcataactaggtaaaaagtgaaattttatgaggacaaaatcaaagacacaacaacacttccattcaatttcagcggccagggcttgaccgccaaaagtaatcctttattttcagcggtgtaataagtcgacgaaatttacctattaatttcagcggtgcaggatgagccacaaaaaataagacttaatttcggcggactggtatggccaccgaaaagtaaccttttatgtatatggccaaaccctttctctctcttccctaattctcccagcccgatctagcgcactagctcgcgccacctccaccgttttgacagtgccgccgccgccgactagtctacgtcgtcgccgtgccgtcccgaccacgctaccatcgtca

SEQ ID NO: 4665 - DNA, 1112 bp, Zea mays
  misc_feature (1)..(100): optimal_loci_13066_G1, chr1:71571371..71572482, Cluster 29
caatgtcagggagttagacagtccctaaggagacaaatagtcacataattatgtgtaggggaagtgttagaatgagcgattcagaagttatcttatgagttttagaacataactctaggagttatatgtttgatggatgagaagttacctgacttttgacctcccgtgtcctcttagctctcacgtcctctgacctcccgtgattgcttagttctcctagatcgactatataaatttcatcatgtcatctgctcttgggttgccttttgtggctgttcaactattatccaagtactccattttagtacttacacgtacgggttctgggagacccgtcctctaaaatgaatgtcaccctgatcacctgctcaggtgaaggacaacaatcgcgtttttggggagcatcagtgacacaatttcttgctttcatcttctttatggtgtcgtgctctatcatctccaggtcagtttggtgttttgttgctgatcgtcatagttatatacatgtactacatcaagtgggatgactacgtcgattggcaatatgtatattcataggtatagatctttcttttaatggtaaacaatcatgttactcttaactctgtttatagtcatcatgctaagtttacatttgcatctttctattgacatgaacttttttgtatatctttttttattaaagtgcaaccaaaatgcctagttttctaacatttaccgctctataataacaaagttgtgcgacactacgaggtaatatgtttcaccattttctttgttgtacctgagtatgactcatgatccacgagggccaagaaggtacaagaattcctattctacgagttcttcgctttatgattaaatagaagtaacttagctaccataaaagtgaaggctctgtttggcacattacgtttttgagcatttgatgaaataaataagttaacaatattttcactatttatttccgttttactcttatattcataactaaagtcttgtgtgtatgtagtggcggattcagagacagattaaagaggctgaattatgcattgaggaggctaaatatggccacaatgcgaatgaatggagtcgacatagagaggatgagc

SEQ ID NO: 4666 - DNA, 1039 bp, Zea mays
  misc_feature (1)..(100): optimal_loci_130666_G1, chr3:228440422..228441460, Cluster 29
gacccatccttggaatagaaaaatgcccgctcggttttggttcaccaatagggcatcagaaagatccttacgagagcaaaggtaaaaaaattaaagggagaacgacaatgtccttcccaaaggaacaaaaatattgaatcttagggtttggtctccaaacataaaagcctttcataggtttaagaattgctaaatttcagaatttagcctttacaaataaggacccttccaagggcatgtattaaattactttagagtaaacaagattgctaaatcgctttagaggaaacaggattgctgagtctaaggacttgacttctacacaacaaaatcccttcagggggtaacagattgctaaaccttcaattcggttggtggttttgttttgaaagaattatcattcaattctttgaattcgttcaagcatactatgaatacgtttgtataaatttgccttgaagaattagtccaacaatttcttaccgagtcccataacttgttgtctaagtcttagtccacacaactcgatagaccaagaaaataacttggaattcttcttcaaagtctcactcacccgagctcatagctcagataagttagacttgtgggctacatttacaagatgcaccaaaggtgcatacttatgacttgtgaataaggaattaaaggttttatgttatttaaatccaagaagaacgacatagccccacctacccaagtggataactcgaccacattaggctcggggggctattgtatagggatcaagggtacccaaagggcattgatgaaggaaatattgatccaggaccaagttgtacataggtctcaaagtcgaattatgaaagaactcaacccacatgacatggtagatctacacatcagaatatatgaggaaagaacaaagcttatctttgcaacaaggtcatgatctgatatatgcgaaactgatgtgtaaggatagaaatagatcttacagtttctaagatgattagttttttcggtttccatctatgcattactagatactttccttgta

SEQ ID NO: 4667 - DNA, 1366 bp, Zea mays
  misc_feature (1)..(100): optimal_loci_131346_G1, chr4:596191..597556, Cluster 29
ataattaacactttagataagaatataatatgggctaatgtttgtgcatattttttttacagagggtgtattacatctcgtacgtccagatggatcgatggagctagctgagctgcgcacatgaacgatcattctcacgttccatcatatcatgcatcatgctagctgccttgctattgtaaagcagctttcagttcagagtacacacgtacgtagtcctccagtatagtagtgtagggtccatctataatatatatcgctgtggatcggagtacatggtcacagtggtgacggatggatgtatgtatgcatgtgtgacagaggatgagacaagcaagcaagaatctttgctggctcatgtgatatgatccagccagcagcagctagcactctgatcgattaagaaactacagccggccagtacgtactgaatgcgatcgtcagtagtgtgcatgcaaagctatacatcaaacagtgcatgcatgctagctagctatatatatgtatcaacgaacgaatggaaacaaacaacagcggggctgcagatcgatcaatatctacatgccatgccatcaggcaagcatccacagcactagctagctatctgagaaggaaggaatctcagatcgatcaaaggatgcatgcagtcagtcgtcgtcttgcttactacgcaacagctagcgcagcaagcagaagggaatatatattatgcatgcgccggcctgtatggtgacgtacgtacgtcagtcactgctgcataaacagatcgagctagcaggttaaatattgtacttatatatagattattaggcaatcaagcactatcactctagcagaaagcaaggacgaccaaaggcagcaggtaattaaggacaacacaagagacagaatttcttgaatggattaatggatgtttatagttcagctagtgtcgctgcagatgatcagcatcaatcagtacataaacatatatatatgtagctacctatctgtatagccagtcacatgcatatggaggcattcgatcgggcaaagtgacaaacacacatggcacaagcatcagctttactattatgatcccagcgactagttgcattgctagctagatatatagcagtccatatgcctacatcgaccaagcacggccagacactaattaataataagcatctagatgatcaacttcattctctattgaatagaccctatctgggagtgcttactgtgcaaccagtgtatatatatctatatataaaggagtagtaaaacaaatggctatgccggtaaataaaatattatggaagatcatttgacctctacaagtcaagatattttcctgcatcgtattaaaagaggcgattcgaac

SEQ ID NO: 4668 - DNA, 1035 bp, Zea mays
  misc_feature (1)..(100): optimal_loci_131696_G1, chr4:2474947..2475981, Cluster 29
ggtactccgtaccatgcatgtgtgcgtgtacctttggggtttacagaaaatgttatttgagccaagtctagattctctaacatggactacttgttgaggcgttgggaatgagaaggtacggtaggtgatgtggaaacacacaccactatcttcacttcacatgcactggcactgcactccccatgcatgtttttggccgtccgaaatttgtggtacttacactgaagttcagaaaaacagtgtgtcatgcttttagcagccagacagcttgttggaggggaggggagtagaaaccgtatccgaattaaagccgcaaagaacaagtaatcagaattcatccaccggtaaaacaaaagttttactgcatgctttgaattgtctaaagcaggggtgcatcaaccttcagcatttagcggccggataaacttctttaattagtcacgtgattagcatcttcttctagaccaaaaactaaccagctggttgttgtgtgtgccggtgctagctgaaagcattgctggaattcggtcgtagcaggagcgagtacactagctacaccgctaaatgcttggttaacatcctttttcgctcgtctcttccaagtggtccttcactcatttcacgccatgaatgaatgaatctctctctctctctctatccaaaaggtaaaggcgacagtctccctttttgacagtacatcaacaacccaaaaggtaataaaggcgactatttactttattatttcgatcaaatccatttactactacttgtgcgcatgattatagcgcccccccgggaaagtgttggatgcagaacacaaaccacggattctatttggttagctgatccaaaataaagatgggcaaaagacaattttttgtttttcctacgacgatgacacatcgtcttttataaagcacagaacagaaccgcgcagtgatattttcgtagagttaggagaagggaaaaaattgttcatcaaattaagtgcaatgtcttgatagatataaataaatcggatctattttgggctgc

SEQ ID NO: 4669 - DNA, 1167 bp, Zea mays
  misc_feature (1)..(100): optimal_loci_132401_G1, chr4:4820825..4821991, Cluster 29
ctcatggaagctacaacttctattgttgcacgtcttaaaggggtgggtgtaggaagtattacggtgcatgtgcatccatgtcggtctacactgttaaaaaatactatataggatgataagttatatttggatagatattccaattctatgatgtactagaatctagttcaactccatattatatttatctaggattcttaaaatcagcctgatttgtattatatttatctaggattcttagaatcaactcttatatacgtaggtcacccttagtcattgttatttatctaatagatcaacacgcatcacacacactccaatttgaactgtcggcaattcttccgagcatctactttgcatggtaattagagccatgacgagttaatctttatctacctccatgaacactctccttgacctaaccatctttgagaagctggtggagtccaaccatgcgctatggtatgcacatgttaagagtgttattcgctgtgcaaagtagctcaacttcctgatcgatggtactaaggcaccgacgaccaaaaatctgctagaagagcgacgacaaaaaagagatcgaggtttgattcactaagaagagcaaaaaacattaatatacagttggtcgtaacaaataccaaaaaggttaatctatttatttatgaatagtttacaaagataaaatccctagatgattagatggcagcagttggccatcatctaaagatgaagaatttgtagagtacgttctcatgggcctcgatgacaactatatcccactaatatctgctttctatgccaggaagaagtcaatcacaatcagcgagcactttggttagctcttgaatttcaaaacctatgtcatgctagtctctaatagtagatctatcaactgcacgagacgaggatatggtgctacttaaggacagggtagtgttcatggacatctaggtggacatgatggttacagtaggcgcacaaccctagcagctctaactagaaccatagtaaattagatgagcaactcgtttccaagtttgcttaacccccccccccttccaactactaagtgttgcacatgtttgatggaaaatttatcctagatcaaaaacttgctacctcaaccacatgttcttatcagatgatctaagctaacatggattctaa

SEQ ID NO: 4670 - DNA, 1093 bp, Zea mays
  misc_feature (1)..(100): optimal_loci_132449_G1, chr4:4902728..4903820, Cluster 29
agatttaagtcagtgcaggaaaaatatatgatgtaagaaattttcaaaaccctagattttctagctcggtggacacacaagttgtggtacatggacacctcaaagatgtcaaggttgtgtaataaatccatacattggtcagagccgcaccgagtcaggtagtgattaagtccatcatcctctttgaactaattaaccccaaatgaattcaatcaatcgtaaaaagaattgatgttctataaaagaataagaggatttacatacagatatcatattgagctttagcttcattgtatccattggcatttgtatcagttttaaatggcaccatacaactacatgctgagaggccttataatattttattttcttcaatagtgaagatgtttacctacttgttagtctaaagataatttacaaaatcaggtgactatagatagggtgaatgttagccaatcaaaatttatgctttacataatcttgacatgcttcccaaaacttagcataagccatcaagacaacaaaaataacaaatgagtatgtcacaagacaaacaatggctaaatattcttagaggtgaccggcaaacaaaacaaagtactcaaaccagtaagaaactaaggacaacaccaaaagcctatgaaattgaaaaacagtgatcacaactccaagcgagataaagtaagagcacacacgcaagccactcaaactaactattggttttatgacttggaaaatttgttgagcaacttataaacttacagagctataggaacaaaagaattgaaaaaatggatacctaaaactcaataataccttccaaagtactagaacacaagaaagttggcctattcaaggtcagaagtaggcctaccaactttgcaatccctaggtaggcaaactaggcctaccaagatgcaaacctggcgtagtctacaggtcgacctagccaggtcgctaggtcgatatggcctacttcaggagactcagtaaccccaaatctaactcctaaaaggtgagatatattcaaacaaagtctgattgatctcaaattttcacgagatgtatctaaggatgttttgagactatccca

SEQ ID NO: 4671 - DNA, 1133 bp, Zea mays
  misc_feature (1)..(100): optimal_loci_132684_G1, chr4:5974788..5975920, Cluster 29
aaaatagaaaagaacggcgtttggtatctttccatcgaaggaattgtgagagagattcagcatctctagactctagttgtctccattggcacatttggcatggtcccccgtcagctggatcagatccattaacagtactgtcaggtccctaaaccctaagaccgtgtctagcatattagttatataaaaaaacgcagttttacactatatatgtatatagtactatttacatagtaaagtttaaattataaggtgagatagggattaagataagatagctgttttccaatctccaatgggattcgtccagtgaatttgttttgtttgaggcatgcatataaagctgctcgatctgaatctgagagagaattaaggccaccaacagcgcttgcattggcaggatcatcacttggtgcaaatggtagcatggaatatgagaacatgcatgaatagagctaggaggggctaaattatgtttttaggccctgcactgcatattgttccacggttcaccattgtcgtatcctctacataaattataaaaatgctaaaattacgtggaaatggagattcaaactatgattgttgtctctaaacccatattcacacacccgtatattctataatcaagtataatggaaactgtagcaatgcatgtatattctataattaagtataaataaaaattgtagcactttgctatttgattatatgagtgaaatgacttatataacgtgctatttgattctttaccataaaattttaaaatctcgcttcagagaatcgggagaaaactatctttttttttcagctctcgatctcttaattcgttccggaaccactttatacaattaccagagaatcacttttgcctgaaaaattgctaggcaaaactgttgctagattaaaaaacaaatctatctcaaaagaggcattagcccctatttcactattacggcatatgatcagcacgtggatgaaaacaaaactgtttaacgtactgattcctttgtttcggttgtcataaataattgaaaatagttataaattccgtatcgtgtatctatatctagtatttactaaagagccaaaaatccagccaaattttttttgtctccacgaccttgtctagt

SEQ ID NO: 4672 - DNA, 1042 bp, Zea mays
  misc_feature (1)..(100): optimal_loci_132781_G1, chr4:6428209..6429250, Cluster 29
tcaccctctattgctacagcggttgaaacaacatgagcatgccactggatcacggtgacaatatcattccctactttcatgtaatataaaatatcattttaacaaatattttgtttgattgtttgtacaagcagttgttaggtcaaacctaaattaaatgatttctttttctctctccattttctaggacatcaattttcctcaacaacaacaacacctttaatcgacgattgtacgacaatgaatttatggggtaggtcacaagattgaattctgaaggtaaagacatgagagacacgaagatttaggtaggttcggactctcaatgcgagataatacattgcgtcctatatgaggtggatttgttgttgtatgttctggtcattagagagttcccctacctcgccttttatatcctaagaacatatggtggttatatggtagacattgagttggttactaagttcatgacagagtcaagtcgattaccgagccatacatgagtttaactctatgttttcaagtttacctctgactccgttgagatctttaccatatctatgtttctagaatcccttgtgctatctatatatgatcttattgttaaatccttaggctcatggctgagcccatgagcccttctgctcaggctcttcttcatggagcttgacttggtacatattattgatagtgatccctgagtaccatttagctcattcattgattcaggaaaatgagactcttatgaatcttctagaatgaccatgtaaatccatccttgaccgagtccttgactcattctagcggcccctgagtctatagactcggctcggagcttaggactcaatttatttattaatccaacatttcaaattctgtaatcccataaaagaaatcccatgatgcttcaacttactcaggccaacaacttcattctccgctactaaacactccgcccagttgatcctttgccttccatcggagaacttttgtctaaagcttgctttcatcgtcattaatcctttaattgatctgctccaaa

SEQ ID NO: 4673 - DNA, 1386 bp, Zea mays
  misc_feature (1)..(100): optimal_loci_133810_G1, chr4:11273636..11275021, Cluster 29
cctagtcattaaccgatctaattggcgcaacaactgtcatattgtgcatattcgtttggatttaatccatatcgtcttctactgcttctataacaatatttttgtcaatataaattacagctacaacaattccaataactgactttaatctgaagcgaacaacgcgaaatggtggggtcaaataatgaggggctacatgcggatgctgaagagcggagttcgtgagatcgggtgtggactgtggagcaccgcagcgcggccttggatctggccttgttaattgtcatatgggtcaagggctcaaggcaagggctgaagcttaaaggttgtcatatggattttggactcggttgatctctctgggaattaggcccacggggagcccaggcagcccccttggatctggccttgttaattgttcattgtttcgttcttaacattttaatttggtttataaaatatatgtgttgcttcgtgcaagaaaatctttataaaatacattttttatttccgaataccatagatttcaattactggagtttttctttgtttatctcgatatatattttaaataatggagcatgacgacatttcctttatactccattcatcagccaaaagtttttattccaggattcaaattttgtcccacgtatataaactcgactgtatataccttttctctatttgaccgatcccacatatgcatgcaaactttttaactatagctgcatgcacaaataactaaggtcaaaggcaattaaccatctaacaagtaacaagccatctttaattctttatatagaaaatgtctaataaataaggataacatattaacatggtaatttgagtcccacgctaatctgtttgagactgtcttgaattgtatggtttttaggagtggtagtataatattaactaaatgtcttcttgataacacttcattcctaagacgaaattttttcctaattattatggttttgttatgatagtataaattcctcgaaggttatataatttgaagtggacccaagcgcaatcaacattctgcaattgtttggatcaactcgctaaaatttagttcctacacaatccttttagttgttccaacctagttaaactcaactaaaacatgagtaatgactaaattacccttctgttttttcatgtccatataattgcgctaaatacaaataaggagaacgcgataaataaacatcaattaagtaaagaatccaaacgaccccaactaaacattagctggtcaaattagtttattaaagtttacctagactgaatctaaatatgacctttgttaggatatagagttttatgtgggttaaaggatactcctagtcaaacctttaaaattgatttttattgatg

SEQ ID NO: 4674 - DNA, 1281 bp, Zea mays
  misc_feature (1)..(100): optimal_loci_136152_G1, chr4:22861731..22863011, Cluster 29
aagtcaaaattttgtaaatatttgataaggtttgtgatcatataaaatttctctaagcttttaaaattataaaaaaatgacaaatattaagataaaaatccaaatcaaatatttagagtccatgaatgtatctttagaaacgtcaaaaaatagttttagccctagaaataggaaaaagttctagaaaaaatctagaaaattctcaaaacattcaaattgaggtagaaaaatgtttaaaattttgcacggtaaaagtgtaagatgcaactagcataaatgcaaaatatgttaatgataaatgcatttgtgttggttgcgtattagttttttttttttgcaacaagttttcaaaatatgtatacatattagaatgtttgggaattttctagtcttttggttatctttccattttgctagagataattatatttttgaatcatctagagacattttcatgagctctagaatattttattttgatttgtagcaagctaatatgtaattctttaaaactttagaaagtttagatacattttaaggcttaaaaatattatcaactacttaccaagtattttaactaaaaagcattaaaatcaccttcaaaattactctaaaatagaatcgggaagtaatttaaaatataggggttaaggtgtatagttttaaagttaggggaaacaaatcaaaatacaaagatatataactgagggaagtaaagatgaactttttcctaaatgtttaagcccggctcacatttttaatcggtcagtcaaccctttcaaaagctagaaaaggacaaatattaatatattttgttttcgatttttgaggaactttttttgtactttagcttggttttaccatcaaacgtatgcttggtatgtactactttgtccggtttaaatcataagacgttttgtttttttaggtatattatccttactatttatgtagatacattgtatatttaagtgtatgacaaatctatgtatctaaaaaggttaaatattttgtaatttagaacgaagagagtatttaataagcaatcttgagaacaccctagctcagtgtgatatgcagtggttttaatttgtgcgaaccttggacgccctagcgataggtttttcaattttgggattagaattttccagccactcctaaattaccaaatttcacaaattctggttgaagttttgtcaaaaatatttaaatataaacatgtggcattatttccctaaaatttttagatctatacaaaatatgagtatgatttatgattac

SEQ ID NO: 4675 - DNA, 1313 bp, Zea mays
  misc_feature (1)..(100): optimal_loci_136275_G1, chr4:23408285..23409597, Cluster 29
tgtgtgaagggaagttggtatagttcgcaagaaggcttaggcattgacatggatctgattgttagcatcttgaaagctcaaatcaagcataaaaaggtcatggctaaagcaaggtttggcaaggaaggaccatgcgtaatgcaatatagaagcgcaagctagagactcgggacacaatgtcccattcaggcggtgaatagcaagcagagggcttggagccagtgcactaaggcaatggtgaggagaaagctagaggctcaagacatgatagaccatcaaggccatgaagtgtgagtagagagtttggagttgagtgaccaaggcaacggagaagagtaggcgaggttaaggttgatggacttgaaggctatgtgatggtttgagtaatccacgacatctatgtagatcaagcaaacgattcaatgaacatatcaagtgacttaatgatgaggacatcacaccttcaagcacaagataactaaactaagaaaatcaatatcggtgtccaactcatccatatcatgacggaggcccatctcgactcattggagcccattttagattccaggagcagtcccatgtaaaattgacacccatggagcatatggattctatttttaacgatccacatataaatataatttgataacctaacaatggctttagctgacttagaaaagaggacaaccagctcaaagaagctgatcagtgcgaccaacatgggtcgattcgtatgatcaggttagaacttgaggttttatttgttgttgtgcttctacaaagcgatttaaatttcacaacacaccctctttgactggtaattgaagcggtgacattgctagattgattaactctagcacttagagacaatcatagctacattcaggagaggcaatcgtagtagtagtggatctcctcactccatgtgtgttggtcattcagacgaccacttgctcttttttgcgacaacaacaacacacaagataacaagcatgatcggaggacaaggcaggcaactagctcctcatgaagacattatcagattctaccaataatatgggcctttgataccctcactgtaagaggaaatgtcaaaccaagctagggtaggctaaataggccacatgggagacctaacttgattggagtatctcaacgacttggtagacaagacatcgattagatatacatagatctcaatcaatatgtaaagaactaactagattcgaacatattcctctttgtaataaattaagaagtaaattagatccaatcaagggtcttcgatgttaaccctacctatgggcttcata

SEQ ID NO: 4676 - DNA, 1122 bp, Zea mays
  misc_feature (1)..(100): optimal_loci_142143_G1, chr4:58513916..58515037, Cluster 29
cagggcatttttactctttctacatttttccccaaacgcgcagaagagctgtgaattattatattaagaacagaagttccaaaatagactgttacaaggtatgtagttcccaaagtgcagtggaacacatgaaatggaaaattaaactcaataaattgcagaaccagtaggacaagtgcaattgaaaaatgatccacgtaaacatcttaaatttgggaagtaggcactctgaaaccagattaatttatacttagctaccagtttgtgccttccactaataaaaatctaaccatataactcttgaacagcatgtgagattgaaaattcaggtttcgcacttagcccaattagacaaataactccgcttagcttttgtgcagtagagcagtggatccaaaagtgagaattgtataaaaatatgactagaggggtaccttagataaatagtgcattaaagtcatcttattgttacgagcacgggtgtcactaagtttaagcaagctatccaacctgaaaccaacagcagaacctacaaaaaacgaaagggaccatactgcattcatgaagaacaagagaaaaaaatataatttgcagatatgacacaagaaaaaaaaggtgtggcaaattaaattaagtaaatacaacttgtcatcacaacaaattcaccaggcaataactaaacatattgatccctttaaaataaaacagaccatatgatgttgcaccaccatttatgaagaaaatattaattactaattaggcttcacagcaggatggcgaggtacagttagtagcatgtatcaagtcagactaagcttcatttgattagtgttcagtcaccacacaaagtaaaattgttgtcacttagcatcaataagaccaatattcctttttaaatgaaaatataatgatgcttactaatggctagttatcaataatcattgttctatgggttatgagcattaagataactcactagccaattatcacataccctcaaggagaaaaataatacttcacaaaatatcttgaaaatacaattaatggaattttacttctacataatgataactcaaatatcatgcatcagtcttcactgaaataacacataagggcttgttc

SEQ ID NO: 4677 - DNA, 1081 bp, Zea mays
  misc_feature (1)..(100): optimal_loci_143849_G1, chr4:69399630..69400710, Cluster 29
tgtgactgggattcctcccatcctgtattgtaaagaaaaacaaagcaggtgcaataaattatgcaggggatgtcgctagaattaaaagattaggagccccaggaacttatgctgttctccatgaccatgataatagagaccagatactagactttcccttgatccatccaatggcagtaataggtctctaaatattaataggtcgatgaagcatatttagaataaaagctaggaaaattactcctggttagtgatcaatcgcgagaaatcataggtgtctctagaatctagactaatatttcaaccgtgtaatttcaatggtttgccatagacagcctagtactatgagggatgcagaacctgatctaaatgaattatggaaacattaattattgcagatgcatgcaagttctcactagaggaacaaatcagtcactgcactgtgaagcaaatgcaagacaataaactttaatacaaacatacaataccaaacttgtttggcatatgaacaatctaaattccataaaataggctcagaatttgtattaaaatcctagtcatcggacgtgcaagaggccatgagattctaaccctcaaagtatgaactaaatagacagcaggagcaaagggatagcgataattaccttgtcaggaatgttagggtcagctccagcctctaattaacaagaacttgacaatgtcagttaagccatcatacatcaacagcctccgttaaaatgactggaccaccgggacttacaaagctcacatcagcaccagcctatagaattggcaagacaaagcttaggtagctctagagggaacagtcaaatgaacccatgataatagcccagattctactctatacagatttcttcgaaagataaggagaaatcgagttaagaaataactggacctcacctcaaccagtagcttcgtgcgttttaaggaacgtgcaccacgaggagcagtgtaaagaactgattggaaactttgttgggctgcaaaggcaggaaaacagttacgagagctgatcagatcaagggaaataatctaggaaaactattctgctgcaccttct

SEQ ID NO: 4678 - DNA, 1179 bp, Zea mays
  misc_feature (1)..(100): optimal_loci_156385_G1, chr4:154271892..154273070, Cluster 29
atttttaaccttaaaaccaaacatgttaagactaaactttagtccctagactaaaaaaaccaaacatggtctacattacatgccacatcgtagaaacaattacatttttttctattttctgatagaaatactggcctgacgcatcgtggcttattacctgaactggttaaccttgccgggagtaatctggcttcaattgaattgattacttcgaacaatccatagatgcatgtgtcaacaagaatgcgttgcacctactaccaatgccgattgacatcgatacatttctgcacgcatgatacgatcgaccacaacaccgcaacacgcttacgcgaaccttggaaggttggaaaggccaaggcggaatccacaagtaccaccgtggttaattaatacactacactagcttggaaggttagagggcggcacacgcacacaccgcgcgcacaagcttgctctagcgtgttcccgcgtacgttttattttaccagttttccgttgctcaaagcatccaataattcagcctttacgctttttttttcctcagtgcatttcatgctgttgttaccatttccttacgttttaagccatggcgtgtcagaatatgcagcttttcgctgggcgcgcgggcagaaaaaagagatcccatgccatgcatgtgtgtgtgtatatacgtgccacctttttcgcccgttccaaagcaacaaaaataaaacgacagcagtggcccgtggacagcgccgcctttttcttttgggagatgaggccagagggcaaatctgcgttctcactttctgctgatctgatgccgcctgcacatcacaacttctggagtactttttttttaccgcgtgtcgctgttcaagctgcagcctgcagcggcgtgcgtcctttattacccaccggatcttcgactatacgtaggttactagacgcgccgcctacctttagttgtataatgaatgtaatgtttatatctttcagcaagtaatcacatcattttcatatactccctcattgctatagccaaacagcttggattctacgttggattttgtgtctagaatctcagatctttccataagctgataaccagcagatttgtattggatttaacaattaattttagatttgtattggattctacgttaaatatatatgtggtagttgagtacataa

SEQ ID NO: 4679 - DNA, 1284 bp, Zea mays
  misc_feature (1)..(100): optimal_loci_157316_G1, chr4:158723140..158724423, Cluster 29
tgtgcccagccggttgttgttgatcgacagcagtggcggacttcaaaggcgatccacaacgccgccggttgttgttggccgctgcatctgtatcgtgctgataatcgatgatgcggtcgtctgaagttttacttgcggcgtaatttgcgtatgaacagttatggatctatggaagaaccgatgcgaagcgagaagcttctttcgggatcctctcgtgagcatatatgaacaggttatggatgttgttgttgactatggttctctctctatatataatatatatatagagatctctatgtatataatatatatatagagagaggggctgacttatttcagtagaaaatagttttaaaacatggtgggcatctttctgatttttcaaaaccgacttgaaaataatttaatttaaaaacgcaacaaaagtcggtatagctgatcgttaaagttagctagaccgcatttgacatagaagccaaagccaaccactactctagctggtttgacacaagatgttggtccgacaaattttgagaatctgatcgatctgaccgaatttgatgatcaatctggccagttttgctttgatggtacccagtcttaacgattttagtagccggactaaccagcttctatgccggtgacacaagaggaaagttagatggagagagcagaaaagtgtagaagccgcagaaggataggccggccgcatgcaggccgaaaggaaaagattctagaaaatcatactattgctgcatggctctctttcttgtacaccagcttttcttggacctgaccgcatgcaaggcataaaggcgaaagcgacctatcagcgctgttacgaacggccacgacttgttgtctcgaccggccggctgctgtcttctggctgctgcaggcccaggccagatggacaagcaaggtgcaatacagttgagctgatggtttttattccctcctcgcgtccatcaatgttcgtataaaaacctatcatatgcacagacacattaaaaaatcctaaatacaaatcccctttcaacccgttaagccattctcagttatagttttatagaggttttattcacattaataaataacttaccatataagcaaatataggatgacatgttatgatttaatgaatagagatattagagagtttcatgggattaaactatgtatacactgttttcaagaaaaatgttgacatgacagccttgaaaacagtgcgataaagctatccattgagaatgcccttagccgtcattcttcgtcattcttcct

SEQ ID NO: 4680 - DNA, 1392 bp, Zea mays
  misc_feature (1)..(100): optimal_loci_162355_G1, chr4:189183951..189185342, Cluster 29
gttatttttcttacacaccaatgattccctcatgttccaaggctaatggatggagctatcaattgatgccatagccatgggcaatagatgtgagatccaaaatgggtcaagtgaggcttggaacccaaggcattgagttgttcttttttagtaattttatttaatattgcggtgatttgtcaatgttggccttgggctagagataaatagttcattgattgaaatactagctgaatttagcctctaggaaggctagaggttaagctaatccacttttagagctaaacactttttgcagctattagttgaatttagtacactaaatgttctagatagagctccatttagcccgcaaatcaggcgaggggaaccaaaaaggactaccaaactagctgaccaaagataatcatttataaattgatgtgtttgttagactatcacttgttagttggtatttatagtatcttgttcatcttttttgtttagatatgtgtaaaattccctgatgtttaacatgttttttgcccacccgctaaattatttagcgcactaaaggtcatagcagactatttagaacactgaataccagtctattgttttctcttgtatagaacccgttggccatacaaagtatgcaaactaaattatagttggactctaaacaagagcttgttgtttgattaaaattctaaatgactggagttttttttggacatgtcagtttggacctatagttgtatactttgaaataacatttgtttgttcacttgttctataaagaaattatgtaagcttagagcctagactagaagtgcattttccttgtgttggttgaaactgcacctatatttttactatcatcaattctaatgtattataacaatatagtaccatcatgagcttttccaattattctagaaaacaggtcatgttcctctattatccatttaaggtttttaaaaagacaagtaatcagttttgatgtaaagtttgcaagaacttacacatttatattatttatttgataggtcatgaagcataatactaataaaagtattgaccaaagaacgcaaatggcttcttcaaatggtcatgtcatacctaatgtatctcaaaatgattcaaagctcgagctctttggttttgattctctagtcaacattttgggactcaagaggtatggccaaatgttctactattttcaccatatttactagagccagggtgtttttggtagcactttgtgttttcttttgttaaccacttgttttttaatgaaatggctagaaacctaaggccatttattttactatacttttaaaagaacatattagttatctaattggttatgaacagtaaacgaatcaagctgaatcttcaaaggcaaccccg

SEQ ID NO: 4681 - DNA, 1309 bp, Zea mays
  misc_feature (1)..(100): optimal_loci_164114_G1, chr4:197801589..197802897, Cluster 29
ataacgggggacagacagagttttccccaccaggtatctcgttaacatatagagaaaatgttaacgaaggttgagaagtgctagcttctccgtgtgcatgtatgtgctggggcggcttcagtgacgtgaattgttgatgctgctgctcccagcagccgctgttactttaacccagcttcatccaaacctgattggcaaaaacacactctagctttgatagtgagtactgtgagtgattttttattcaaaacggcccggttctttaaataatgatttagagaaataataatagatatggtttcgatggggttttattatgcattattaggacacctttttaattgacaagcaacagcagccccctcatgcatgatgagcatggatagataggttttggccaagtcatgaaaaggtcgccgcctgcatgagctgcagaaaaaagacaggggacgtggatggacctccattgctgttgctgacaatggtaatttggctcgtcctcacgctgtctctgaacatctacgcacctcgtctatgctcaggagtcaggcctgtcgtcgttctgactctgacgacgtttcaattcggacattctgcgacgccaacttttgctgcatcgcgtcactaacaatcaggaagcagtgctggttccgaggcgcaggaccgctgctggcgcgttcatcgtcccaatgcaaggagaggagggccctgcagacctccgatcccgtcgaggcgttacgtaccgcaggcaacgcatgcatgcatgcatgcatggcttcttcagttcaggcagggatggtcctgatcgtgatgcatatatggccgcgccgcccagcagtaatgatcttttctctctttctctctcttttttttctttttcatcggaagtagcacaaggaatcagttaaagttgttctttgcctttacaatttgcagtgtcggcggcttccacagttgaaataccgatcggtaaccgatggtgaggaccgccaaaatttcttgtacctctggttgcaggtggaaacgggttccagcaaaaaaaattcacaaatttcgtttcaaaattttaaatttcaaaaaaaaaactgggaaaatttctattaaaaactagacggtaccagaagtcagttcagaaatatattttttgttcaaaaaatcagcttttggcaaattaaacaaatcagaaacaaacattgccagtttaaaaaaaacaattcaaagctttttttcgttacaaatcaccaaaaactgctcagttttaccgatttttttcttaccaaatctcgttttttcaaattcgcaatcagaa

SEQ ID NO: 4682 - DNA, 1029 bp, Zea mays
  misc_feature (1)..(100): optimal_loci_164340_G1, chr4:198929409..198930437, Cluster 29
tattttattagaagaaaagataattattagtccacaaacacgtcgaggtacatggagccatgcaataaaattaagtggcaaggaccatgaagcatgggcagatcgatagggtttattggggtctgtcgaccccgacaaaaaaactcttcaataaattactgtcagaattttattaaaaaatcccatagtgaaccccgatgaggtttttgtctagactcaaagcatatgaaagcctttgctttcactgcccatgggtgcttagagaagttaaatgtcccggtttagttatgatcgataaataaaaaggagaaagatcattgcaaatacgattatctagtgccactaggtcatatttaacattgcatcgagtggagcggtacgatgcaagataaaacctttgaaaaatattttgagaatgctaactcattgctaaagggtgtgatggccaaccatagggatacctattggcattatctatttgaaaaggtttgaaattaaggagttgctcggtgtaggaattctaccctcaccggagtttaagtggctttggggttcgaatttagtctggtcacctgaacatggttttcagagctatttggacgtcatcgaaaagctgcagtggccatagagcttacaacacaaagcttacacggtggttttcaattgaggcaaactttgccttgtggtggtaatcggaaatggtgcatactttggagcttggttctgatggtaggcatgagaatttccaaaaacctccattggagccattggagcttagtacatgatttcacttctagagatagtgtttttgtgcgcacacagagctaagctcaatggatatgtttggtgatcaccggagtgctagcatcggggcatagagaccgtcaacccacccgtttttgacattgttagtgactgctgggtttactctagtggcaaattccaataaggccaccacatgttttcaatggtgccatagtgtgtccaataagtaggtaaaggttggtttcttgaaagggctataaataa

SEQ ID NO: 4683 - DNA, 1231 bp, Zea mays
  misc_feature (1)..(100): optimal_loci_16730_G1, chr1:92854860..92856090, Cluster 29
gttttggcaggtttcttgtacgcgcatgataaaccttgtgtgtcatgacgttgtttgactcaagcattatcggctctagacgacataagtgtggctttttgtcgtggttgttgcattgagttggaacagataatatatggggaaatgggaaaagaccggagaaaagcatgccaaaagatcaataattttgtggttggcagtaaagaattaggtgactgcgcttgtagtacggtggcacatgaaaacccactgaagaaatggcatgcaggaggtactgaaaatatcagtttcaattgttccctgttccacacgtccagtaataacagttctacgaccccgcacataaaacagactacttaaaaacatatgacaattctcctaataatttttttctttgataattgaatgggaaatactgctttggtatgcccaatataccatcagtaattcaattcatatttactttaagaacattacagcacaagaaagaaaaattaagggcaaaagctactgaaaatactttagaatttactttaagaacattacagcacaagaaaggaaatttaagcgtaaaagcttctgaaaatactttagaatactaaaaggaaaaaaatgttgcaaaacgagcacaagtataattcagcaaacaacttagtcagaaagaattggctacatgactcgatctgcaagctctataccaatgcagtagaaacatctactcaactatgtaaagattgtgttttctcagagcaagtatgaaaccggttagcctcaatcacttactaggtatttgtcaagactcaagacgagtctcttatcagctagtggaggaaatgtaggctaagaatcccaaagatagaagggaatttgatggctaatgtgttattttttatggaatatttagaaggaaagaaataaaataatttttcaacgttcaaaatgtcagtcactcaatattgcattcctcgtcaaagaagatgtggaccagttcaagttggcttcaggctcctagggcgtcagctggtgtttagtggtttattttgttttctatttctgttttgtaagaattttttctttgttggagtgaccacttgtctcgagctgagatgtctctgctagttgtattttgtttctgtttttatcccttctaataaaaatttcggcaactctcttatcgttctttaaaaaaaaattcagcaaacaatgtctactgaagtcattcactctttgg

SEQ ID NO: 4684 - DNA, 1375 bp, Zea mays
  misc_feature (1)..(100): optimal_loci_168236_G1, chr4:219828775..219830149, Cluster 29
agataatgagaaagagtgataccaaattactcgcccattttgccttatttggacttgtggagccgctctaaaagactctttaaattataaagatttgtcaagcctttctagctttaggaccactgaaccgagtcaacattgacttgataagggctttatgaacattgaactcctcttgatacatgcaagacaaatgaagtattttaatgtattagaatccaaaaacgaggaataaaagagaacttacttttcttcttcctcgtttctacaattttatcttccagttttgccttctcagtggctcgcagagccttgaccactttgaatccaatgccactagcctgtaagctgcatgcatgagtcaagtattaaaagcacagaggacttagaacaaaatcgagggctcaaatatgtaccttccaactcagtcatgtttttctcaagcttatcacgcaatgtcttgagcgagtccataaggttaggattatatttcttctcttgcttgaggttaagccgagtagtctcaactccttgtagttttgtttgcatcaacataagaagaggagacttttcctcttattcatttaagatctcctaaagggcaatattgtcaaaagcagaaatctagaaaaaatagtgacatgttaatatacagatgaagtcgagtaaacttggccacgtaatggagaaccttctagagttgttggcagtctttggtttattgatcatacccatgacatgttcatagattttttgggagagctcattgtgaccagtctccaagatgggttccctcacatctcgaaggacctcctcgattatggggtctacaaaagtctatcaattatgaatttttcaagaatatcttcaagatatcaatagagaaaggcaatcacctatgggttggttagcttctggcagtgccctgggtatgggtatcctcaacaaccaaactaggtctgcctacgcaaagagggaaggctacgggccccaccttcgaggcaggttaggttgacaagatcacccctctgaatggacaaggagaatacatgatcggaatccccgccatgtgtcgacccatggcccccctgccacgtacgccttcattaggcttccttctgcaatggccctcgctacctagtagcagggtccaattgcgacacgtggcctaatcgacccctactcatggtggggtttgatactgccatgtggcttcaaagtcccattagaggcctcataccccatccaagagggcttcgaaccccttagagggctttctacactaagtggctccatatgctctcgaaacttcatcaaggccctagaccccatggtaaactccttcatacgagcactccaccaattgctaggaagg

SEQ ID NO: 4685 - DNA, 1364 bp, Zea mays
  misc_feature (1)..(100): optimal_loci_170176_G1, chr4:228846678..228848041, Cluster 29
cggatattcggtaggtatattaatcacattatcttcttttgtgccaacattcaacacatagccgggcaacgagtgatcgatattcatagcgagagagtcaacaatcgaaagattggacaaaatatcgttctcggacatcatatttttcacttggaattatatcgtcccctccccacgactgtatctgctaccagtgacaatctagagaaaatataagggatgcatctctcttgtaggtatatagagatgagatgtaagtgatgcatatatgatgaaattttgactattataactgttttttatttcaagggtgtacgtgcacccaaaagctaccatgttgctttgccccatgtgtgatgccttaaaaactataggcagataataatcaatatgcatgaaaagccacttttaatataaaactatgtatgataaatgacaagtaagatggctagataatgggtgagtaggagtttgctaaaaactcttgcaagattggccactgtgccaacatcttccacaaaagcccaaactatatgtaaagtacatacaaattaactagagtatagcagcaagaaacataggaaaccacacaacagacacacactacagatgtttcgtgttctagcgtggatgttcacacgctagagtagagcaacaagaaacacgagaaaacacacaacaactaacacaaaccacaaatgttccacgttctagagtggaggttccacacgggcagttccaacaactcaaaccaaaagagaagagatgaaatctctaccaaatcgattcagattaagttcaaacttgccacacgagtttcttgtggtgttaagatgatatcctcaaagcaccaaacctaggaacaacttgaatcaatgaggatataagaaatcatcttcggtttgggggttttctcaatttgaatcaaagtgatgtaatttcgtgctcgtgagaaatctgccaaaaccacatggtagataagttccttacaggtcctagaacgaattcaactagctcaaacacccttaaaaatatggaacgagaaagccaccaaaatctcaagtgagggagaccaatagaggaaaaatcaaaactaatagaaacaaatgacaccgacacaaaaaattcagaggacaacttatttattgtagcaagaacaagtttgcacaaggtttggtcttacactgatgtacatagatatatgcatgaggctctcatgtgtgaatatcttgcagtatagaaaactagatctagtaacacctaaacaaaagcatagaaaataaaataataaagaggtagctagcttgggggcgattctcctcttatttataaagctattacacatgttcatgtccgccattaga

SEQ ID NO: 4686 - DNA, 1189 bp, Zea mays
  misc_feature (1)..(100): optimal_loci_172034_G1, chr4:239234280..239235468, Cluster 29
  modified_base (645)..(645): a, c, g, or t
  misc_feature (645)..(744): n is a, c, g, or t
  modified_base (646)..(646): a, c, g, or t
  modified_base (647)..(647): a, c, g, or t
  modified_base (648)..(648): a, c, g, or t
  modified_base (649)..(649): a, c, g, or t
  modified_base (650)..(650): a, c, g, or t
  modified_base (651)..(651): a, c, g, or t
  modified_base (652)..(652): a, c, g, or t
  modified_base (653)..(653): a, c, g, or t
  modified_base (654)..(654): a, c, g, or t
  modified_base (655)..(655): a, c, g, or t
  modified_base (656)..(656): a, c, g, or t
  modified_base (657)..(657): a, c, g, or t
  modified_base (658)..(658): a, c, g, or t
  modified_base (659)..(659): a, c, g, or t
  modified_base (660)..(660): a, c, g, or t
  modified_base (661)..(661): a, c, g, or t
  modified_base (662)..(662): a, c, g, or t
  modified_base (663)..(663): a, c, g, or t
  modified_base (664)..(664): a, c, g, or t
  modified_base (665)..(665): a, c, g, or t
  modified_base (666)..(666): a, c, g, or t
  modified_base (667)..(667): a, c, g, or t
  modified_base (668)..(668): a, c, g, or t
  modified_base (669)..(669): a, c, g, or t
  modified_base (670)..(670): a, c, g, or t
  modified_base (671)..(671): a, c, g, or t
  modified_base (672)..(672): a, c, g, or t
  modified_base (673)..(673): a, c, g, or t
  modified_base (674)..(674): a, c, g, or t
  modified_base (675)..(675): a, c, g, or t
  modified_base (676)..(676): a, c, g, or t
  modified_base (677)..(677): a, c, g, or t
  modified_base (678)..(678): a, c, g, or t
  modified_base (679)..(679): a, c, g, or t
  modified_base (680)..(680): a, c, g, or t
  modified_base (681)..(681): a, c, g, or t
  modified_base (682)..(682): a, c, g, or t
  modified_base (683)..(683): a, c, g, or t
  modified_base (684)..(684): a, c, g, or t
  modified_base (685)..(685): a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
aaatggtctatagctcgtgagatcatcgaatggccattgaagattgtcgtctgctccgaccgttgttgtaagaggctcttgtgattattcctcatgaaagttcacgaacaacgactctagtgaattttgtggattgttataaacaactatagttagaattgtgggttgttggagtgccttcttagcatagttcttgtgaaaccctcgctttttgcttggtgtgtgatgtcaattaacacatgaccaactagtttggactgaccacaatgagaatttagattgtcggtaagcaaccaaacctcgtgatatatatttgtgtcattccttgtcacatgtggttacactccttaatctcgcatttacatgtattatgtgctatacagttcttacttaactaacactatatgtattaaagttgctaataaatatccgttaatatctcgttccagtaagtagcctgcttcttttagtatttactaaatatcaagctactagaataatctagaggcttgcataaagtaaactagagctagagcgagtatatgctctcgtgacatctttgttactaacgaaattttgtcttagcaatatttgtgagtttttagagcaacatttataggttatgacgaatctctagataccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttggagtattggaatcgaactccttgattaggtggatacgttatgactagatggggcattgattagctcactaataacttcatgcatggatgcaaatgccagttttttccataattaagagatggaagctatgggagcatttgcatatttgtgttattataaatgcacaattaactaattgttacagactagtagtacaaagagaaccatccgcccatgaaaaggtacctaacagagttactacttagtagctctggtcttgtccaattgaatttatgcagaacaagttagcttttttgtcaggtccatgcttccctcatctgattatgggaccctctgggtgaacagttttgtagtgttgcttcttcagtggtcatgttatcacataatcaaaggccaagatccattgctttaaactgttttgcaacaatgccatatatac

SEQ ID NO: 4687 - DNA, 1115 bp, Zea mays
  misc_feature (1)..(100): optimal_loci_173102_G1, chr5:4141901..4143015, Cluster 29
ttgatgggtgtttagtacagttctgtccatgtcattgctgtttgtgtttttagttcagaacatatctgtagaagctttgcaggattgtggatagcattgccatctaattaatctgtggaataattcgttggtgaacatgcaagggttttggaattgaattgtgttcatattatggtcagatttgtcattgcccccgttacaggaatgagtttcctgttggttgtttatgatgtattttgtggctcatcatattctcttttatcaatctttgtactttgacacagatgcatttactttttttcgggtgacttaaaggcgaagctgatgcatgtttacattcattctactatctagctcagtgacctgatgataactttaaaggcgaagtcgatgcatgtttacgttcattctaccatctagcttagtgatctgatgacaacgttaaagatgaagttaatgcatgttcacaatcattctaaccatctagtttagtgacctgatgataactttaaaggcaaagtttgtatgtttacgttcattctaccatctaactatagtgaccatttgatcctccatgcatgcagaaaaaggatgctcccgccggtgagaagcgtgagcccgtgaaatcacacctccgcaacacgatcattgcgccaaagatgattgggagcatcgttcaacggcaaaaccttcaaccaggttgagatcaagccctagatgattggccactacctcgcagagttctccatctcgtacaagccagtgaagcacggtaggcccggtatcggtgctacccactcttcttggttcattcttctaaagtgagggctgaatatggctctcatcggttggatttttttccatgtagcatgggctgccaaattaaacccccctgtagacggactatgcaatgggtgtaccggtggtgaattcactgttatcttagtttatgacgagctattttgattgcatgaaagcttgcgtgttcgcttcgttgtctttaatacctgactgctgctgagtcgttcacattgcgtttgtgctactgaaacgcgagagtcaatagtgttttttatgaatgttagaactgcattaaatttttttttggcgaactt

SEQ ID NO: 4688 - DNA, 1096 bp, Zea mays
  misc_feature (1)..(100): optimal_loci_173460_G1, chr5:6337681..6338776, Cluster 29
attttctaagtataagctcaagagttcagcaaagacatcaacatattgaaatctacgattgctagctagcattgtgtgtcgagactggtgcagagctgagtcaacaatgtgttgatgcatcttcgctagcaaaaaaatatatattaagaaacaacacgacagtacaatttattttgttttttttgtataagaaacaacatgtggtggctagtactatcatatttatgccttctaatagccattggtacctttaaatgtttcatgggttcttgctcagatccaacataattcagaaatttgtgagaacagttaaccactgtgtgaatcatagtgtgaagacgaagcagagtgcctacctctacctgtacagtgcaattatatataatatatcatttgtactgacggttttaaaatacataatcattttatcctatggaagcttcatccatttttctatcagataacagcacaatgttatgggaaatagtattcacgattaatcttgtcttcatgcgcaacattaaccgactttgtttgcactaaaacagacagttgattgtacgagccttagacgaactcctgtctaggacctcctatttatggattgaatacgacctaacggtggttgatgcggtagtttcaccgccatttatattttatcgagagaaaaacgcattgctttccgcgttttaatcacggcaaaaaaaacctttgagttgaatgtgtgtgtgtgttttttttaataagagttcaacgtggcttgttttatatacggagcatccttgtgcacgcacacagtgcagctctgctggagaattccgcaacaaaagtcgtttccacacgactgtgcacgcgttgtcacctttctggatcaagcacatacgcgcgttgtcagtccattctgctccgcaccacggaatttctattccatgaaggcttgagtgcctgaaaacagcaagggatgtttcgggggaacaagtctactacagaaatgatcgttcatcctttcatccacgaaccaacactgacatagtgacagactaataacatccaccacactcaaataaatactaaacaaatacatttgcgcatgcga

SEQ ID NO: 4689 - DNA, 1330 bp, Zea mays
  misc_feature (1)..(100): optimal_loci_173599_G1, chr5:6941738..6943067, Cluster 29
tcggatgtttctatgcatatctatgttaaagtattagatttattatataattcgtatgttttagaaacatccctattttagaggataatggttggtacatgaaatttcctagggaaattaatgtagcgagtgatgtaaaatcgtcattgtggaaattttacctccgaaaatcctaaggaaattctagttctttgatttgataacatgtatgacaaataaacaacttgattgttgctcatcttgttttaagcattgatgtctaaacaatggaataggtctaggagggcagcttgggcagcacccaaaagcctgcccttgccaacactgcttattactcatccatgtttctttcatcgctagagtagtcaatcgaaagcctaacaggctgtgaggatggtgatagagggggcatctctttccgtggcgttcgattcatgttattcggtggagcttcacaatgcagtcgtgacttttcagccttgttgcaagggctgcaaggggtgacatttctacgagctcttcaaatgcgacctataataggctatccattgttgtgtcatctgtggtttataaggactatgacaaacgataggagtgagctctttgtagatagcggcttgcctcatccttttatcttgaagcttcatgggcgtgaagtgtagtgataatagcaaaactccttgtcttggtgcataaacaaggtgtcgcgacgtgttctagctagtgttaggcaggagggaggcgacacttgttgttcgatgcagagtagctagtgataggtaggagggatgcgacccttgttgttcgatgcatatacgagtgtatgataggtcacacatgctttgtgatcttgtgacaggtcacacatgtatatgatcttgtcggtgcggcaacaatctttttactctgtggtgaacttttgtgaccatttttttagcagtttgtctcacatgacactggcaagttggtgttgcaatggtgatccacatatatagcttttggaggtccaagtctgggaagtgggtgacttttaggcgaaagctttacatattgaaactagcaatggagacatcttcaatgtctccctgatcattggaggcattactttgagatcttgtacctctagggttttggtaaaaaaactcttgagttccttcgatgttggtgacatatgtggataccatttacttccttggaggcatcgccaccgtggttaccccacgtcctctagagctctttgccgatttgtcatggcttgcggggtcgcttgtttgttgttgctacggtggtttgtagatgatgtttttatcttggtggtcattgttgttac

SEQ ID NO: 4690 - DNA, 1348 bp, Zea mays
  misc_feature (1)..(100): optimal_loci_174710_G1, chr5:13819965..13821312, Cluster 29
gggggacgtgacaaagggcgctattcctacacatgatactgtacctgcacctgctttgtagggatccgtagacacgcatgaccattgattcaggtgcgcgcagatctacatcgttaagcattaaaacaccttgtcgtctcgatctgcaagaccgcaatcacttgggcatgcagtgccagtgctggcagcaatgcagcacccgtcctagcttcacccatttcttgctgtagctgtcagctgcaggggggagcaccaaatttaatactgatgcaccagcccttgactccttggcaataacccctgtgcagggggagaaaaaaggaaacccagaaagaagaaggccacatagtcaacgaaacatcggcaccttcataaaaataaaataaaaacttatatagcaaaatatctgtttttttcactctcttttaagtatttttgtgagattaactatactgtgaataatacaacagttttatttcagtccagctggacaaaagataggcaaaactcaaatcgagacattgttttaaaggaaaacgaagagataaagcacatccaacactaacagaccacagttttttttttctaacggtcaaaaacccgtcaggagaagacgaaaaaccaacacaaaatatatttctgacggccggcggtaaggtttttattactttccttcttctctgaccaacaggatctcattttcatattcagatgctgatgatttctgaaaattttagcattgagtttggaccaccactgatacttatcctgagaaagcattgccaaacccaccctaaatctattgcgaagggaacaattggcctctgtgcgcgtccgtccgcaagtacggaccagagggcccatctgtttaaggatccaataatagtcctcagctttgcgattgatctaggagaaatgatatggtatgaaagaaaacatcattcctccaatccgtctgaagtctgatgcatcacgcattgtctgaaggcttgaaacaaattaccaggtacaattaatcgtgtgtgcagtagactttacattccgtgatggtgaggtacgcagacagggcatttatttgttgatgtgcactctaaaccggcgtacagtatttctcttcctagttttggtattttagctggattgttttagatactgcatattgtgttttcctctgacacttatccaagaaaaaaaaatataagtatgacatggttcctactctttttaatcgaatcaaagtaacctatgcacaaaaaataaacagatctaacattccttatagaaaagatccaagcagataaacatagctccaggctccagcggttgatttgtacgcaatataatatat

SEQ ID NO: 4691 - DNA, 1053 bp, Zea mays
  misc_feature (1)..(100): optimal_loci_175491_G1, chr5:18206928..18207980, Cluster 29
ggccactatgattttcattaatcaccttcatgtggtatgatacaaactttgtgacatgttcttttatgagctcccatcttccttccaaattacacagagtccggattggacaagatggccccttgagcctcttgtattctctctattgctttccaaaatgaagccttcctctgccctgtacatgcttggtcataactttcattacaaattatttaattgatcaactacatctatgatgtgtcacaaaatataacatacaaaggaatataataacctataagtaagtctgtgctcacattaagccaacatgaaacaagtgtccagtctgaagatggagtcaatgtacagtgccactatcgtggtggagaaccacttccggaagaagccgctcgttcgctcggaattctccttcccgcggatgattggctaccacagtgcatccgggttcggagcacaccacacatatccgtagattgtttctctcctcatgttcgggcactagttacagggagtcgttggagagttttggacaacactgttcacattagacgttcgatatgggaagctttacaggcatacattagagacaaccttatagctgatttggtgaccacggaattggaggagatccattggggaggaatcccctttctagtcaattcgaataggaaggggatttctctcccatggatcccctccaattccatggtcaccaaatcagtacttagtaattgacaaacacaccacaaaggactctttctaaaaaaagagaactccaaaaccataagaatatgagattacttttcttcgtctcaatgaagttttgaatttttaggaaatagttcgttcactatactatatccacacgatactgttagctgattgtttggttggttttgatgtcacatatttttttcccagtaatgtcgtgtccaacgactgtatggattgctccccctatcttgctattacatatacgaataccccgatctgctccaacaactccccctcttcacagtgacggagaaaatcacctctgggggctcgttcggt

SEQ ID NO: 4692 - DNA, 1109 bp, Zea mays
  misc_feature (1)..(100): optimal_loci_176562_G1, chr5:23474943..23476051, Cluster 29
ggccttcacctgccagtctacctccactgcatttcatatcttaataaatacataacattgcctagattgtcctgtactggagcaaaaacacacacagccttttattgtttggatttctagaattattcgacaatataactgaactttaaatccattaatcaattagtggtttgattgctaaaaatcgagttggtgaaatttttctgtgtagattcctgtatgctactatggtttgtgaacatggttgcttcatacaatcaacacaactgcctctaactctaaggacataaatgcaggattaatggtggtatctgaattgaaataagctctcctgactgtgtatatgagaaactatgtacacaatttgaagtcatgattcactgcttcatgtacttaggaaaacagtagggagtctggtctttgtacttgctattatgtttttttttgcatgttaaaataccaaagtattattgggccatgaaatgcaaatactatcatttgtcttcccagatgaagttatactaagagataagttttttagttattcatctttcccatttatagcctcaaacactgctgtttttgaaaggcgaacactctttgattctgtgtcaggatacaattgtaaggtggtctgctgccaagggaattggtaggataactgcatgtttaacacctgcattgtcggaagatgtgctatcatcaatattgcaacttttttctcctggagaggtctgtgtataacttatggactttgcaacatcctttgattgtttaatgagatatctcggtttatcttaagcttggcaaacttctagtttgctcagctctgtatcactaataaaataacttatgccttttgaactttgaagggtgatggctcctggcatggaggctgtttagccttggctgaacttgctcggagagggttattgttaccttctagctttcctgatgttgttcctgttataataaaggtgaacaagtagcataatagtaccgaacgatatcctttcctttttttgcaatattgcttaacaaaacagaatatttctgaataggtagctcatgacctgtttccatgtcgttgattttgttagatgcctatg

SEQ ID NO: 4693 - DNA, 1140 bp, Zea mays
  misc_feature (1)..(100): optimal_loci_1814_G1, chr1:9227254..9228393, Cluster 29
aaccaccaccaccacattatattgctcttgctcgtagtatatatatgcatagataactctcgcgcactcggggctgcatgcatcgttggacagttgcggcaccagaactttcccgatccatccatcccacacgcagcaaaagatctggatccaccaccatcgcgtttgttttaatatatattatacgcgcgccagaatgctaattgtggcaacggccggcgtgctttgctttgggtttggtacaatcagtttgcctgacaaataatctatctgaataaacaaattaagggccagcagaggctgacggaggatgcgagtctatataggacggctcttggaaagaccaaagtctcgtcgagacgtactaatgctgcattattcattcgaccgaggattgggcaatgttgctttaatttgttgtacgtcctcttcgaccccggtcgatttctagaagggaaacatgcgtttgggaatgatgcatagacatcagcagacatgtggcagctactgaatgaatgagctccttaattggcgttggaagaagagaaggaagttaggaccgctcactggaattggaaggtgtgtggtcgtgaaagatgaaccgaaatgccgcgttggcctcacttcgttcgtaatgcatgccaaaattcgtcttgttcgtttaggtatggtcaaaaatcgtctgccaccgcgcacgcctatttcgtttaggttacaaagatgatcattatagaccaccagtggggatctttaattcctagcttgtgcagtttttgctacttctttaattattcttttgaatggtgttgtgttttatcttatacgtacgtgtggatatttaagacaagatattatctacacattatcttagcatatatccggataacaaaaaccgttcgcgtagacatgtatagttcgctaagaaattaccacacatcgatcaattgaagaaacggaaataataaaggcatccttctgatgctcattttgattttgctagctagtatatgttaataaaaatcacaatatgaattgttttataacacaaggaggctttaatggtctcgtttggttctgcgtatagtcagatttagggtgaaacaagaaatagattcattcctatcaagcatctaccttttt

SEQ ID NO: 4694 - DNA, 1015 bp, Zea mays
  misc_feature (1)..(100): optimal_loci_182959_G1, chr5:60937585..60938599, Cluster 29
taaatataaagtacagagcgtcggttcaacagctcccatgggaagtcgtctaatatgacaactcctatgggagaccgtctaataggaccatgggtctggggtgtgattagatcctaaatccgtcgttccacatgtataagaggcaacgatagcatgtgtataaccaaaggacccgccgcatattctctacttcataaaacatcactttctacatggttctatggtcaccatgttccgcatatgtgttttaataaaataaaattcgctcatacaatatataaaatctgtagtaatgcacgagcatgtgattagtgtttttttggatgggattacctttaaattcacacccatgcaatgcacaaccacatgaccgcatagagttgtctcatcagcgagatttccttatttttaattcctctccggttttgggttttctaaaattctaactaattaatatccactatacctacttctttttgtactaacggtttgtataccaggctgcactagtagtatgtgtgtagacatgggacttagggaaccaaaggacccatcatatcttctctactatatataaaacatcagttctaacgattttattgttcaacagtcattctcttactatatataaaacatcagttctaacgattttattgttcaacagtcattctcttcgttgccgctttatgcaaaaggtaagataaaaattggttgttggatctacactcatatctacctaaccaacataacatatattgttttacgttttattataacaaagtccatcatataaaatacgtagtaatgcatgtacatctgattagcaatgaaggtagaaaagaagttaagcagagacagaggaagaagatgatgacttgatgagtccctagtaatgcacgacatctgactagaaatgtatggagagtgtacgtgtgcgtactacctacttggccttggccggccttcacaagtctacgcctgtgctatacggtgggtcagttagtacacctaccgt

SEQ ID NO: 4695 - DNA, 1153 bp, Zea mays
  misc_feature (1)..(100): optimal_loci_195101_G1, chr5:146387353..146388505, Cluster 29
attgtcatgtactcttacatggaacttatgctttcatgtctatttactatttcttttatgcatatactatttgtagtgtagctcatattatagtcttgatgagcttgcgtatatggcgtaagccttttgggtgtgggcatgtagaaacatgagaaaaacatgaccatagtagcatgtttagggcgacttaggtttttccatgtgaaactagataaggcctagtttaaaaaactgattaatgatccaattgaatcccctctctctaagtgttcagaatatagtgtccctacattttggagggaacttatcataccttttactctctctctctctctcccctcccacacaatctcaatcaacatcactctctcccctctttatttctctctcacatagaatggtatcaagggtagcatggtgcttaggtgtctacacgtgggaagaacaataactcggtatgggatgagcaaagcaggggtagcacaggaatgcacatgtttggatatgtaggagcaaggtgatgactagtggtatacctattagggtgattgaatgtgtatgtggtccaatagatttagcaatgaccatagtgaagatgagataaaggggtgtagctgctatgaagatgatgacacaacaaatacaataacaggatagtcagcaaatagatgtggaggtaagcaattggtgaagtggcacgagtatgatgttgtggcgtgtggatgaaaatgagaaagtggcagtagttggtgtacatgtttaggggtcacaaggttgcatgtggtcgttgtggcttgcttttttgtgagacaaaaagcaaaggagctagatgtgtgtgcatgtgtgtgttggtggaggggtatgcaatagcacaaagcagagagccagacaatccaaggatgttgtggttaccaaccatatatagagaggagcgtgtgacgatggttgatgactcatccataagtactcaagaataagacaagtctagtggtgttggtatgtggtgctataatttggtaagaaagttagggaggcaggagctgacctatagataggcaaggaaggttgatgcttccttgaggaggaggtagaagttcacaagtgggcctctttggcacatgtatgccacatttgtgaaaccatctttacccta

SEQ ID NO: 4696 - DNA, 1300 bp, Zea mays
  misc_feature (1)..(100): optimal_loci_195115_G1, chr5:146421565..146422864, Cluster 29
aagactatgtgaccaaggggagaaaactattaaccatctgcacctctcttgtttcttcactagagaggtttggttcaagatttttaggctctatggattgcatctcctttgcccctaaacctgaagacatctccttcttctattggtgagcacaagctgaagaaagaatagaggggctgactagaagggtttcaattggactatttggaagatgcgcaatgaatgtgtttttagggcctttccccttcaatggctactattttttcctgtttctgtgaagagacagatttatggttgttgtgtggtgccaaaggtcttttgttcctatcagctagtgtttttatggacctttttgtgtattctaagttctggccacaatgagttggccctagagttaaggacataggtctattagagactctataatgttgtttttatttattctaatgatttgcagctcttgggtatttttgagaaaaaagtaactataccttattaacgttggttttggtagctgacgtaaaaaatttagtatttacgacgatttctatctggataacgtaaatattatttatgccgggtacctatggctgatgtagattacttatctacagtagctagccgatgtaaataatcctatttatgatgctttattagtgatgattgcaaaccgacataaataataaaaaatgacgtaaataactatttacgacgttgttagccatatttaaaatggttctcggccaaaatagattggccaaattcatgttgtgtggggaattagtgtttcaaacagtaaggaaagacaatgatctttgagggccaagggtttctggaggagtggagggtgactaacaaacaaagagacaaaagccttcggagaagagttagcgcattatggtggcaacaaatgtgttacatgtaaacacaagatttgttgagaccattggaaatagatgtgaaggacaccatagcatgttgagaatgtcaagagaagacttgtgggcatgtacaaagacccctagaggcatgatttcagggacaaagttgtgtttagatctgatagaaagtcaaaaaggccagggaataatctaataatattccatacggtagacatctacctaggcgcattttgtaacttcacgagtaacttatccataaatagtagtagatgaatagtcccatggcctttatatcaaaaagatccctccaaaggtattattttcatttatttattctataaatgtttttatataggttattccatcatttaccttcttctttaatcaaatgcttgtta

SEQ ID NO: 4697 - DNA, 1121 bp, Zea mays
  misc_feature (1)..(100): optimal_loci_195118_G1, chr5:146425877..146426997, Cluster 29
atgccgacaatagtagtgtccaatctagtgacccaactactaagttcaaatgtatcaacctacctcagaacttgtgtaggactgtcttgtatcattgcataactttgtctcaatggattcccttaggtcctcttgatatatagctttttcaatatccaagactgttaaggcataactctgtccaatcacaaacctatcacaaaaacacaacttttgtttacattgccataataggaactaagaataatgcaattatgcttttagcttaacatctcttgtgggggtaatcttgcctccccactaaaaatgataaagtccaagttgagaaattcatatatagttggagtttaacgttgccaatccaactatagatttaggaaatcattggccatgaaactactaatattgatcaatttaatccattaagatggctttagatatggttttgctaatgtggttgacatgtaagtgtgtgtcaaaaatggccttaccaacaatatttctaggtgactttagtgattgaatgccaacacggctagctaaatgggtgtgttaaccatgtgatttgtaggatcataatagggatgaagttaaaagagaagtcacaaagaattagcatgaatgaagctaaacaagtttaaatgagagtgtaacaccaaatattcttataagttataaaatattctcatcacagtgctaacgaaataccttagcaatggatgctagaattgaagaacatgtgaaaaaggacccattgaagtatttaggacaagaatttaagaggagaacagatgatattattcgattaaccggcaataaacaaaatatttgtatgagtgtttaatagtagtattcgagaagcagaagcctccttgaatagtccaagtatggataagtgtgcatgttagactaacaccaaacttgttttatagagatgcatgcatggtagaatctccactcatttggactcataagttagtccatctataattgaagttgaatgagacttttgtgaatggtctaatgttagctccattttcttattgtgaaaaaataatgaactagaagattttaggttcaggataaacagagaacctaatgattcaaaaatgttagattca

SEQ ID NO: 4698 - DNA, 1162 bp, Zea mays
  misc_feature (1)..(100): optimal_loci_195885_G1, chr5:150608771..150609932, Cluster 29
tcttttggtcactatggtggggttaagtcttctagggtgtttactacctcattagaagtatgatccttagtttttggaggcttttgctatgttttatccacatgcgataatggtccaagtggtgtgagttttgttaatacttctagctaacacctaaggtgttacaccttgcacattagtggtcggacataaccgtagaggaaatgcatcaaagcaagcaccggcaggcaacttttaacaattctcctttcaaaagaatttttttaacaattcccactttcatggatgttaggacagatgacaatttcatttcagattatctctgctctcacacatgcagggcattggttgatcactgttgatgcatatgtatatatagggtagattctgattaaattcggttaggtggttagtgtactagtacagccgtcactatcaacaccacatatacaagcaagctactccgaatttaatcaacagagagtatatattttggcaaaattgtgcatgcattcctagcttctacacatcacagagacacttgatcgcgcgattatcttgatcaatttggtgtcgctttgattgtttttaaaactttctggcttcgagcagatcaacttcgtgccaatttttcaaataaaactttctggcttcttcccacagcagatcagttgcaaaatacgcatgcacgcatctaaatcttactctgacttataccgtaacacacgctgaaatatctacaaaatatactaccggcctttacatatctgctaattgtgctgtgcgccaaaaattttgcatctgtttcatatctttttatttttctacaaactaattgtgcatctgccactagagtgcgcagatcctttctgaaagatttgtccttaataatcaaccagagccatgagtttcatatctttttatttttactaagtggggccgacttgagtgtgtgctgacaactgtcatcacacaatcatgccgttgtgaacaagctactaaaaggaaacaggccaaattaattgtcccacttgtgcaagcaccggcaagagtcaataattctcacagggaatattcgcgtgtatcaaaacgacccttactagttactactgcttagacaaacgtaagagtaataagtactccaattaatgtttcatctcta

SEQ ID NO: 4699 - DNA, 1151 bp, Zea mays
  misc_feature (1)..(100): optimal_loci_196799_G1, chr5:155102379..155103529, Cluster 29
tccagggctttcttttcctttctcctccaactgaacgacggaccctagttaccagatgctttttccccagcgcgctcgctgaccaatgggcccagggaccggggatctaatcctcgacatatgtgataatttgtattatcataagtgaattgaatccagtaaatacaatatgcagataaatgaattgaacaaatatcacaaccctacattgattcataacacattttgtagtcaatctccattcaacaatagttttctagcaataatatcagtcatacatacaactagctaatttatacatcaacgtatcaacctcactcatacatcatatcctaaagtatgaaatagtttgcactctgaaagaaaacataattgatagtttgtaaccataacaaaatcgattattattaggaaaattatttaagtgtgtcatagttaacatatacacacatgaatgcgtccaaacaatagcataatatatcatatagtacaatattttcaagatatattccactaaaggttgtacaaaaaattaaattccaataaatgtaggtgatctactccctctcatatccactttaattgtattaataatcttttgtgagagaagacgaaaatgttacactactaataatagaagatcacttatatgtgcttttaggggatgagaataagaagtatgttggagatgctctaacatgttccttattaaaatgtgtccccacatccattatttattgcttatgtcaattcttaaaagaagcatcctcacaaaaaggttctgaagtagttaagatgatttttataagggctttatgacacctccccattttggtcattaagctacattgcgttcttcaaatcatcataaacaaagtgaattattgacaaatacctccgtagtcatgagaaaatcatcatagaaggctagatctcatgtatatgttattatatttttaccatttgctataagaatattagattaaggttaataatacaacgtgacaaccctctattggttgtacataaacttacatctaatccatcagcccattcatgtagtatttagctcacctatgaagaccttgtttctctcataaaatttcctagttcttgtgaataaggtgacccacatattaaatgagcatgtt

SEQ ID NO: 4700 - DNA, 1054 bp, Zea mays
  misc_feature (1)..(100): optimal_loci_196884_G1, chr5:155411629..155412682, Cluster 29
atctattgaacaccacaattttttgggtatgcacaacgccacgtgtgggttacccaacccaccccaaatgggtatgggttctgatggacgtgatctcatagatattagaaacctttattagatcaacttactagagaaatttctagataccaattgataatatttctagatgtcacttgaggacattgttggggagaaggtccatgttaacagaagtcattgttcaaaaccttttttctcaagtgaaatgcttcaatcaaggatgaagtttggacaatggaacaaaactgaagcttcaggcatgagcacgatgccaaagattgcaccaaggcaaaggaaagggagccagagcttaggcattgcatttgaagatggtttagatgaagaatgtttcgcggaataagataagatgtacatggcatgatagtggtgtaaatgaaataattgtattttgtcgattaggaagggctattgtgcaataggaagggtagaattgtaatttaatatgaaggtgtatactggcttgaccagatgaacaatgtcattgctatagacatcgaccattttgttatcttgcacttatagctcctttctcgcgagagaacttctaaaggtgagatgtcggaccttatttgaatagccccttttgtctattatatgatgcccaaagtagcctatccattaatcttgatcatggtgtatataatactatttgctaatgttgattgccttacatgatgttgatctaaacatttaaccttactctttgttcatgatttgagtattcttcatacatgtgaaaagtagtatcaccttccttcccttcagcttctacgaaggcgagaagggatgagcgaaacaacagagcaatcattcacatgcaattaaaactaaccttcgcaagtagactatctaatggctccaaagttctcaatatttaccccttcatacatgttagtgatggacaatgaagctttgtttcgtcccttcttccctcctttggagagagaagaagggtccttaatttaatggtgtttccctatagcaacaatgc

SEQ ID NO: 4701 - DNA, 1141 bp, Zea mays
  misc_feature (1)..(100): optimal_loci_19848_G1, chr1:112616488..112617628, Cluster 29
ttttagaaaggagggagtattatcttacagtacaatacgtgtgtaattcaagaacaaacaagatgttactttgcatgtcttttataatggtattatggcatatgtgagcaatttaaaaacagactagatgtttcattgcattatctttcatataaagttatatgtgggtaatttatatgcacatttgggatattatttttaattatatatagtaatggcatgtggataattcagatgcaagtgttgtaggttttttaaattatctttaataatggtagaagtgatgagtaatttcgtctcagagctatttgtcgataattttttagaaaaaaaaatatatccagtggatgtttgtttaacagtcatgatttgggtctatcaaactaaaggtaaaatatttataaatcttgtgagaatttttagtatttatatttatcctagcattggaggagagatgatgcatatgcaaatttatccaacagatcatgcctatgcaaatttatgcaatgggggatagatggtggacaaatttgcataacaatatctcttctgtatgcgtttttccctcttgcgaatacatggcctgtcgttggagacaggctaaggtattgatagaacaaatcagaactgcctctagctagggtctcaggctatctgatggctcgtcccttctccggtcttttctcaaacagctgagctgagcctacatgcatgtgtatgctcatctagatgaaccaaacagcgagagctgagaagacttggaccaatgcaataccgacagcatatgtgacttaatctcgatgtgtttcacaaggacatgaagcgggtccggtttaaaagttgatatgtatgttgttcctaaagtgacttgatatagctttgctaacataaacactgtacgctcggacttaaagcttagtcagcatacattctgttttttttctttttcggcaaaagaagcttttattactttctcaacttcttgcaacacactttgacttcaacaagatattttatctaagaatacgatggaaaaccaaaacataactttttttatatagttcttgtttgagaaattttattatatttgaatattatagttcatatatgttttctacatgtttaagcaacacaatgctta

SEQ ID NO: 4702 - DNA, 1198 bp, Zea mays
  misc_feature (1)..(100): optimal_loci_198567_G1, chr5:165644645..165645842, Cluster 29
agtttgagcagcaactcatgtttgcttagaaccaggaagcgacctcaacaaagtagagtcaaggtcaaggagtgagccacacctgttgtggccatggacgaggctcgaccagaaggcaccacaagtgtttgagagtctcagtcatgacctcaagttgtagattgatgaggccaacaacttgatcactgatatgtaagctcatatcgatcaatgagctacaacaagagggagacgacgactatggatgggaatacgttctacagctagaagaggagatggagcccatggaccagagtgaattggagcataaatatttaccaccaagttgactcgagtgaatatgactctagaaggttctagtatgcttgtggtatgtggagatattggacaatagctaaatatgtctgaagttaaccataatcgttggaagttgaatgctaaccatactctaactttcgacagaagataggttccagaagaaatgggatgaaagttataacttctaacaactgttgttggaagttactaacttccaccgacctaagagagccaccataagttaatatggtcggaccactaactttcaatgcatggtggcatcgtcggaagttaggattaactccaacaacccaccataatcatcaaaagttacatatcctatatgaacttatgattccttggaatgaccttagtggacatctcagactataacaagggacataagaagcaattaagacctaggctataaataaaatgtccacacaattctagagctataaggagaagttttataatgaatatgtcaagaaggatcatactttgactttcattgccaattacaaaaaggttaagggaccactagaaagattttgtgaggtataagactccagaagagggtgaggcacaagtgagacgaaatcaagagaatgcgagacaaaagtaataccatcatggattaggagcaaataaatacaagagttccattcctaagtgggaaattatggagagaactaatttctgaagcggtcagacttgctacattggattgacctaaacgctcaaagaagtgtttttatgggaatgaggaaacactttccccaacgaccatgagtgtattttggggaaaaatctaagaaatgacacaaatacttcaagcattataaacatttatgctaaattttagtccctatctaatcta

SEQ ID NO: 4703 - DNA, 1145 bp, Zea mays
  misc_feature (1)..(100): optimal_loci_199110_G1, chr5:168846417..168847561, Cluster 29
ttaggtattccaatttatcttgcgacggatgctacaaaatcaaaatgcacgcatctcaaaaacaccgcgaaaacccaatattccagtgaccagtgtgtgtgtgtgtttttttaggatagatacatataacttgactaattatcggctcaaacctgtgaaaatacatcttgttaataattatttaaattggagtcagagaatatttgtcttagatgaacattggccatcaacataaatgagttgctgaaagtaatgtctttggactagttttgtagctagctagtacgattaattaaatataggcaactaaagtttagatgagtaaccttagatcgcgtgtgctgtaaacatatggactaatactaagagagactaacaactaatttgactggattaaacataacagtccatcttttaatgaatatccatgacttagatgcaacaactaatatgcaatcagaccttatacgcaagctcgctttgcacactttgcgcataaggccggattgcagtgacctagctaaatatatatacaccacttaccaatttaccatcaacataaatctgaattgaattacaacacagagtaacattttaatgccatgcgaattaaaatcaggtcaaaaggccggtgtgacaatgaagcagagaggacggggggtttgaataccccaaactgatgaagagtaacattttaatgctttgcacgcatgcatgttccgtcggagtatatatcaatacttgaatataataataatagcaccaagtattcaagtggtgtcgcagaagagttcagtgctactgctacatcggctaggctacacacaccaggtagctcatcccccttgttggtaccaagctagcagcatcatatacttggcatgcactgcagagctgagtagctacggcttgaccgtgcattggagctgcccgagacccggccacgttcggcttgcgtagcagagatatataattggtgatctatctaggcggatctgctcctccatcctgctgtccatgataattcttcctgcatcatgctgcctgacacggggcctcatgcatgcacacgctgatggctggttaatttttctcgctcgcccgtacgttggatcgagctggtacgtactacggtgcccaaccgg

SEQ ID NO: 4704 - DNA, 1031 bp, Zea mays
  misc_feature (1)..(100): optimal_loci_200594_G1, chr5:177245829..177246859, Cluster 29
tttaaatagtatatcaaatttcatttttttgtaaaaaatacaaaaccacctttaaaaccagcacaaagaccagatttatcctatttcgataattggagagtgtcacccttaattatgtttatcatcaagtcaaatgtatcatgctttgagagaacaacagtgatttaacatgcctgcccccaccctcctctccaatattcgaacttccaagacacacatatcatatacatttagaacataaaaaaacaaatttttgcatcatgcactatataaacactttttccctttcgaagttacatgctggatctctgatgtcatggcactatatagaatcaaattctcatgtacccatatttatgattatataattaagagaaatattcaaatatatgaaatgtactagcgtttattctttgtattaatgctacataaatagctagcctgtaccaacaaaaaattctgtgtgttctacatgactacatgaggtacacatagtcaacaggtacagctaattctttaacaagtcctatcagaagtaacgttggttgaaaaatcaatataccatctttgttattaggaagagcaatgaaggtatacccagcaagcataatatagctggactcaaaaaacgtggatcacgaatacatacaataccatgcaatacacaacaacttatttgccacattcgcctcaacgaaagggtcgcctgcaaacactaccaggaataatgccacatccacggtggccgatgctgacgatataaactctcacccgatttaacacatccctaagaataatgctatgcggcagcgtgtgatatgccctaaaagagggtttccataaatcaacgaaaaaaatgagaaaacgtttctagacccaccacatgtatatatatcacccatctatctaaaaggcaaaaagaaaagttggtttcccgcacgctcctaattcctaaatcgtgaaagcacattaccataaatctggtgctgtgaaactgaaatcccggtctaaacatcaagaaggcaatgcaa

SEQ ID NO: 4705 - DNA, 1257 bp, Zea mays
  misc_feature (1)..(100): optimal_loci_200751_G1, chr5:177763061..177764317, Cluster 29
atcaaccagaatcctggaggagaaagcaagagggagaatcttcctaaaaaagaggtatctcagaacattgttcttgatcgccctagttgctctttctatcatcttaacaatcacttcactagagaatgcagacacagttttccttgtgaaatctgtggttgtgatgatcatgtaatttatcagtgcaagagatgtgttccctggaatatgggctccgaattatgtgctacacaagtagaagaccaaagttttttcttcattgatgaatcaattgataatagaatgataaaggaaaaatctagtacaactgtgatctatgtagtctaaggggaagttggagaaaaagaaattgagcttgaatttcctagagactattcactccatctaggcattgaacttatcctttcagtgtccctagataatgacctatctagcatgagctcgagactttactgagagagaaagggagaaagggttttgagaaaacattgtagtagcccttcactggccctttcagtatccctagataatgacatatatatcatgacctcgagactttagtgagagagaaaggaagaaagggttttgagaaaacattgtagtagcccctttatttgagggatttaggtgagtttctgagggattaagaaaaatatttaggaaaagggatctgttggatctatgtttttgcatcttagactcctttatgcaagaatatagggaaataaggtttcttttgttaatctagtgaagtttttgtaaatttagaattgatgcctagttaggaggttgccacaatgaaccaaacaagccacctacacataatgacatgatgttgtactaatgatatccatgatcagtcatggaaaagacttgcttgattttttagtttcatgttttactgtctaggccctatccactaagggctaagctaagtaggaaataaaaatcttcattcgcctaattctctattagagttatgtgtagctaaaatttattctctaggaccgcattggataaattttttgtataaagcgactttgcatagaaagtgcatcatgataagctattttccaattcacaatctcttaattaatttaagaaaataacctcacacaaagagcatagaattgctatttagtaaagcagttattaaacctaaaagatgaccatttaattactatttagtagaaaaaatgttggcaagatacacctagatccaatgtagaggatgttatgagaattcaactagagaca

SEQ ID NO: 4706 - DNA, 1156 bp, Zea mays
  misc_feature (1)..(100): optimal_loci_200835_G1, chr5:178358389..178359544, Cluster 29
ggacgtgcaatgtatggcgggagatatatgagctccggtctggagagctgagtggacaagtgggaaaggagcgccaagtgtggagaagcttctattggagctctggaagtgtcttgaagcccaaatttcacaggcaaggacaccggacagcgacagcgtttatgtccactctcttcggtcaaagtacgtaaatgcccctcacgtcacgtggaccacaccatggcatacagtcgcgtctagtaccgtcgtcattcaaggctcggcccgattctgcttcgtccactaaacgcatcgagtaggccgggccggggaaggtaagaaagcagcccataatatatccacgcgaccacgccgtctatttgtgtagcaagcgtggccgactacgagcttgggccgaatagagagaccccgtgtggacaggataagttgcggtgaggcattggtggtgcggtacgcaatcaagaggaggatgagaggctatctatataacgaggggaaggtaagaatacatccgtgccaataagttaaaaataaataatcataatcttaaattttaatttcatctaatattaaaaactaattatattactatataatttagtgttttcagtaaataatttgctttctaagacttctaacaaatcagaataaatatattaagatataaaatatagtattaatatttttctcaaattttaatccattttattatttaaaatatatttagtataaataaaatgttcttgcgacaatattctaatttgtataagattttaatttgcttttagtatgttattgtttctttatttttaagtcttgtttgtttagttaaaattgaatctcattctatcaaataaattcaattaaaattaaataacttaaactcaaatttattatattttttcaacgtgcaaaaaaaataattgttagaattagattctaaatattgtttagatgataaaaaattcaaatataatatgacactagcaaaacacttactctctctcgccccattaaattctctatattcaaaaccaatacaacaaataaacatgtcatataacatctaacagttagttaccaattgaaatcaaaattcatttaacaataaaaagagagcacatgaatagtttacaacaatcgatcccgtatcatt

SEQ ID NO: 4707 - DNA, 1234 bp, Zea mays
  misc_feature (1)..(100): optimal_loci_201194_G1, chr5:180570374..180571607, Cluster 29
ctgttaaagctccagaatgttccattaaaacatggcacacataatgttttgatgaaactctagtctcgataggtcattccatagatgatgtgcggtgttggcagatgctttgtgaaagaaagtatgtaacttgtgcatattttctgtctctatgtgttcttacggacaattttttgtattgattgacgatccatcaatacacttccactgtagaattattcaaggcttatatggctttcatccaacattcatagtagctttgtatatttattgtggatgttgtatatacatgacatatgcaatctttgcacacttatttaattatgggactaccattgctcaaaatcttcattttttccatttgttgttttgatttctaattcatgtgtttcttttcttttgtagggtgagcgccatgctttgccttagagatcaggcaccaaagtaggtgtggttggacatgtccaacaatcctcacacccatgacgatgatgatctcaaggatgggtatcacacaccacagaagaaggaaccacacaataaataattcaagagctccaagtctctaactccgcctacaaagttagatgacgacgaggatcctttggatgagaaggagtaaaatagtgatgatgatgatatcgacaacaacttaggagtgatggtgatgatagtccaatggatgatgatggtaatgatgaggagggtgtttgtgtttggtacaaatgagaaggtactagtgggagacatgagaatttcacaaggcttccaatgctaggcactatgctagggataaggattcttctacatgacacttccattcatttcatcaatattggatgttctagggtgtgttcattgagaggcccattctggtaaagcaacaacagatcatcttgtcctatttggagaagtttccatagatggcaatcttggtacatgcttttaggtcattggatggagagaggctatggatttttggcagaattagaatgagtgggtggttcgacatttatgtcactttggaggtgaagatggacaaggtgaagttgtcatgtatgattggtacaaagaggttcatggtgatgtttgaggagccaacaatagctagcaagtttgactctcttgagataaataggggttgtgatgacgatcacaaccttgcaatcggacgagactcacattttctgccctaggataggtcatatgcatggggctaactatggtttgagga

SEQ ID NO: 4708 - DNA, 1362 bp, Zea mays
  misc_feature (1)..(100): optimal_loci_202131_G1, chr5:186244975..186246336, Cluster 29
attacgatgtgttacaagggaagtacccttgtctctctttatacagtacagtgggcagacatacaagtcgagtactagttgactaaaacataagacttctaatcctatttagaaatagtctttcttttaacccgactagatcaatagcttcttaccttagagaacatgtcatcatgttctgtgtctttagatagcttcatgcactggctcatctacttaccatgtcgtcagtcttataggggactcttaggatatgagatcctcaagctcttcatggtttaactttgaaagtcttattgaatctctagtttactgccaagtagaatcaaacgacatttgagtactcttcttaagagaagccatgaagtgttctttggatcttcctctagtagtgtgtgctttcttgcacatccattcggtgtagccatcgagcctcttactgtttagcacaaaacatggaggtcttctctacaaatcttcctatccccaaagaatattctcaacatattttaaagttatctgaccaggatatatccgccccatgagcctaaaaccgactatgttgtagtcgattaaagggtcttgtacatccttagcaaattggccaagtaatccacgagacaatggcaaggatccacttatcatcaggtggttttgttgctttctatagtcatatttgtgcattgtccttcccttatccctaccaaaagcaaaagcatgcaagtcaaaataaagttgatgacttttgatgttgaccgctctgtaaaacttgccatccaatatgtgcctggaacttcacatgtccattgtttattatcatcttgtgtgagtgttgggatataaataccatatgatgagcttaatgcatatatcagtggtagccataatccatagttggcttatagcttggtcttctcaatcttgaatatgatagtcttagtgatccctaagcccctcaataagtataatcaagtcctaattatggggtttaatgataatgaccatgtaattaaagaactaatgtgatttgttgagtgtaatgataggacaaagaaaaacagaagaagacattaatagtggtggaatccccaaatctgatacgaagtttataattatgtttacatttttaaattatgcatatgtatgttgtattatcaatgggaattcaatctacatgtttgcttgcaagaacaatgttcatattccacatgcatattccataacgcctagaaacctacccttaaaattttagacacatttggatttctgagcttatgtggcactgttgcaccatggcactaccactcgtcacctagtagtgctagacattaaagtagctattcgggcttgtaagtgtattta

SEQ ID NO: 4709 - DNA, 1315 bp, Zea mays
  misc_feature (1)..(100): optimal_loci_203335_G1, chr5:192883437..192884751, Cluster 29
gattactccagtgaaggatgatttagaatgtctaagaggttgtgtcatctgcaagtgctgcttgatcctagccagtacatgtagcccttattaaccttttatcttaattgcataagtggtgacccttccattttgtaacaaaaaaggggcagcctacaaggtttcaagggtttacaaggctcaagtaatgtgtaacctcttgtactaactttaagagttagcttgttccacatatgtgcacagcaaactggatgagatacaccaacaagataaaacctaggattatgctttattatttcacgattttaacaggtaccaaaacaggaacaataactctatacagattcattagatgaaaaagaaaataagagtcaaaaggttaggatccagcaacagcaaaatataacaccacaacacaaattccttggtggcgcaccacatgtaaaatataaaaaatttcaattgcatgtatgaatattgaataacattcgcaaaagaagtaacacctgaacttgaagctcctgggcagaaaaattaagcagactacccagtaatctcctcttgaaaattggtaatgcttcttcacgccttaaaaagaacaaaatagcacaagatatcaccaacctggtattgtcattacatacttcttaacagaataggaatatgaaaatcaagaaaaaagctatcagcttgaatttgatctaagggaaaaatacatgtgcactcttgggggaacaaaaaaaaacatgataaccgataaaccacaaaaactacatgcctagaagattaaagaaaaagcgcagggtgcagaaactacataattaactagaaaacttggtaagcatcttattgtttacctaattctttggtcaccggtgctagttcctccaaccattgaaagccattctgcacaatgtattgttgcctctacgtcctgaaatattgccacattacaaaaagtatgaggctacaacaaagtaatatctcaaataagagagagtgatcccaagcagaagataccgcaaaaaggaagtttggctctataaaatatgttactttctgatagaaacaaataccaaaatatctcaccttccacccatctttttttcgcattgaatgctgcagcacaacaagtagaagattgtgtactacgtcttcaacctcacatatgcttataccatctgaatctttgttgtcccccatctgcacaccagtttatacatcagaatctacagaagtgaacagacaaaaatggagaaagtagagaatacaactgtgaactgtggactcttaatgtaagagcattacaaaaaaa

SEQ ID NO: 4710 - DNA, 1162 bp, Zea mays
  misc_feature (1)..(100): optimal_loci_204093_G1, chr5:196921517..196922678, Cluster 29
tattattgacacttattaggccaactacgaaagctctccttaaacctccctcaaccgaacataggcggagctttagggggattttgtctccaacagctcttcctatttacagggagacaagaatctctctgtgtatatagggggatcactatgctcctatatatgttaattaacatgtatgtaaccctaattaatccatgtgacatgatagcaatatctattatggtaatacaaacactgtacatttttttaaaaaaataaaattaataaatatgtgttaattacctaagttatagtgtgtaggggattgttaaagacgaactgaatgtaggaaaagagtattttaaaatatataataaaatatattagatatagtacaaataaggagagatgtatagaagaaattatcggagagagcctcatgctgcaaccattgcacctccggcactggttggtggcccatggggtccacctatccaccacagccacaaaggacacaagctgacaagcccacagccatcagccgtagtagcttagtagcagcagggttcgtcatttcgtttttactgtaacgaatttagtttttccctctaaagtttgacttttatatttttgaatatagaactgaaatctaccaaaaaacacgatcgaaagtaaaccctggtagcagcccagtacatagttttaggagtagcacaattacgtagtattgtataattacgtaggaaattgttgttataaaattatgtaagaacttaaatatttctatgtatgagtgttttctgtgcatctgttttatgatttctgtaaatattgagcaaataaacggaatgagcgtgaggtggagagaaaatttgggtgcctcgttgaaatattagtaccagtgtccgtatgagagacagtacaattgggggtgtaatgccctcagtactgcttgcatattaccgttcgtgaatccggtatcgatggcatttgccagcctactgatgacactttgtccggcagtataccaaaacatcatcaattgctaatttagacattgatttgaaatgaaagagtgcttccatagaacgttattattattaggcgaattatgccgacgctagtggcaataatattagtccggtgaatttggtaataataccaactgtactagtcatga

SEQ ID NO: 4711 - DNA, 1363 bp, Zea mays
  misc_feature (1)..(100): optimal_loci_204767_G1, chr5:200897100..200898462, Cluster 29
catgagcaaaggtatgattcagcggtgtgttaatttaggcccccttcggtagagctccttcatgggttcctccaacacctccttaaaaaaatctaccaaagaggaaactctctaaaatgtactttttctagaaaagagggaggagctcctccaaaaatcaacaagtgccaggagacagaaaaaatgagcttttactagctgctcttccatgtttttctgtcatcggtgctaaaaccaaacaagatgatgtttctaaattcttccttaaaataaggagagagttgttttattagaggagccagaactagagccgaaggtggcagaggaagagtcctctcaaatgggtcgtaaacagagactacaattgaaaggtgtgttggagcgttgaaaatagtaagatgaaaaggtgtacttgaagcgaaagaaaacaataataatctacgcaagacgcgccgccgcataaaagcagctacggctgcaccgggcaagagccgaccagaacacgcgggcccaaatctgcagcccgccaaaacgctcactacgaaccgccgatcaaagcccaccactccacatgctgacggcatccgaattttgaacgaaggcatgcgccgaaataacaaatggtcaatttactctagtagaatatcatttttctagccacagtacaatcctagatttaagttgaaactgttctgaaatgaatccgatgctgcagcagaactattcggtactgcaccactcctgcacatgtgggggctttcactgcaaacacgcacgattcagctctgagaacagtaactacggcaccgccgctactgttcctcctctcatggccgttgagacgccgaccgagctcgtgaacggcaccagccgagactcgcttcaaaagaggggactcggcgcgaaccgcgacgcactagtttagtgcatcactgaaaattacagttccaactgctctctctctctcactctctctctctcgtttaaaactacacaatatcttaatatctgtagatacatagtatatctagtatgatttatatctaagtacgtaattatagttataaaatggtgtaaaactataatttcccttcgagaaaagaaaacgtcgacgcataaatagataaagtatacaaaatactctgagaccactttgtgactctaaattccaccgtaccaagaaaaaacaatctgcttttcttaaaaaactgccatacaaaaaaatttaaaataagtttaaaaaaactgcttcaacggatcctatgtctcaatacttttcatgtaccttttttgcccctcaattgcttgaaaactctcctcggccgccaaaagacacgggagcaggagacttttttttaaattt

SEQ ID NO: 4712 - DNA, 1337 bp, Zea mays
  misc_feature (1)..(100): optimal_loci_206512_G1, chr5:210496603..210497939, Cluster 29
ggtatatacatatatatgattttctgtacatcggttagttcttatttcagacgtcagtgccactatttatgtgatcatgatagaaagataatgtgaacggccatttatatcctcgttcattaattagtgatgcccggtcccaggcagagatgccaacaacattgcccttcgctttgtgctccggtcctttttgaccaccccacccttgcggcctccacatatctatctcatcatcatatctggagcaggcagtcgccgtacacagccggtacgtgtacctgcttcgtctttctcctttcggccgcaccaccaaccacgagagcctttggaatcactctactgtcgccgaactgattagaaggttccgttgatattttctgtcctgccagggtacgtggctggactagatccatcatccagctcttaccttcgactcttctcactcatacatacgctcctcagaaaacgaaggtgatccgtacattcatgaaaacgaaacctacagtttgctcagcgttgttccctccatcgttgcgctagacaatttttagtttaaagtgtttttatttacctaaagatgataaaagctttgtcgaatattacactcactaaaaagaacgtataacaaaaataattattgtcaaaaagctctttaccaagttttctttttgtgccgttcattggtttttatcgagtgccgaaaacactggacaaatgaaaaattgataaaaaaaaacaaaaaacaaaaatcacatcgtcgcgtaatatgcgttggcgtcataagatctaccacgtacatgaaaaatcttatactacagtgctgctttatcttgctactataagtgacgtgacaagacctagccttaaaaaaatcataactcttcgatatgacccgaccttcagaaaatcataactcttcgatacgatattggatggagacgatttatatatataaattatagtctagatctacaacttttttagttatgaggtttttcatttgggtaagttaacatgtttaaaataataatataaaatttagaatcacaataatcgcgtgttggctcttgtcgcattagaaaaatattatctcaaataaaggtattcgcatgccaaagttgtagttgttaatgagatgtacaatctgcaaaagtgattttagccgaattggttaggtagtctatgtagcattcttcatgccttgagttccgaaatccagtgagagcaaatttcaggttaaggttaaaaaaaaatcactcgctggttcatgtgcacacaagatggactgcaaagttaaaaaaagatcattcactggttcatgtgtgggctccgattga

SEQ ID NO: 4713 - DNA, 1218 bp, Zea mays
  misc_feature (1)..(100): optimal_loci_207208_G1, chr5:213581602..213582819, Cluster 29
acatatatggaataatataatgcacgggtggatgtgcttctttgattcctcccggtgtcatgtctggtatctccgaattttatatacccctggcaggtctccatcaagcgcaattccagtgacgtgatcaatatgcaccatgcatgccttttagttaattcagcgttcatttgctcgatactctacaagtttttgctagtaaaaagcagctttgagagcgacacttgcattttatttctttgtagatatacatgctgcatttaaaaaaaattgccttttttatataactatatattcagcttctttcttatcagatgtaaagttgacaaggaatgaagaatagaggtgtagttagcactctgttaattaaccagtctccctcgctgtgtgctcagctttgttattggtcgtgatcgtgaggccttgtcacgtgtccttttttgtcgatcgaggaatctgagttgagtcgtcgtcggcctaggctcgcctaatcaaaggcaaaagaacctcctttcagtttgtcactgctagtaagtttaatttgtcattagatagatagccatgtggtatagatactctacaccactttagaaaatatagccagagaaccttaggtatatatatattagaacacagagctttgttatttggtatagtaaggtcattatattctggtttatattacatataatggcaagggcatatgtatgatgactgagctgagggagacgtgggataccctgaatattttggctttgcggattactttgaagtagcaattaattgaccaccttttgctattgcttcttctatctttggagtgatatattaatagcaaaacttcagtcccacaatatatatacttttatatatattatgtctgtcctaatgcaaagctatttatgtcatataattaggttcgacaaaagatatataggagaaaatatcaacacggaggacaccaaattagtgtagttggttagttatgaaatatttttacaatatcttagatatttgggataagctaaaataatttatttgggataaacccaaaagtagctatattttgggacaaaggttatacaaatttatttggacatggcaacgagagtgctatcaataaccactcaatgaagtaagattttgcaagctacacaataaattaaacattcttgatttctccaacataagttgattgcaactcatatggttatcatg

SEQ ID NO: 4714 - DNA, 1107 bp, Zea mays
  misc_feature (1)..(100): optimal_loci_208074_G1, chr6:683199..684305, Cluster 29
gaccagcagaagggtttgaccctccaaccaacttgatatcaggggcactttgaagcaataagccaataacatccacacaagtcatgtaatgagtcactaggggggcgccctggggtcgtctgaccatggggcacctttgcacttatggcaccagtctacaatgatggattatggtctaggccccaatgtcccatgacatctccaactagaataatctaagtccccaggacccctcgtgtcctaaggcgctcagggatcaaggttttagagccccttgtgtcccagggcactaatgaaggatttgggtgctagcttggatccttctgtctccgagggcactcaacgacatttagccgtttaggatccactgttggaccgtgggtctctatggtccttggttttgtttaatgtgttatgcgatgttacgtgcctaacatgcacactatcgccacgacttaggctataggatactcaagacaactatctagtaagtgcaccgaccccatagtcatgcatgtgtacgacaatataccatatagtattatcaattatagaagtctacactagctaccaattgtatcatacccaatgacacacagactggatatgagaaaatgacatatcatatctgcctcttcaacaagtatggcaattgtagaagaaagacatccccaacactgtgccatgactgaaagcgtggctctatgtataactctacaaacaggataacaacaaagttgatcgatcttagcaaaagtgatctaaggtccatataacgtatgttctcccttacactataaaaaggaggagtagagtaacctttaggataaacaactatattggctagaaaatctcacagtaggttccacccaggtaggggctccacttagggattgagaatctctacttcatagaggattcactctatatagagggcatgcattaagatggattagggcaaatatgctagaaccttcattagaaccaagaggtaaggaggatctaagaagttgtagtgctagcttagttgtgtaatgagcttgtaatcttcttcaattttgcgttcattaatcagtgagtagaaagaggacatagatattacatata

SEQ ID NO: 4715 - DNA, 1100 bp, Zea mays
  misc_feature (1)..(100): optimal_loci_208312_G1, chr6:2064668..2065767, Cluster 29
catatgccatatttaaccgggcccctcacacaacacttttgttagttagtgtttagtttatgtcacttaaaggatgccggccggccggcggaaacgatcgaagctacaacccaacaaagagcatggcatgtcctactacactactactacactgcactacacataaagctaggaaagaagccgtaccgtaccgtaggtgcggccggccagccagccaaaggtacgtgccagcatgcatgcatgcctgtagtgttggagcaggccgatgcacgtctgtatatatgcttgcttgcttgctgctggtaataaacctagctcgattgctagctgtgggacacactactgctgcttatatcacgaccagctcgatcaatcaatatgcatgcatgcatgcttatcatccgtagtagctagtaggcatgagcatgatgaagctgtcctgtcgactgccacaaagatacaaagatcctcgttccactgggtcccactgctgttgtggggggtggggcctacttcgattatggtgtgcggtggcactttttgctactgctacacacatacatacatctagatctaggatgtgtttgacgttataataacagaaccagacgtaacgagaccatccctcaaataaggttgtttgatttatgattcgggattaagataaaattatactagtgttgtcatagttgtcccttaaaattaaagggacaaaagagtatgtcataggacgtccctgttctagttgtctccagctgtcccgcaaaaaaacacaccttagtcactctaataaccactctactctgccccctagctaccactacaatatatattttttagagcaaattaaatggaaaagccagaccattgcactagtattgtcatcatccatagattctatgtgcatggtggaagggccgccatatataaaaatatactacccctcttttttatatttaacgccaaataatacaaaaataaagtacaaaacgtcaagtaaaaaaatacggaggttttaaaacaaaaatgggatcaaacatcaatgttccttttttgtgcatgatatcatgcatatatatataccctatcggaatttcgtt

SEQ ID NO: 4716 - DNA, 1013 bp, Zea mays
  misc_feature (1)..(100): optimal_loci_208314_G1, chr6:2076960..2077972, Cluster 29
agctctcaaatgtgtctatgcatatatgcgtgcatgttccatgcatgtaacacagtatatacttgtaaatatacgttcgttcgtactggttgtcaaaactagttatttttgtcagaattcagatctaagtggccttggtctaaccttaaatctctcatgacagaattaactttcaaccaaaagtttattcacgtaaaataaatggacattatgcgcacatgcatgttgtgagagtttaagagggatggagtgaggcatgcgcccacacgcaaaacatagaagacacagatgttatgacttatgagaaggaaaaaaaatgaaagaaaaaaaaatctccttttctccttgttaagggtgatctgatgaccagagaattggaggaaattcataggaaacaaattccttgctattcaaaattgaatatcattttaaatagcaagtggattcctcctccctatggattttcttcaacttaatttgtggtcatcaaaccagctctaagatgtactcctttctatcataaaaacaataattaagtgaaactttataaattttatccaacagttagtcatactctgtggaatttaatttagagcatacaacttaaatcaatagatttgttgttaaaagtttctctaagatctaaaggagatcgaccacgtacggacatggagtagtatatatgtatacagatcgatcggcagccgagcatgctgcagaggattggagtggcctgcgtatatatactgaatatggacggcaggcgttgctcagcgaaggccatgcgtacgcattcatgtgtagtgctctagctatatacaagcgatcgatgtcttctcgatctaaggcatcatgcatgattggctcctgtctgtcagctctctgtagtcggtgcagcaggcatgcatgccctaccacagataacgttttctattcagatagataccttggtcctctttatttcacctgcttctttaccggatcgagaacatgtacaaacaaataacgtattc

SEQ ID NO: 4717 - DNA, 1017 bp, Zea mays
  misc_feature (1)..(100): optimal_loci_209926_G1, chr6:13814458..13815474, Cluster 29
agtagatgaacaccttgtgtttgatctaaaaagagtagtggtttaattagttagaagaagaccagactaaaaaatgacatgacctccaaaaccatgatctgtaattttggtatgggtgtatgacagcatatgcctggcgagagcaagctcgcatcgcatattggcttggctataatcattcattctccaactgtgttaacggcagcgtgtctcggaaattgtgacgtggcaacagtattccataggaaagaaagggatgtttttctgtttttcaaaacaacatgcctgcatctctttcctttgtttgggtttcctttgaatttcctaaaaaaaatactaggatctaaacagccccttactatctatccaatacaagcatatctttgttgttgttacaactttctcccccttttcacttttccctcataatttttatggtttctatctcctaccaggggaaacaagaattttcctgacgtgcaattctcgccaggaaaatataaaatactatcaagaaaactaaaaatcaatatatttgacggtacaccgtcaggaatacagcgacagtgaaataaacaaatgtgacggtccactgtcagaaaaattgaattttattttcccgtcgataaagaaccgacagccaaattataaattgtcagggatatgtattttgttttgtcggtggaaaccgacaacaaaatcataagatcctgacaggataaaagaataataccccctgtcggtttaataaccgtaaaaaaattcaaatatcatgaaatttcacgtttccagcagtgtctcttctgaagctgttattatagcttcagcatgtatctacttttttatccgaacctaattagtctgaccaatcacaaacaaaattagatgtgttgggttgcacacaaaaagagatgtgctgtggtgctctgagttatgtgttctggccacttcagctttctctgaactcgcaggcagatctagtctgcattgcgtgggctctgatttaaggctgagggg

SEQ ID NO: 4718 - DNA, 1077 bp, Zea mays
  misc_feature (1)..(100): optimal_loci_210189_G1, chr6:14689121..14690197, Cluster 29
ctgagggggttcgttcctgggcctgttggcctcaagggtcagcccaatgcggttattgggctgcttggggtacctagggtacagatacacgacataagtcaaattaaaatatagatagcatcaaattagtacttttaatttcaccatattggtatgctagtttattcattttaaattttagaacttaatattttgatttaaggcaaagattaattgggtgaaagtagctgtaaaaattcctgcattttggaaaagcgatgtgaaccctattacattcaatcctctgatccaaacaacatgcgacactcaagaagactagccttttgaaatttatttgaaatactctagttcaaaccggcccatatctcttatccaatgcatcctcttttctaccatattagtcgcgtctatgcctctcttaattactcatctatttagcaattctgtggcatattacttgtcatgaattgagcttgtgtttgccagatctacatctcatgttactagatttgattccaagtgggctaactaagctcattgttcttgttactattgtatctcatacaaaaaacatagtgaatcatggagtatgatggccgtgcatagatagtgcggttaggcttcatgactctatgattgtgcacggccacactgatgtcaatgaacttaatgttgaagaatatccaaactgaggcagtgtcatggtagtatcgtagacgtagtcgtttgacaaatctcatgattgttgtatagattaatttggttatagagctataagaattagtacctatattatttgtttgttatgataagagatctgatatgtacacaactttattagttcaacttttatttgtgatgctatcattcccctacctatatatgtacattatggatcaattgaaagttctctttatagatgacatttttcgttgtattttctcttgggaaacgatctaggtaatagatttgatatgctagttagtttatacaaacttgatgcgctaattgatttaaggtatccaaatccttgagattcatggagacttgataaaaccgtcgatggatcccgctaag

SEQ ID NO: 4719 - DNA, 1090 bp, Zea mays
  misc_feature (1)..(100): optimal_loci_219916_G1, chr6:79217557..79218646, Cluster 29
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(164): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
  modified_base (137)..(137): a, c, g, or t
  modified_base (138)..(138): a, c, g, or t
  modified_base (139)..(139): a, c, g, or t
  modified_base (140)..(140): a, c, g, or t
  modified_base (141)..(141): a, c, g, or t
  modified_base (142)..(142): a, c, g, or t
  modified_base (143)..(143): a, c, g, or t
  modified_base (144)..(144): a, c, g, or t
  modified_base (145)..(145): a, c, g, or t
  modified_base (146)..(146): a, c, g, or t
  modified_base (147)..(147): a, c, g, or t
  modified_base (148)..(148): a, c, g, or t
  modified_base (149)..(149): a, c, g, or t
  modified_base (150)..(150): a, c, g, or t
  modified_base (151)..(151): a, c, g, or t
  modified_base (152)..(152): a, c, g, or t
  modified_base (153)..(153): a, c, g, or t
  modified_base (154)..(154): a, c, g, or t
  modified_base (155)..(155): a, c, g, or t
  modified_base (156)..(156): a, c, g, or t
  modified_base (157)..(157): a, c, g, or t
  modified_base (158)..(158): a, c, g, or t
  modified_base (159)..(159): a, c, g, or t
  modified_base (160)..(160): a, c, g, or t
  modified_base (161)..(161): a, c, g, or t
  modified_base (162)..(162): a, c, g, or t
  modified_base (163)..(163): a, c, g, or t
  modified_base (164)..(164): a, c, g, or t
tccatcatggacccggcgtcgaggttgaggatacgggggaaggactgacgaatctctagatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaagtttgtcaccaggcaccaacctgacctcaagtcacgtgccggcaactcaacagaaatgatgctctgcacatgcattgagataaaaagcatttgtatcatccactgtctcatctcctattccaaacttcaatctttaaatattatcttctacagtgtcacattccctactttaaaaggacccatcgaagacagtctaagagcatgtttagatccatggtgctaaaatttagcactgcatttttagctaaactttagcacattgctaaaagatgctaaaagttaagtgctaaactttacgctaaatttcaacaccatgctaaagtttagtccacgggatccaaacactccctaagcatgcatgcatgtcaaaggctccgtccagatcgatctctaatctacgttttaagatggcccagttcttcgctattcagagacataacatgaagttgactgagatttgtagtgtagtatatgtgtgttttgaccaggttcatgataatgatggcgacacggtattataataagattagttttgacaaagccttgtttcatattcgacattttaaacttttgaccaacacaaactcaccgcccctctgtaggaatagcggtggctcgggttcgggttgggtgctgtatccgcgtacccgaacctgaaacccgaattttaaactcgaagccaaacccatattcgggtggattatcaccctcgaacccaaacccgacgggtaacccgaaacccaaaaaaataacagaaataccatacacaacttagttgtttcaaacagtaactcaacattcaacaagtccacaatatgacaataaacacaccatgtgtccatgactctatgtcgaaaataaacaacaggttgagcatgtgacgcatacacactaatacacaacagccagccatacaagcag

SEQ ID NO: 4720 - DNA, 1230 bp, Zea mays
  misc_feature (1)..(100): optimal_loci_222415_G1, chr6:95373987..95375216, Cluster 29
catgtgtgcacagatgtgatgatatgaacaaaatacattcccgagttgatatgctggtgggtccatgtgcgaaagtctttcccaattgaagatgccataaaggcagcaataatttcccttagctttgccttgtagtgcgaatgtaaacccccttgtcccttgcgtgggtttaactaggaaattagcgttgttgttgaaaattaaaattcgcttctacggtccaagctagattatcagacgatcttctttaacagagtaaaggctgccttaaaatatcgtaggctatactatttaaagattgcagtttgaaataaaagttacgataattaacagagtaaaggctgccttaaaacggtgcgcaatgcaagatcactttcctggattccttgtgcatatgcaaatggtggcgggagtggccatcattaattcattattaactcgctaacagttggcgccttgcccgccaacgacctcataacgcaccggttgcaaggtcaaacatgactagcatcgtatgcgaggcacccagccacccactgctgttaacacacgaacatgacagcgtccggttgctgggagaggcggtgatagcacaggtgtcaggtgatggtgtagagaactgaagaagagatcctggcctcctgggcagcagctcgagcagaccaagcacgcgttgctggagcagttttcgatcggtttggtggaaatctgccgcaagcgcgctattcaagaaaatgcagctcgtccttgatttctgggattttatctcttcatgcacggaatccaactaattgacgacacgtgtttaatccaacgaaattacagaactatgtacatctgtcctaattgagtttttttcttaatttttctgcagaaccatgttgaaattgcgccccaccccgaaactggaggcaacatgaagaagacaactgagatattttgtggtatgatgcagatagagccgatgatcaaaatatttaaacactgtcacacccgatgagttgagctgggctgcatcgacacgtttttggagggacctgatgtgtgccgagctctatgactgaaattacttctcaaagcttgccttacgcaagttggaacctgtagcgttttgtttgcgtgacgcaagcaagttggtaaagtataatataataatttatttatgttgggcagcacgcatagatactgtcactgataagcaacatttgtaaagcatcatggatgtaaagg

SEQ ID NO: 4721 - DNA, 1009 bp, Zea mays
  misc_feature (1)..(100): optimal_loci_222483_G1, chr6:95732110..95733118, Cluster 29
gaaaactagcaaaagtcggtctagccgaccactaaaatcgattatgccatgtttcacaagagaaaccggtatagtagagaaagctaacatggtcggattctaccaaaatatttttgcgtatcaacgcagacatctatttcataaacatctgaatctgattatgttatgcagatgaattatgaaatgattattaacctacgattgcatgaaatgcctgggcaaaaaccttaacgaacagcatgaccagatagaggcagataaaacagaaacgatggccttatcagaaaggaacaacagaagaacagtctttttcaaagggaaaaggaactcaagcgatgggatacatgacggaaatttcctttgaaatcggcctaacaggtgcacgcggagcatataccaatagaaaaaaaagaagggcagtgccaagtgccaactaaaaaatcgaagatatgccgaagaggaatatggaaaggccaggcaaaaggaatattttaaaccttttatgctggtgaataagtattccacagcaagtttgttttatttttcaacaaaagaaggggctccttttatgacccgacggggacgttcaagctcccgttttttttaaaaaaaaaacaagaagatacccctatagcatcagaaatgcactaacgagataagatggaacatccgtatctgaacaaagacaagataacagatcgatgcctgcattcaaatgggttatttcttcacgatcgttgaacaagaacctacatatgttgatgtatcatcatcatttttggcagcattaatctagaatctaaggtagcgtttggttctagagagccaatctgttcccaaattgttattgtttggccatatagaatggagtggttgtaaaaatagaaaaattatgctcaaatattgaatcatttggtggctccttaaaatccgttccatcctaattaggtccggatccaaacactatgtgcatgattggtagcctgtccgcgtgattggttggctcgcc

SEQ ID NO: 4722 - DNA, 1062 bp, Zea mays
  misc_feature (1)..(100): optimal_loci_222870_G1, chr6:98101744..98102805, Cluster 29
agtctacacatgggttgatttatttcttgaaaagtataaatgatggattttcaaaactattggagactataaaggaaattgcagtagatatggatattcatctagagtcatgaacaaaatgaaaaataataaggacaacttggtgagtgtgcaaatgatgcttctattgagtcacaatctggagaggagtcatttaggatgaattattttatatctattattgatcaagctataatttctcttactaggaaatttgaacactactagggcgtgaaaaacattttgtttcttatttactttagataggttacgatccacatatgataagagattaatgattgtttgtgtcaatcctgaggatgcacttaagagtggagaatataaagatgttggtgggaaagaaatgtttggggaatcaattctcatccaagattcactcatggaatctatgtgtcctcttaatattttgaagttaaaacatccattttatcttgatgttattattgcatatatgagttttgttaaccatctggttatcattatacgtgccaaaaggaatttctctaaactcaagttgttgaaattctacttgagtcatactatgaaacaagaaacactcaatggcttagcaatgatgtctttgaggagattaactatgaagatataattaaagattttatttcaagaaacgctaggtgaatgttgcttttattagaacataaagtcagtaatatctttgctcatgtagcattgatatttagtctatttctatgtattataaggatataaaatgatatgcccaaattgtataattgttaaaaaaatgtatattacttctctatgttttttataattttagaaccctaatgtaaataccattatgtgcccaaatttctagagacaagcattattagctaacattattaactagtgttgtggatatagttcaaagaattaaatgtggacttttatgaaagcaaaagggtgatccgaaagatcaacacctcaagaaatttattgaaagagtcattgaagaactacaaggtcatgtaaagagtccca

SEQ ID NO: 4723 - DNA, 1297 bp, Zea mays
  misc_feature (1)..(100): optimal_loci_222883_G1, chr6:98133606..98134902, Cluster 29
accagctaagggcaactcaagtaaaagcattatttgatacataataacaccaacttaagtaaaagtaatgtttgatatgtataatatttcctcatgaacatctttaaccaagacattaaaatattataacataagaaagaaaaacaacaagggaaagcacacaaccatttccctagtatattcaacaatataatgatgtcaaatctatgataaatgtccattccaagctaacatttatcctattcatgatattaggactcatgatttagagtccacattgaagcttgtcataacatcaaaagagttaatgccaagtggaaggtgctcgacatcatgagatgcaacaaagatgctataaactttttttgcacgcttattcgacatctcctcttccaaattcctcctaagcacagcaacttccttcttatgtgcgttctggtgcccaccacgagcctgtggacttttaaaagtcttattgcaaaatgaacagttgtagagtgtttccaaactttgtggttgtgtgtgaagcactgtgttaggctctactatggacccaagggaggctaagccataggtatagggatatctaggattagctttatcaaccattggattgtggtgttatcttcctatcccttatggtgaggtagctcgaaatagagaaagaacaatattttataggcaacttgaagaagctaaaataaggtagaagttaatgttatgcaattgaaggttgttttcatttggtgacatgtatagcaccaatggcataaacactaccacataatgcaatcatcatggatcaaaaaagattatagctatatatgtcaatatttaagcactaccaaactatatgtcaccattaacataagatttaaattgacgaatgatatcttttggtaggatgtctgaggtgttatattatgctttgaaatatctatatatttccaaaacataaatatatgctagcattgggtattaacatcacacatacttcctagggggcatgaattactagcctcaaagctatatttgtaactatatatagatgaagcagcttttgaagtagcacaaaaggcatgagagatggcaattagtgcactgagtaagagtcatctcacatgtgttgacactgcaaaggtcccacataaatagagcttgagtgcctgtatcatggagctccacaactattgatgaacacgcaaaaaattgacctagccagttgtgtaaaaaaatgccataaagacctctaaatgcctcctcggaagacccatcatcgagatgaacctattggtgt

SEQ ID NO: 4724 - DNA, 1158 bp, Zea mays
  misc_feature (1)..(100): optimal_loci_226716_G1, chr6:118100474..118101631, Cluster 29
ccaaatacatatacatatatgtaatcattgttctcttttctttgttacatctctatgacttcctggcagatcagtgatgtctatatcgatgccttcatttctttgagatcgctcggttgcttgatgacgagtactaaatactgatcgacgtaggaaggacagaaggtgatgtgcactgtgcctgtcatgtgactgctactcgcatagtcgtgttgcttaattctagcctattatagggctcgtcccgacaactcgtattgttactcctagtttagttcgttgtactttgtttctagacaattttctctagtgtgtttagatttggtttattgtgctttttaatgtttagtctaatttgacaagataaaagtgaaatactctctctcaaaacaaatgcacagttatattatatagtttgtataattttgcgactcataaataccggtaaccgtgtctccgctcatatcaatttgaatgaactcgtgtaaattagtatcttattttattcttcagataccatttttttaaatagtagtctcgcacggtcacaccttcctatagggtctccgtttaaatttttgtttaagaccctcgaaatgtccggccctgtctactttactaggggcaaattataaaacaataaaatacaactcctagtttagttcgttgtactttgtttctagacaattttctctagtgtgtttagatttggtttattgtgctttttaatgtttagtctaatttgacaagataaaagtgaaatactctctctcaaaacaaatgcacagttatattatatagtttgtataattttgcgactcataaatatcggtaaccgtgtctccgctcatatcaatttgaatgaaatcgtgtagattagtatcttattttattcttcagataccatttttttaaatagcagtctcgcacggtcacaccttcctatagggtctccgtttaaatttttgtttgggaccctcgaaatgtccggccctgtctactttactaggggcaaattataaaacaataaaatacactaggaagagaagaaagacaaaagaatatagatgagatggaggaagaaaatagctgcagatttgtgaaatccagccaatctctgaaattgctcattgtggtctttctaacgggaattgctca

SEQ ID NO: 4725 - DNA, 1043 bp, Zea mays
  misc_feature (1)..(100): optimal_loci_227576_G1, chr6:122597352..122598394, Cluster 29
tgccgacgataaaagtttgatggtaatagcgcgagattctcaggagctttttttgttgttgttgtctactctcggtggcaaagctaaactgaaccaaagaagggtgtatatactttaatagtctatggtaataacttgtaggtgttgtatatatgatgaaatttgggtctaaataactagttttgcaaatttttgtggatgcatatacctaacttcgcctttgctcatgggagacatatgaagcagatggaaccatgcggtgatgatgagtcttaggcaaccacgagcagcccacaacaatttggtcgatactctaattttaggtaaggttttctccgctatccctttcagcaacatactctaaagtgtcttctatatatatattctctcatctcatttatcaattttaatactttaaactacatattaaataaaactaacaaatacatatgcacaaaaatcgagagcaaaatatgactctaatgtaggtacgtacgtatgtattttaatttagaaaaagcaaagtgatttacaatttataattgaaggagagtagactctaattcaacacaaatgaaggatcctatttttttgtgtttggttaccagttagatttgaggatttcctttatggatgtattctcgcttggtggaaggaacactaacgcggctagatcatctcttttatacaatattcgaggacttatatatgtgtgttatatgtccaaaagcgagtaacgcgtgttgcactactggtactttgctgctcctgctgcttttctagtgacttttagtgaggcagtcaacttccttgttggtcattattttagctgctgaacctcaagatatatattagggcacgtgcaagtgcttcgaaggacgcatacagacagcagaagagacaattgatatattatgttgtctgtgtactatttatttatttgctatctttattgctctatgttgatcaagcatatattggatgactgactagtactgttgtgtttctagcgaaggaggcctttcacttgtggttgcctcgta

SEQ ID NO: 4726 - DNA, 1137 bp, Zea mays
  misc_feature (1)..(100): optimal_loci_228897_G1, chr6:129485700..129486836, Cluster 29
caagtgataggatgccctcttgtatgaccaaataacacaactaaacatttgaaccagaaactcaagagaataatcgaatcactctaaaccctaaaaatatcgttatcaaccccgtttgaacaaaagcaagagcacatgcacaagacacccaaaccaactagcgatttgatgacttagaaaagtttctaagcaacttagaagctacaaggacatatgaataagaaaataggctctagaactaaaaatcaccttcaaaaggctaaaaatataggaaagtcgacctagctggggtcaagagttggttaggctagtattggaatgcatgggaatgtaaacccagcctagtcatgatgcatacccatcctagactagaggtcaaactagtgaggatgctaggtcggtcctacatactttggtaggctgaatagtgtgaaacccatttctcaaaaggtgaaatccattcaaatgaagtcaaattgagctcaaattttgtgaatatgtttctaaatatgtatataaactatccccaaaaggtaaactcgtaagcttaaggaaacttcacagctaaaaaaactctcttcaagattatgcttttcccaactttcctaaaaaatctccaaacttgagcttgtgaggaatctagtcaaatggaattgtaggaatgtttcatatgtgccatagctcattccaacccctaaatcaatcccaaggtccctataaaacttagttaccaaaaaacccaaataaagggtgttcaggcaagagaaaaccaaagagatttaagaactcaaatcaagaacttagatcttgaatccacaaggacaagaggaggcaagggcctccatttccaccaaaatcataggatataagattcaattacacaaatgaaaggttatgtagtggctaaatcatttgtggatcttctataacaatatagaggaaggtaaaacctaatagagagataaaccatgataaataaggagctaaggtcagttgaatcaacctctcttttatttatagtgctattacatattctcaacttgccctaagataattggatccaaaccacttaaccctaatgatgttatggtgcaactcaagatatgtagatttaatggtcatgggatcttcatgact

SEQ ID NO: 4727 - DNA, 1315 bp, Zea mays
  misc_feature (1)..(100): optimal_loci_231460_G1, chr6:141046724..141048038, Cluster 29
aaacaaatgtgtgaagtgttgcaatatagattgtgtggctatgatcttttgtttcaacacggaaaagatcgtgtagtggagcaaggaaattggttgagagcaatccaactagagattgaccatgagtgctcactcccaacttcctcaacagagacataaggtctagtggatatccaaactcctagaaatataccttgttatgcctctctatttggtttgcctcaaactacatatttcaatcaactatttgtacttccaattgtatctccttggttgtgcttgtctgtgggtgtatgtactacttcaataagccaaaaacaccttaacaacctatataccatatttcatttgagttgaagtggttttataggacttccatatttattgtgttattcctagaagtcagactcgagactgcatgctatggagttgcctagattgtatcgatagtatttgagatctagctctctgttgtcattacgatgtttctagacagctttgtttttatcatgcacctcacagtaaaagttggacgtgcatatgttgcttggcacattgtctattcttgcgttacttattggctttctcggcatatatctccccaaccattttgttcttgtcatcggagatgttagcttcctcatcgttctgatgtccttcagagagcatgaaaacctctcatccatgatcaaagttgtatgtgctactatgagtgcaaggttatgtggttgtcacttctgtaatactgaatacggtggttttagcatggtaaggtaatgaatccatgtaggcgactatgtgggaacaactagaaagaattctagagtaatcgaacacctagctactgtattttcttcccttccaacgtggtgatgaggactaagccttgctgagcacctatcaaagggattttttctttgtctacatcctcttctgttacaagagtggtcggaatgatacttggcactgtcatttgatagatagcggtagtattctccaagccaaatggtaatcagactaagcttagagcacaattgttcgatagcttagaagacgactcgaaaaatatagtcatgttgaagtcaaacttgatctatctgtgttatctgcttatctggaacagactagaaataaaaaagtgtcaaaattctcacgtgttcttccaatgcattttggcgaagagttggagaaatttaatccatcatagctccaagaggcggatgtagattttgtcagagtcattcaccatgcaggcttaggaaacaaagatgaaggttgatcctgccaacgtcatgatgatcttgtggcctatcaa

SEQ ID NO: 4728 - DNA, 1074 bp, Zea mays
  misc_feature (1)..(100): optimal_loci_231468_G1, chr6:141058536..141059609, Cluster 29
tctccccccacgccaccgttgaaccttctcctctccttcccgataatcgtagcgttagcatatgctatatgctagttaaagatgttgtcttcttatgttatttatgtggtagcattgacagagacatcattactcattagcttagattttagattgcactggtttatgtatgtaacttaatataatatacaaacaagaaatattacattaatataattgtttattttaaaagacatatatgagacctataaggccgaagagagcctccatgtgaagtggaatatcaaaatataagaaaagtgtacacagagtttttatcacaataatgatgattttttgctatgttttatatataaatacctgcaattgacacaaattagtattggccgaagatatgttacaataaagaccttggcgccgttcacttattcgtgacctgggcgagtatgttttttaagttatgttcaaagcactactaaacttagttacttaacattaaacctgaatactatgtaaatattatcgcgcaaccatatatatatatatatatgatcctctatctttcacttctaaaatattgccaacaagtagtggtactacaaactatagtttgtttggacataatacaagctagctaaaagctgtcagcctgtcacacatagtaaaacatagcggcatatagggttcgggaagactgctcatccatcgaagaagaacagacagaatcaaatggtcggaggctcttaattgcacaccgaaccccaaactctgacatggattccgtagaaaacaaaccatgttttgacgctttccatactgcaagttaactagctagaggcacaccatgtagggacaacaacacggcatccctccgctcgctagctagtgctgtgcaactgcacaagccgctactcggagctcgtggtcatccctatgcacactgcagccctgtctggttgtgcttggtaattccggcctcttagataatctctagatcttcgtcaacgcaaatctaaatatttattctatttttagttaattaaaaatggctattctctagttggttatcgtttc

SEQ ID NO: 4729 - DNA, 1106 bp, Zea mays
  misc_feature (1)..(100): optimal_loci_231493_G1, chr6:141165394..141166499, Cluster 29
tgtaattaattccattccatcgcgctcgatcacgcgcatagattcatttgatcatcaccatccgaagcccggctgtgtttaatttccccatatacggtacgtttaatttgagccccatgcacctgaatttattttaaaagcgacaacgaacgcgccggccggtctatcaaatccaaataaatcctgatcattattgtcagatggaagaagatgatcctgtgttcatgcgtacgtgacaccgcttcagtaagtcactagcacccatcgacttcatcgtttgatagctacggcagcttgttgagatatatacattggagagggattgcccggatggagactccaggaactcacctgcaggcggagtcaagaagccggcctgcatcatcgatcagatgtctcagtcggaggataaaccacgaacggactctagcagttcatccagctctcctaatcctatatattacacgtaattttaaaagtaacaatgcaaaaaaacggcgacgaatacgtagagccgcacaaatatatataataaccacacatttacacacgcattaaagtgccacatataaacgatttgtctatggctagctgaatgaacttgaaaaccttgagacgacatcttgttttacagctctcttttttagcgcgcgcccttttcttgtcctgttgttttcgaaggcaggcaattgtacttttttagataatgggaaaaaatgtttcagcacggccgtacagattgaaaattaatagagcatacatcataaaatagaacattcttaaaaaaacatgtcctcgagacaagcgtcctctaatctggcatattagacctccatccatgttttacaagggtctccaatgccaccgtctctaaagattaatataccataagaatcttttggtgaacttcttcgttctgcaataatctcaataatctcaaccaaccagaatgttcccctgaaaaaaaacccagaaaaactgatggtattggtttagaagtaaagactgtgtattgcgacaaagccaaatataacaaaacattgccgccactctgattaggagtacttttctgtgtgttattcccttagggcccgttcggtttacag

SEQ ID NO: 4730 - DNA, 1018 bp, Zea mays
  misc_feature (1)..(100): optimal_loci_231928_G1, chr6:142926983..142928000, Cluster 29
tctattattttattatcgatgttttgtcttttgttatgggttccagatatccattatacttcttaagcttgcattttttgttttattgttttaatatgttggttcgtgatggcacttcaaatggtcaggagaactttacgattcctgctacaaatttagttgataatcctcatattcctccatatggtatgctacatatcgtaaaggaaacatatatattgttattagctctgttatatattttatgaactactttgattatttgagttatgcaattgtgtttgttttttgctgcttgtgctagaagatttcttgcttcttttaatgtttgaggttattttatcatttgttttattttactacaacattgattttcattgatgagtgttgcttggctataacacaaatataaaaaactgaagaacattgtttgatctatttcacgcctttcatacattgtaggttttgtgtactctaagtttacgcatattccaaaaattactaaggaaccggttgatagaacaagttggaattgtagtggagattgttttagctctaaaattgcttgtgtgctaagcgcaaggactctgatctaccttatgtatcaatgcaaaggagaagttctaagccccaatggttctaaacataatagtattgtcttcaaacaatggaagggttggaaggaaaacatgattggatgttttccttgtttgctggttaaacatagttgttctattggacccctttttcttatggatttcccttttggaagtgaaactaatctaatcttgattctcatcttttggatgcatcttaactccttttttcttgaacacatttgagagttgcatatcattaaataaagaagaggaaaaatggagaaaaagagccatgagagggaaacaatagaccaacacactcacaacagccaaccataataccacctcctaaccacgatgaaaggtctggagcaaggacaagcccttagcacccgccaaacaccaacctagagcctcat

SEQ ID NO: 4731 - DNA, 1129 bp, Zea mays
  misc_feature (1)..(100): optimal_loci_232797_G1, chr6:147525090..147526218, Cluster 29
cgaaagtgggctgctctcagactccaagacaccttgtgagagaggaaaaaatgaagcaagtattaaatgtataacttactatatcataggagagttattatatgagcatacctttagttggctatatatatataacatgccaatattataaacccactatgagctatattattaaacttactctcatatgttgttcatttaatgcatccaacacaatactgaaacaacaagtcaaataaatctctctgcaaccttttctctactgtcagtataaggttagctcttcagtttttctatgcaaacattaactaaagctagtattattttgctgcggcatctaggagggtatatatgtcggaatggatgagtgaaatccactaggattctttgtaacaaaatctgcattaaatcttctgaatttgacgatagctcatactatgtccatgcaatattaccagctagcgaaatcgaaaccaatgccacagtgaccttttagacgaaagaagtggcaaacaagagtaggacctaaatcagctatgacatacacagggggagcagctgtgttggtactggtagtagtgtggagtatatacacggtccctctagcgggctccaagaagcagaaggaaagggactgagtggtggaattaaagagggatagggactgggcaagatgagtcccgctttgggcggctgcttcttccaggcctctgacgtggacgatgtctacttctaccatccttctcgatcacttcgttccttgacatttttttcattcacactacgaaatacttgtacatatgttccttaacatttctgttttagattttgtttcccttgtcgtctcttcttcgttaatcgttctggaacccgtgctggcacggtttatttgctcactgtcaggagagtcagatctagaagcttgcaggatgaagaaacgacagaagaataaggtcaaattccttgagagatggagaaggctgacaactcgcgaattgaaagcacacatgcacgcatgggggcctggcagctcatatatgtgtcaagggcccaggggtggtccatgcatggaggcaaggcacactgactcgttttagcaatgcactataccacaacaagtcaacaacca

SEQ ID NO: 4732 - DNA, 1145 bp, Zea mays
  misc_feature (1)..(100): optimal_loci_233982_G1, chr6:152922095..152923239, Cluster 29
tctcatgggttgcctactatccagaaaggaatcttagttgtgatggaaaagatagaatctcaggacagagagaactttgaaagaattcccgtgggcagccagcattcagaagtgatggatatggaggatggatcaaatgtcttttcagaaaaaaagggaataactgatgagtgtgaatggaaagctgcagcggaaaattctggatgttatgaagctagatgtgtggggttagaaaaggaaatgagctagcatggaaaaaagaaaaaacagcttgggtaaaggaggtttcagcagggctaataagcaaaaaatggtggaacaatatgagtctttagtctctcaagagcatggtgatctaagctgcgagcttacgacgatagaggatggggataaatttgatattgactcaaaagatgacagggatgggagtctgctagaagaattagctaaaatagttaatgagattacatcagaagatggagagcaagattgggttgcggtgtctgacggaaaagggaagaaaaagaatagagtaaagggtctagtgagagcgactagagcgagctcgagaactgtttaggacggagtccctatcctagaaaaagctatgaagagagcgcaagagaaagatatcccaaaaggtacttcttcttcaaatcattttactgttttgaataagaaaagaatgcaaatttaggtgaggacatgagggatatatggatagtaataaaccaatatgatgaacagatagatgtttttaagtctgaggaaatagctagagctgcgataactgaagcacattttaaaagaagttccctagtagtacctctgtgattatgtatgatgctatgtcttttctgtagagctggagtgtggttcttaggccagaagatcaaatcaagctggaggagattttggagttgacgaaaagctatatgtagaattttcagccatcggtgggggaatgatctgacgttatggtaatatgaatgggccgatttatcagtctgcttgcagttagtgtgtcgtttgagagaggaggcgagactttggcagcagactgttctggttttgttggtatattttgaaccagtttaattatgtccttgatgctcgtttctcagtccgtggcgtatccctgtaaa

SEQ ID NO: 4733 - DNA, 1026 bp, Zea mays
  misc_feature (1)..(100): optimal_loci_234327_G1, chr6:154088274..154089299, Cluster 29
cctaatcgcttcccttttagcgatgcccctaagcacgccaatttcgaaggtctgttactcaatatttagttgtggagtaacaatttgcttttaagtactgatttgtcctttctttttctcgttatatttctgattcttaaggtcttgcttggattgcaattgctggctgggaaagctcaaacattgcaggaaaatgactccaagttctttgtaaaaggtaagttaaatcctctcaaacctttgtgcacattttctgatgtcaatgcctatatttcagttcatactgtagttttctcaaaatggaccatggactgtattttcaaaactttttaaatttctcatctacaatcagataaattaccataattgttttttcaattttagttgcacattgtgtcatatggccaacatctgaaaattatgtttctggcaacacgtagtatcgtattgctttaatcccatttcccctgcagatcatcttgcatcgatatttttgcttgtgtattcatggcaaaggctcgagttagattgttggcctatactgcttgaggaggtccagacaaagtatgagttgaatgctgcaaaggtgactttttattactgtcaagcacatttatatatttttgcttgatttttggtctaacagaatattgttatactgcacagctgtggtttccattgcgagccttacttactcaaacttctggtattccagtggatgatgatttgtctattatcagaaggtatatgcatatttttttctccccctcctagaaacatatattttttctaatgcaagtgttctgcaaattcagtgttgaggaatttgttcaaacatcaagtcttggagaatacaagagacgattgcatatcctctttgccttccatggtgagatttctgctggtgctagcttgggtagttattcaaggtgagatcaaaacacaatctatattatttgttttgtttaagatagttcagtatatctgttgaaattatttgccttttccactataattattttttct

SEQ ID NO: 4734 - DNA, 1031 bp, Zea mays
  misc_feature (1)..(100): optimal_loci_234981_G1, chr6:157150877..157151907, Cluster 29
gtgtttacatgagcactattgttccattagaacgagatcctttgtggctcattcccctatagttgtcacctataggtatttctacaagttgaactaatgttcattaggtctatctaacaatgacaaaagcaacctgaagtggactatatatagtggaatcgaactaattgtatgttacatttgaccaaatttataagtgcagacatctaccttttatgttattcgagttaaacatgtgtgtcgagtatgtgagtataaaggtagacgtagggttgctaatagatcacgatctaaatgtttttttacaataagttaggacccaccataagagagttaccataaagggactgatacgacgtgaaccaccgcctccctagtttcctcagggaagcgacgacggaagggaggaggtccctccgcgctgctagcacgcttcgagccatctccttcgtccccgacacggcggtgccctacagctgcaattctctccgcaagagcctgccacttctgcatctcaaggcgtctggccaggaggaggagatgcgggagtgcttcgtgcacacgctggaagaggagttgcagagctctacgtggatctaccgcgcgtgagacaggaggtactttggtgattatgttcttcgtcagcaccatcgtgttgtcacttaattttgagattttgggaacttgccaccggggcgcgaagccagggggtgggcgggccttgccccctaaccctccacatataatatgaaatataaaatttctttggtcaaaataaatttctatatctaagtaattttttttttgcatgtttgaagcatcaaattcattgctaataataaatttgataaattttagtctaaagttgtcacaggatatagttattgtcgtgtgacgaatttactgtttcaccttgagtatacaatcatttagagtcaaataaaatggaggtgcttaaaacaaatgtcttggaatcagatataaccctcttgagggagctcgaatcggctcagtctcctctttatcgaaac

SEQ ID NO: 4735 - DNA, 1330 bp, Zea mays
  misc_feature (1)..(100): optimal_loci_237768_G1, chr7:3376588..3377917, Cluster 29
tttaaaatttccctccatatttaactgtacattctgccaccgtttttgcatatatgtagtgccaaaatttgtatattgtgatacacacgatatttaaatatttctatcagtatacacaatagctattaacattgttacatgcatttaaactaaaatactaaacacaatcaacatgttattttcactttatagtgattagagagaatgatagtttaacaccataaagcttcctacctgaagtgccaccatatataagatagaaactagagctatcaacaacaattttgggagcacatctcctatttaaaaagcaatgaggacacaacaacatatagagggatataaattggaccaatagcaggatatatcatcctaatgagcaggttatcatcaaacaaagtctagatggactttacagcaacaaccataaaccaaagggtaaggttgaccaataaatagagactctataaaagatgaaatgaacatgccgagtttactgctactttctcaccattcaagcaaaagccacataaacttctcaccattcaagcagaagccacatgaacgcctagaaagataaaaaagggatgtgagatgtaaaaatatcgacaagtaaaatgctttaacaagttatttaagctacaagttcattaagcatcgatttaacctttaattatgtgaaaaccaacaataggcgataagataaatccaacaagtaataaaaccacatagataaatataaatcataaccaaaccttggggaaacatagcttctcataaactctcccaaagctttagtccaaggctatcatgtctcagaccaaaactataacgcatatacaatgcaaacgccatgtctcctacattcacacccaataaggtatatgaacctacatcgttatgctcaaataaatgatgttgtaccaatacaatcgtggctagcaagcagcgacataatcccatatgctaatgaatgaatggaatgtaatacaactactatattaaggaaccataaactacatataacaccatgaccatcccaccacgggacaataagtctcattccattgtgccaacatgagtatcatcaaatatttgttcggaaacttttgtttaagaaagtctcctttgtcatggtgttgacttggtcaacaacataacaaagatgtcattgtaaaataatttaaaatcatgatatggatatagagtgagaagggaatgagtttgacctagcattacatgccacacacattgcacaaaaaaatttaaaaatatttttatattacatgaaaacacgagatattacaccaaacgtggcacaagtgaagca

SEQ ID NO: 4736 - DNA, 1055 bp, Zea mays
  misc_feature (1)..(100): optimal_loci_238023_G1, chr7:4571896..4572950, Cluster 29
gcttcgtgtaccgttgctcactgcgggtagcctgagatcataaaagcatgtctagctagtcagtttattttatttaaaataggagtttaaagggatcggagggatatttttatttagctacgaagttgacggagctagctagctagccgcatctggtcttcaacaatggcggacgagtaaaactggctcggctaccaaatattacatttttaccaatcggcaacggttgttggtgtttcatcgaatattgtcatgacacggctcttcacacgatgaaccggctcgatcgggtacacggtagtcgcatgccaatttcactttctacttctttcgcaaagacacgaaaatgtgcctttctacttttcaatggaataaaaaaaacgacagtagtacagtagacagtagtccagtggtttacctattatatactccaacacaggaaaggaaaaaaaagcccatatatagttgtatgtacgtactgctaattaagtaaagaactcgagaaaatctgtatgatcgaatgagatatatagtgatgatgacatgcatatgttgatcgatcgtttggtacacgattttttaatcttaacaggtaactggcaggcaatatatgtaattgttcatcgtcgtcggcgttgttgtgccaacacggattcattagattttgtcgagtttgtgattttatctaataacaggccggcgctagttttttattctcgaaacagaaaaatgtagattatataaattgtagaataatcatcctcctctcgtgttaataatgtctctgctgagtgccgactttagtttccaggagattaaatttgtcccatcggttgttgttgacgttgtttcctgctgtacatgcacgcacagttagtcgtggctagctcttgtacggcaaagggataaaacgaggccatattgagtcgcaacagcaagcagtagtaaccattcaaaagcacgagcgtacgtaataattaaaacacacagagatcgattaccatttgctgagaaactaaaggtaaattgtggcggcgcgcttttggacgtggcgg

SEQ ID NO: 4737 - DNA, 1153 bp, Zea mays
  misc_feature (1)..(100): optimal_loci_254232_G1, chr7:108495487..108496639, Cluster 29
ggttgccatccttatctcggtgtcatgtaccaaagcacccaaaaagatagatgcaaataaatataaatatgcaggagagtaggacagattattcagaggtcagtacatagcgccgcaatcttctactagtgcagtactattatatagcatgggcaacattttggtacgttgaaactttgactgatgtcatgcgagattttaggggttgacaaatacactcttgttgcccggccggacaggaagcttcttaattactaccctatattataaattataaagcatttgattttttttctttctaaatacattatttttgtaacgtatctaaacatagtgtatattttgtaataaaaaattatatataaaacaaatcaaaacgtcttataattgaggataaaggaagcacaagagaacaaaacagtcacagcaactttctttaaccctcgaattcttctttttacaaggaatttaacgctcatattctgttatgctgtataaaaaaactgtcgcaatgtaatgttttttttgtcaacaaaattgggtgctaggcattatttaagaaataaaaccatcaatctgagcacgttttcaaaatacagggtaaaaaaaagcatcactggttcaaagaaagtcaatttcatatgccacagttctgacttgtataactgaaacatcaaaggggaaaaaaacccagactattaaatttgagcacgtacgttctgaaatctaacaagcacgtcgccagatccatggaagacaaacattcaaacagtaagtctgtctctattcaagacttcaaactgcgttgaacaaccacctcgtctgttgactggcttttcgaggaacgtggtcgcatcctgatttctacgttccattctcccccctcccctcccctcccctcccaaaggcattccattctcccccctcccctcccctcccctcccaaaggcacgaggatcttttccttatccagctctgaaaactgtagtctgaaatctatctgaacttgaagaggtcttgcggactagaaacttcagaaaccgaacgtggacaattttggccagagcaagcttacattatttccaggagacgaactaagcacgttgcctttttgttacaaataaacataaaaaaaaactttgcagaatctaag

SEQ ID NO: 4738 - DNA, 1142 bp, Zea mays
  misc_feature (1)..(100): optimal_loci_254377_G1, chr7:109344215..109345356, Cluster 29
tctcctcgtgatcacttaacttaattctgtcttttggtgggtacccgcacgtagtacgtgacaagcagattaataggcacacgcactcgaatggctgctgcctgctgccccgttaatctgcggatctttgtcagagccaagcaatggctgtcggtttgctttgctttgctttacttttttttttctttccaaaagagccagagaaaaagagagagagaggtcggtttcttttgttagatgcaagaaaaggaaaagggagagggggattttcatggctcatcattggtgtgtgatattacatatagagaggcagccttgtcaacgggggatgacgccgcatttctgctcccttttcctgcatttccatgtcacagtatcttactagtagctagtttccctccgaaaaaaagagttttctttgtagtagtagtagtagtgggttggccaggatgaatccaccgagcatggcacggcggcatgccaaccactcctgcacgacttggcgcggacgagaacaacgcacaccaaccaactgccaagcttatatatatcatctgaaaatggcgatgggtgtcagggccgtcaaggagaagacgagaaacagcagtagccagtagtactgttgcgcgtccaagaatggagaagacgacgagtgtgtgttgtgttggcggttaacgtgaagggagaagcagcaggagtagctgttaatggtctcgaacgatgatatacaaggcactgtgatttgtaatgaacgagagctcaaactctgaaccctccctccctccctgagaaatgccttcttctcgtccccatttctggcttctttcctgcaacttccatttctagagttatccgtccaatcccccatttagaaaaaaaaatacattattagaaaagaaaatgttatggatgatatataaaataaggataggacactgatccgaggtgtaatataattgggtcacttcaagacatgtcctgtatttttttattacaaaaattataaaatagagcattgttggagttattttacaagttgatccatgttttttaaaatagagtgatgatttaaggcactgttcaagatgctattattattctctagtaattttagcatagtcatacgagcaagatccacaatt

SEQ ID NO: 4739 - DNA, 1097 bp, Zea mays
  misc_feature (1)..(100): optimal_loci_264700_G1, chr7:165482331..165483427, Cluster 29
catgagtggggattatactattcgagaagatgccaatcggaaaggccagactgacttggcaggggatgcatggacagtggacaccatgcaatcagactgctcagccctcagctgtactaaagaatgtctttagcccttaatattttgatcgttagcagtgatgcatgttgcttgacctgctgacctttttctgtgggcagtggtattctcaactcaaacaagtgggttgttgattttttttttaataaattttttttgtacctggtcgcttggaaccatctgccgatgctatgccacataattttaaatggcgggagatgtactactgtattagtagtactgtttaggtcctttgttcttgagaaacttaacctcgtgaagaacaccatgcatgaccccctattttaaaccatggaagggatgagatcaaaatattcttcttccactaggttaaatagtttcggactttggcctctgtgctgtgcaggaggacacgtgtgttcaatctatggcatttagtttgaagggatcttgtcaccgcgcgcggatgaatttcaggaacacgacctgattcgctgttgacttttaggaataatagcatagcttatatcaattcacacataagcacatcatataatatctcgtgtatataaaaaaaactagaagaaaaataaaaactctaattcgtaccatcatgagtgcacgattgcactcgatcgtgttcggtttggttttgttggtccgtccgtgcgcgactacaacgcgagtaatgagttcatcattggagtttagcgatgctgccgagacaccaagtagctctagtactcgtcagttgatcgatccaaatcctggtgttcacctactttctactttgcagaaacaaaaaaaagaagaagaaaaagaagaatataaaaagatgatgaaacattgcagtctcatgagcacaaccagcagcacctctactctgctgcttcttaactctttgagaggaggctattggtatttggtatttctcgggttgggttgggtgccgtgcccgtttcttaattatcctaatacaaccgacatctcttgcgtccgatctgtttcaaagaaac

SEQ ID NO: 4740 - DNA, 1121 bp, Zea mays
  misc_feature (1)..(100): optimal_loci_265765_G1, chr7:171477307..171478427, Cluster 29
tgctaactttggcaacaaatatgaacttggcaatatcttgttgtcattgtttagtggttgcttctatagtgtcaagcattagaggtttgcaaagaaaagactctacagtggcgagaagcctgacaatgttagtggcactggagttgaggtaccggtgagcccactaagattatcattatgatgcggatcattgaaggttgcctctccatggtcctaatgtgaagctgagggagtagtgtgcactcaagggtcacacttctaaaagtcctagggacacaagcgttgtggtgcctctaggatgtggcatactcccgaatgagcatgagttgaagtgtggtctacagaaacaacacctcgtgaccccatcgaaccatgtcttcctgtaggagatagtagatgataagaccgagccggattacaatgtcatttgtgttgcgactcatgatcggagttgtgggagtaggtgttgaaggctactttgttgttgagcagatgtgttggtgacaccatagttgcataacattggaaagtgcaccaaatcctagaaaagaacccactgcataacttgaaaaatatcattgtagtacgacactaggatatcataagtatcaaaaaagagaaaaaagtttatggatggagtgaggggcataggctagtgacatgctgatcctaaatgcaacctagttatgagcacacatgtagttaatagatgtttgagccacaagatgcttaataacctacatcttatttggttatggtggattaatgaatatgaccttctagctctatatttttatttggttttagtgagagttctaggctactggtctctagttcacctctgcttatgccctttactatctttgaatgaatcataatccttagattggacccaactaaattcttgaacctttcttctatgttgctctactcatttgttttatatctaaaaggacaatagagtgatataagaatgctaggttgcaggtctgccccgacagaggctcaactactcatatgctatcacagacatggagtaataagcaacgacatgccctagacatgtcatagcccggagtacacaccatcatgtacaatgaagctggtatccggtgtagtag

SEQ ID NO: 4741 - DNA, 1050 bp, Zea mays
  misc_feature (1)..(100): optimal_loci_268153_G1, chr8:7309043..7310092, Cluster 29
tagtcttacattttcacatactagaagtagcaacatgttcacacgtgctcctcaagttctttgttgatcaacaacatagcaacaacaatagtgtctctatgtatccacatgtgtggggatgaaatgacacattgttggtgtgatagcaacgcccatgtagcaagagaaatgatggtattgtcttgggtgcccgtaaccctagggagataagcagcgactaagatgattctcttatctctagcgcgatagcctcttcttatatatagactcatgctaatgagtttttaccctaaaggattattaacattttaatggatcatgattgcctcttgcacatatattcaatatctaggtatattttggagaaaaggtggaagtaatagttaagattatcgagatatcatattgataccctcatcaaggaaaggatgggctagagtagaggtttaccagcatttatcgggaacccaaggcgtaagagaaagtgatggcccttattgaaaattatatataaccaatatgaaaactgtggttctgtttgggtgacttcaatgaaattatgttcatacacgagaagggaggtggtcattcaagagccaaaatctgcatggaactgtaaaaaaagcacttgaggattgcaatcttgatgttctagatgacttggctataacatcaccaccatgtcataggatgcataaaaatgttaaaaagagttgttgcttgtaatgaatagcgaaggtgttttccactggtatgtgtaatcaatgacaactcatggcattcaaatcattaccactggtacaaggtttacaaaccaatatctttaattattaaacctatagatgttaccccgcgacgagcataagagcactagtttccagtcaagggtgccgccaagggaatagaataagctagaataagaagtgtgcccaatctagaatctaagatcacaaaatctcttcatttcccttcatatgcaagcctgattagctatatcacctgcactagttattaaacatatatttcacagacacgcgcgcgcgcacacac

SEQ ID NO: 4742 - DNA, 1213 bp, Zea mays
  misc_feature (1)..(100): optimal_loci_268404_G1, chr8:8401663..8402875, Cluster 29
attttctggtatactagtcctgtatctctagccttgtagcaatgatgctttttgcagttcacttcagtttttaaaagatgataatgggcgattgtgcactttcttgtcattctgatgggttatttgcagataatttgctaccacagtgctccaataatttttaacacaaatagatgggcatctgagtcaagaggacatggcatgctcacaagcatgcattaaattcatgtgattttttctcaattgttttctggtacaatttgcgaacaggggagaaagcaaattgaaagtagtagtgctcctcacttccttgtttactttaatccagttcttaatggcaaggggtggtattagtttaaaggtcgcgctcaataatcacatgggattggaagtggaaatacaatagaatactagatggtgtcgaagaatccttggattttattctgctggaatgctgtcccagagaactggtgcaatgcatgctcacgtaggtgcacatgatacaccccatgtttactgattccttctggattcaccattgtcacattaggcatatcaacgtcgaaagcaaaagatcctgagaactcatctttcaagattcatagccccatgatcattcattgtttcacgaatttctggatcctgatttaattgtttgacttactaaaatgtggatcccattgtcaacaattaaagtaatgaagttaccacatgatctgcttctgataggactttggttttgaaggattctaatagaagcttgtagatcctaggaccacactatagttttccttcatttttttacgagtgatgggactgcttgcattatgcgcttcagttcagacaccgacaatttgcatgacacagctaagatctctctcaccattattataatataatttagggattatatgagcatctcacaacattgtttaccatatcctactaatgggggatgtaaatgacagtcagttttcacatgttaggcatctaatgatgtgatatcatgtcgtgtgatgtctacatataatttttgtggtaacatgacctagaatacatctcgcatttatcatcccattttgttggcatgtctttgttcagtacccaagggaaattgttttctattcaatattttgattatttacaccactagagaaagtgtcatcggtatgaaaactgattacaattatcagattcccaaccgatactgagt

SEQ ID NO: 4743 - DNA, 1050 bp, Zea mays
  misc_feature (1)..(100): optimal_loci_268875_G1, chr8:10801591..10802640, Cluster 29
atatgtgctggaataaccaccctttgaacacttcctacagaagacatatatgaatggtatgtattgtttcttgatgctaatgccacccaatacactctattagaggaggatgactgagatagtgtaatgccaaacttagatgatctcggagctaggtataactgggcatgattcataggtttgtagcactgagtggagtcgtataaggatcaagaagataccgaagaatgttctttgtttccctagtgggatgggactatgcaataggagaccaccgaccatccaaaaactcaaggagtatgggtacctcaatatccacaacatcaagctagggcatgggcaagactacaagtgctccatttactcccaccaattgaattacaaaaacaatattgtgaccaaactgaggaccactcgctcacttgaatgctcttagagatgatgacactctagtgcaccatctcttgatctccaaccactttttgcggtggtctttgtgagaccaccatatgcaagagagacccacaagataccaactcaactgactcagttaacaaagagtaaaatttgttatggtgtttatgttaagggcgagtgaactcgcaagaactatggttgatggtgtaatgtactctaagtggttgtgagtcgagtgtgtatttgtgaattattatgtgcttttatgtccttgttccttttactcatagaagtagaaacatatgcaaattgtacccatttcatgtaagttgaactattttatgtatgaagattgaaatggcaatgttaagttgtgtttaattatgacctatgttattctttgttcatgatacattattgtatggaatatatgatccatataagcacattggttttattcctcctatgaacacatagttcttactgggtttaaagcgttttgtgtaaaacatatctaatggaagatgtgtcttggacaaatggttgatacttgcatgttaagatcatgggttgggggtaggaggtgaagcccaaaacaatccttctccatcgccttcatagtcagggcttatg

SEQ ID NO: 4744 - DNA, 1012 bp, Zea mays
  misc_feature (1)..(100): optimal_loci_269454_G1, chr8:13632279..13633290, Cluster 29
acttgtcgggcacgtatcatgctgccatctttgctctgttgctccttgtagtagctactaataaaagcaggagcgtttcttgtagtagcttgcctgttgtgttagtaggttgatcgatcacagatatatatatagtactccctcaatccataaatacttgacgtttcagacaggttagccaaaattaaggtaagtataaatgggctaaattgtccttagtacaaattatacaccgaaaaaaacccgtccagagcttgacaaggggggcaaaaaataagtcaccaaattatagtttcactttgaactaactgcgtcaaatattttaaatgctttccatttatactactggcgtcaaataaaaaaatatcaaaggaagtatgttttggctgcaagtgctatctgtcagttatggcttatcaacaatcggttcctagtcagtatgattctatcagattcatacgcaatacattgagcattgtggctataagaaaccagacggctcccttataaaaaaatgatgatgatactgctgatcaatttatgttaactacacactctagcagacgtcacattagccacacaaaatgttgtggaacacaactgtttacccagtctgccagtggagcataagatgctataaactgctctagaggtttatcacataaaggacactttgcaatagcatataaagatccagtggtgagaagccaaaggtcctggactcctggttagacgcagactctttgtaaaaaaaaattacagtacaaaggtaaggcctttctcagttatttctttcttagacctcatcgtgtgggaaccaccagcacacagtcctatccttttacaaaggtccagtgcatgaactggataaatagttaatattttaagaaactaaaatataacaaaataataatggtcgtcagatactaaggatcatattggtgatcttccaccctgctgctctgaacattacgtagccaaatagttccaccagaactattatggattgcag

SEQ ID NO: 4745 - DNA, 1007 bp, Zea mays
  misc_feature (1)..(100): optimal_loci_271143_G1, chr8:23994258..23995264, Cluster 29
agtgaccgaggtggtggggccgcagagtagtagtgacgcgcagacatttgcctctccacgcaggcctgcggaggcggagcagcgccacacgcccgtcgttgccaatcatcttacgtttgttcagatttatataaaaaaaccataaatttcattatcaaataaacggtgctgtatttttacagtacacttatttatatatatttttctataaaattagttaaacttggtatggtttgcctatggaaaaaaaaaactagagctgcatcgttttctgttttctcgcttcgcatggctgctgtacggcccgacccacccacctagcaaattctagcccgataacgcaccgacgtcgcagtaaaatgggcctaacgcacagctgttaagtttgatcctgttgggccagatgcgatataagtgttgtacatgtctctctgcccttttgtgtcaggaaattattgactttttttagttttgttaccttccttagttgtattttttctctctgtttcgtccttctgatctatagtactagaagaacaaaactgaaaagacacgactaagaataaaattaaggacaccagcaaaacaaagaaccttaaaaaaaaccgttctcttttaacacttcttgcgcaatgttgtttccacacgggtaagtaatattgagatgtactggtaaatatgaaaaaaggttataaacattcatgggaaaagagaacagcaatgatgtataccaatttatatcttacccgtcctataagactgtagcactatattttattttattagatttgatctgatttatttatggtggccatgacatcaacaatataaattgatcttggcaacaatatgacaatcttattttaaatttgcatcgaactaaaatataagagtggtagatttcccccctcctgtaaagcatataaatatttacaataaaattatcttaacttgagctttcatattacatatgtggtggtacaattaaatattaagtaccataactt

SEQ ID NO: 4746 - DNA, 1216 bp, Zea mays
  misc_feature (1)..(100): optimal_loci_28294_G1, chr1:172859837..172861052, Cluster 29
ccgagtcactcaagcatgcctagcgaggaccgagcatgcatcagacctgccaaaaataggtctgatctatcttgtgatacttgacccgttaaacactatgttgtctcaaatactatgaattgaaagaagtgaattagattcaactttagcttacaacgacaagaatgacttaggtagaatatgtaatgccttgaatatagttagttagaaggaaatggcttaggttcaattttgcaatgcatgaatgagttagatataatataaaaatatctttataaactatgagttggaaataatgaattagattcaaccgtgcaataggaggaataacttagatgcaaataaaatatcttaagcatcgtgagttgaagaaatgacttaaatgcaactctaagttggcaggattgactaaggaaaaggactaaataagataaaataaataaaagtacaaggaatgacttaaataatatgaaagtggattaaaattagttgaaaactaataaaaggaatgaataagataaaatgaaggacaatcggatgaaataacttaaataatatgaaataacttaaaatgacatggaatgacttaaatgatatgtaatagtttaaaatggataaatatcaaatgaaattacttaaaagtgctttagtttaaacatcaatcaattagcaaagtacattgtaagatgtaatgtctaaaaacacatgaaataacttacaaatagttggaaaattaaagaaaaatgaatgagcactgagtaagatgaaatgtctgaaaatacattaaatgactttaaatcagttagaaaagtaattaaaagtattgaataagataaaatggctaaaaaatcaaatgaaatgtcttaaactagataaaaggaccgaaatcaccattggatatctgaaagtgattaaaatgactgaaatcagggtgagttgtcctaaaccaaataaaaggactgaaaccccagggttcaatgtcttaagccatttaaaataaataataatagtgggatgtcttaagctaattaaaatgactgaaattagaccgtgacatctgaagacatgttaaaaggactcatatcagagctgaatgtcttgaactagatgaaatgaccgaaatcatagtgaaatgttctagagttgttaaaattaccaaaactagagcgcgttgtcttaaacgggctaaaaaagctgaaatcggaatagagtctcc

SEQ ID NO: 4747 - DNA, 1281 bp, Zea mays
  misc_feature (1)..(100): optimal_loci_283802_G1, chr8:108818330..108819610, Cluster 29
gaccaaatcatttatgttcccaagaaagcaatcaaaaaattgttgtctagtctcaaggtggttgccaacattgttgtggcttatcatttaggtgtgcatcttagaatggttatcattggccccacaacaatcttgtgagtcggtatgttgcacatgtgccatgtagcactcccaaagagggagaggcaatcatggttctcatcttctgagacatagttctcaaggtactctttgtacttggtttggtcgatgatgttggtgaagctcttatttaggttcaatgtagtgagattggcatcatatgcatcgagcttggtgttagttggtgtctcaatgttagtgtttctatcatcaagactatggatgcacacaattatgatgaatcgattcacatcattgttacaatgtccctttggctagtcctcaactatgagggagctaagattgagggtagccatcgtagcttagcagaactaatggtggtaacttcgctttgcgttcttgaacctgattgcgaagtaggtaaggacgtggtgggaaaatggtgttggatctatgtcagggacccaacacagatctaccatgagcatgcatactttatctaagatgaagtcgtgactaaactaggtgaaggtctcatgagcataaaggtccatgtggtggcctaaagaaaatgggcgaatttccacggaatccttaagcccaataaggaacatgcagatggaaggtgactcctctagcatgggtgccttgagttcctacagatgtaggatgtctctaaaacacaaggaatctatggacaaagtgccctacctggtgtgccaaatgtcatgtgtttttacctcaacaacaaatatcatgtataatagataggaaataagaaggatagcatatggcagtggcgaatctaaggggggctagtggggctccagcccccatgcgcttgagaaaacaatggaggaggaagggagagggaggaagtagataaggaaggaagataaaggaagaagacgaggaagagaaaaagaggaagaggtggaaaaaggaagaagaaggaagatgaggagaaaaaggagataattaacctccagccctcccttgagatgaatcctagatccaccactcgtagatgggacacaactttatactggttgggtatgtggtactctatatctagtttggattagatctatttatcttgcatgattaagttacaaggggctgctcattactaatagtatttgtggtatagtctagaactatgcgaggtactaattaggg

SEQ ID NO: 4748 - DNA, 1087 bp, Zea mays
  misc_feature (1)..(100): optimal_loci_284615_G1, chr8:112683279..112684365, Cluster 29
attgtgtggctccacattatattgatagcgaatcctcagccgctacatcgacctcattattaataatgatttgtcagtttgcttttgccttgtgttgtctattgttgtgtgcatgctgtccagtcccgaactcaatttattatttcatctctggagtggttcggtatattttaaatttgtcaagctgtcataaaaactgccacgactatatatgtctggatagttcttatttgattttttttctttcatttccaacaaaagctgatcgatgtccctaggctatacccggccaatagcaatggtgtagtcaaattcacgtgttttgaatcaatcaacactgattctgtcgcgctgtttgaaccgaaaggatggtttacatagatagaatacactaaacctgaaaccgccgcccagtcatggaggcggtaggagcaagtcgttgtctccctcgccgtacagctaatgcaacacaacacttgtttcggtccagctagcttggcctttcccttcttctagaagccgcttcgagagctttctctggcagtgacagtgacagtgacagtgacgcctccagtttcgtgcgtgcaatccaagaggattagcaacttgcgccgccgcctttcaattagtgctaaacagaacagacaattaaaagaggtggcaacacttgttggaagagtgacagagaaacccagttggggcaagatgcatatggagttcttattatgctggtcagaattcagtcgccatccccgtcatggtgtcagcatcctagcttctttccacacgcgaactcatcattcagatatttttctcatcagttgtgccgactacaaccccaaagaattccttttctttttctgttctacaagagagaattcatggcctagtccaaaaccaaaaacagttgaatcaatatgacttgtacaactcatcattaccaaccacttgccggaatcagcgatggtattctaggaagtgatctctctcctcgttccccgtcgtcacctatccctagaatattgaagctcgtcacggttattacttattactacacttttggaaaagcacaaattgacttgcatta

SEQ ID NO: 4749 - DNA, 1291 bp, Zea mays
  misc_feature (1)..(100): optimal_loci_284639_G1, chr8:112760617..112761907, Cluster 29
ttgcagctgaagctcaagctttttttttaaaaaaacgcattccttttctttttcgcctcgtatggtcttcttttacactagaatcgcttgttgctcaagcatgtatgtagcatgtcattaaacgttataaacctacctctctcagacaagaacacatgcaaagtaaatcggtgggctgggcagcaccttttcctttagaatgcaaattagaaagaaaccactacgataatttaccagtgaggacgaaaaaacttgtagtaccacactaacactatctatctgcgcactactgtcagcgtcttggcgcggccgctcgtaattaatgtaaatgcttgactactattcatgtgaaagcatacatgcaggccagccaatattcgtccaagcgatttgcttgcagcatgctttgacttttacgcaggggagatttcccatgcagccgtacctcgttaaagaaataggcaattttcagactaatcgagataaaaatcatgatggtctgagtgagatatttacagtcctgaatttgaaaacatgaacaacgatataataaacaacaacatgattatagattcaatcacatgacacatgtacctttcgttcggagagggaaacaccattgctaccggtggagatgccattactagcggtggtatgaagtcgtcgatcagcgatggaaaaagagctctaaagagctgacaatatacaaccctattaattaagagatgtcttgagaggtttttacagggttaagtacacacaaaaaattaagagatggctctttacgtagaggctgtctcttacgactttttatacatattatttcttaactgcatcaatggtctagagaatgttaggggtgctccttagccgaaggtcctaaaagcattggcttaccatttatctatgagtccattccaggtttaacaaggtaaaatgccgaaggctaccttcatataagatgacaagtagttgcctcagttgtggagacgaagttgtgatcttccatttaatggcgtgcacgcacgataaagaagccaacgagaggaggacgaaatccccaagacttgtttggcaagactatgaaggaaaaagacaacgatgccctaacttcgcttcatagctcatatgtataggcttgaggatataattgtaatttttctgaagcagtactacacgactataaataggggcactgtgccatgcatacagacatattttgccagagtgaattgtctcgcttcgcatgtgaagctatgcttcctttccatcgccacattacgaattgtag

SEQ ID NO: 4750 - DNA, 1073 bp, Zea mays
  misc_feature (1)..(100): optimal_loci_291970_G1, chr8:152690458..152691530, Cluster 29
agtaattacctttataaccaaatcatatgtgttgtttctttcaaatcaaaatcgtgcataatatcattcttatacattgagcggcaacacatgagtgaaaactcaacaacatctatctactaatttatatgatggcatagactaatctagtctcaatctataaactagatgatttctatattcgctaactattaagatatcaattataaaaccacaaaaaatattgcaaattaaacaaatttgaactttatggcaggtcctcaatttaagagcctatttgacagtacttcggctctgacgcaggaggaaaggtagagtcttggcaaacacatttttttaaataaatggcttactttgaaaagtacataaaagctagagccatttttatactacggtaaataagctataaatagtagctacaccgattctagctctggcattttaatacaggaagatggctctagctctaagatatgttgtttttatcaaatgatttgccaaataccttcaactctaaaaaaagttgattttcggagaaatctagaaccataaatgtttttagagccctgccaaacagactctaagatcctaagacgtacgcttctacaaacatgtacgttgttgttctcctttctatttggtacagcttaactttactggtaaaacagtttatctcatctttgagtaaaaaaagagctttacgaatgaagatgaatgtgtcttgatgaaccctttggtaaagcagcttgtttcattagataaaaaaacgatcgcaatgctctttcaattttttctcttcttttctttcgtatttcttcgcatctctccttgtcctttccggccgcctcatccatccattccacgcgcacgcggcacgcctccgtgtcactagctcttcggccatctagcaccttcgcttggcccgatgtggccctccacacccatcataaaatgacaagtacgctcctcttcgacatacgtggcccttcgatcagtctgacgagagtgcccctctggccctctctgacgtttgtgctccgacgaatgtgtgtgagtgactgcatgacatgtcg

SEQ ID NO: 4751 - DNA, 1377 bp, Zea mays
  misc_feature (1)..(100): optimal_loci_292717_G1, chr8:156668436..156669812, Cluster 29
gtcgtctgaaggatgacgtgacctattgtctaggacagtcttgttgacgtagccctcctgacgttgtcttctggttcatgcatggacgtacgctcggtatggaggatcgctccatctgcccggtaggcggggttactgtagcgactctcgtggcgagttttcctgtagcaccatctagagggactcatgggttcatacatggggaaactagatcttcaaaaatcttgatcttgcggtaccacaaacatcgaagaatctagatctgattcagggtctccaggcgagttggcagtagtaccccgagcgctaaaagcagacatatctcctaatgcgaaactcatggttaccatcatatctcgatcagcttgacgtcccacttcttagcgtgcgaaccatctagaatttttcagcactgaatttatggggtgaatcgcgagatctagaactgaaagtaaagacataaagatttagacactcttagtctctcgatgtgagataacacactttaagtatacatcggtgatgcttacgagtttgaatgaaatctgaatgcatgcactttgaatttattattacaatgtgtgtgtgagagactaggatggagcatgctgcatgtgtgacctctgcgcaagcagtgtcctacatctacatggactgtctccactctctccatgatttttctgctccagtggcctttggatcgatcgtctcctcctcctacagcggcatggtgcgcctagcagagctagctgtacactgtctccgtgggccgtgggcccacatgaagcaacattactgaagcacgacctgccctttctcgcattatatttacattcagtcagtgcaagataataatatcaatactgatatatagtatatatacagaattaaacgggaagctaggtctcagcatatccaccgactagcatagcatagcagtagggaatagcaacgagctaggtagcaggccagcaactatatatgggcttagtcgtcttttgcaaattagaatacattatcatctggatctctctttctcgataataatgctcccttgtttaagctctaccctgtttttctgatacagtcagttccatatatatatatatatatataacgctttgggccggccatgcatgtgtgctgtttgatgcgacgtagtataaattttctctgattcaatttcaacaaacaatgagtgagaaaagggagcaacatcattgaggcttggtagaatacactgttacttataggtacactgttgtgtgtgtgtatatattcttgtacagtacaatgattttcaaccttaaccggttacaatttaaggaccgtaacgtttaaggtagccggctatactatataatttttagcctaata

SEQ ID NO: 4752 - DNA, 1075 bp, Zea mays
  misc_feature (1)..(100): optimal_loci_293613_G1, chr8:161151747..161152821, Cluster 29
ctccttttatagtccaaagaggggcggcatttaaaggatatgtatctaggtcgattagaagacatggatagaaattgagcctaactaagcctatcctgaattatcgggtagcttatatttatatgtacaagtgttgttcccatatctatgggattttaccatatcttcttggatgccaatctcatctccttaatctgaaaagaccttttccatatttctctctttagaatctccctacgagtagaatcttcctctggtcacgtgagtcgattccctaggctctcaaccaagcccatggacccacctgacatagatttctctagtgagatgtacttggatacccctagtatatatctctaacagttacacctaagtattatttggtcgagtcgttggcttaggtattcaagaatcttatcttgaaacttcttgtttaacttgaccctattgtatctgagttgttttacctcctagctaagtccccaaccctcaagtctatagactcgacttttactatttaggactcaattatttcattgtactggcacttcaaattcagacaatttgtatcgctttggcttccttaaccatttaaaggtaaaaaaactccatgacacttcaacttctgcaacttgtcataaaaggaactaccccatggcatttggacttcatgggctagttgttcatagctttacattctagcctacacctgcatttgctgccacatcttccctagtgctcttctcatcctagccttttttgccactgccaaattcaaaaatcatagccatgcccaccaaatgtttgttggaatgtctcaaccatctaggaatatcctttgacctagttctccattacttcttgcagtctcatgtctttgttcatgtaatggctctttgattagacttctctccctccctggtctcataagatttttcctccttggtctcatcaacaactaaggtagtaagttatcactctctcacttgtctttttgctttctccatcaggtatactcatctttattttatgtttcttacatacattctctctttcacacaacatgttggtcagt

SEQ ID NO: 4753 - DNA, 1122 bp, Zea mays
  misc_feature (1)..(100): optimal_loci_293828_G1, chr8:161865122..161866243, Cluster 29
gtcagcattggtgattcaggttaaacacagtttaacattgttccttcattattgggtatttttttggtagatgcatgaactcatattcagtaatctatgcgccgaatgcagtattgtgagattcttgtaaaatcttagttgaaggtgaggaagtgatccattttgtattttaatcccaaagtaacaagactgctttaatccattttaaagtattaaatgtaactgatgaagctttagggtacagctatgaatttagtttctgtttagaggaaattagccattgaaaatgctgtgccgtcatctagatgctaatccaatttactgtaggttcttgaatgatatagtttaaatgctaatccaatttactgtaggttcttgaatgatatagtttaatagttattttttctctaatatagaaatagacctattgtaataagggtcaaaggggcgaattctagtatctatttgtaaacatgcacccaagaggaatttcttgtttatttgaaagccacccatcatcagtaaaagaataaattgggactgtgtactgctacaaggccaagttgatttggctagttgctttacttgagtgtctacagatgatgtttgttatatttgttgatttgctgttaaaggacaaagagttgtgtttcacttcacaaatcacaacatcgaggtatgggaggggttagggaattaagtggtttaggaatcgaagggctgtggattcctgtcctgtatgttgttttatgttttgacatgcataaatgaaatcctccaagcttgtgtttttcagcagaattttggttccttctagcatgaaaaaaacattgaagttctagctctaaaataattttagcaagtgacagttagttacctttactggtgataacttttactcatgcaaaaactagttagccgcttcttttggtgcatgcaagtgctgattatctgcttttgctggttgcgtcctcatatcttctgtcattttttataatggaagacatatttgtcgtggatcacgttttgttaccgcttaccagaatcatggtgctcaatgtttgcaacgtttcgtttgcatactagaaaacatgatttccatctatagtttctccattctag

SEQ ID NO: 4754 - DNA, 1113 bp, Zea mays
  misc_feature (1)..(100): optimal_loci_295106_G1, chr8:168014501..168015613, Cluster 29
atactatgagtttttttttttgttatttggtctattcagatattaaagattaagaaccaaaccctaatccgtactcgaaacatagtaaatgtaggaatcgaacctaaaactaaaaactccaatataccggcaattcaatatatgtaggttgagtttaagttcgaatttgtttttcaattaaaaaaatgctcactcctaatggtaggtaggagagtccatatcaccgagtacgacacgggtggtagacgttaaagaaaaggtgccaaaaaaaggttattagacaatctaattttacaataaccctatatattttttcctgtcaaaacgtacctaaataataaccaaatgtacacatgtgcaactaagttttttccctacaaagtaattgttgttgtttccacggtgtaaaaggtgttacgagatctagtttttatctatcaaatagactatgacttaagaggtatttgtttgttattataatctgtccagattatataaaccaaaatattttgaactaatagttattttaaaatatattggatcatatattccaaacaaacatcctatgagttagttagaaagggaaaacacgtagccagagaatcccgtcgacaaaagacatttgtttcctgctgtgttcatgcttcatgacggcgcgcgccgcgcgcgcgcacacattcacaccctaccaatcttttatcaacatggtcccgatttttctctgcagcgacgccgcctttcggttccgagagcaaaactggattcttcaaacgcaagcacaatgctttcccaccgccgaaaagcaaagcatacttgttgcaggactggaaccacagagatttgatgctcgggggaaattaagaacgcggcgtatcgccgtagcgaccgatcgatcggaaaactcagtgctactgtcggctgcttaactttacacggccagcatcttgggctcttggcaacatgctcgcacagcgctgctcaatgttgaccgctccatgcgccaggcctccagcgttcgcgtgcgctcgcagcttcagaagcagagctgcccggtgcccgctgcccgctgccgtgccggtccaattcagagtcggagcttgagtacggccatga

SEQ ID NO: 4755 - DNA, 1103 bp, Zea mays
  misc_feature (1)..(100): optimal_loci_295605_G1, chr8:170257902..170259004, Cluster 29
cgtgttgagaataaccgaataatgtttatgcttcgcatagttgttctcacccccaagatttggagacgatagggagaagggtaaaattgttcttcaagtcttcacacttcttttgattggagattgatgagatataagaacaaggatagatgataaccaaatgataacaagaaatatcaagtgtgatcttcatgccttcgtcttcccttcatttgagattaaggccggaggtgcaataacataaggatcatgtgttagcaaaagacgatgaggaagatatatatagaatttgggtcttcaattcttcaatgccttgtcgtttgagcagatgttatgaggccgacaacaggcattaccccacttaattaacaagagcattgccacgtccaacgccttgtttttagagccccctcaaaaaaactcaaggacgaagaaggcacacgcacacaacacaccaaacaaggcaagcatgcatcacaacctcgacgctaggcgtgcttctgttcaagcggtagtcatcctgaaaggtagattatggatgatgaaggaccatctaacatttgaacaaggtaagattacaaaacctctaattttaaaggaaatgctgatagaatagaggatatataaggtcaatgatataataaatactatctcaaaggatcttatatcaaggatgggagacaataggacaaggatagaagatatacaaatcaaaggtcaaggattacaaaggttgtgcggctacactagctaccgactaccagcaacaacatacttgacggtgtggactctcaactttccactatggcacgatatgctcgacactatggcacatcaaagacgtgcattgtatacgactccacactacagtaagatataagtagttgggcctctgctaggtggaacctgctgtataaacagaaaatataactcaaagaggctctcagaaaggtagtacctttagtatttgttttaaattttcccagttttacctagaaaactatgtaaagccgaaaactttttcaacaagaaactgtttcatcaggatttgtttcgacgtgatttatttaatagaagaagctgaaaaaaaaagttgcctgaaa

SEQ ID NO: 4756 - DNA, 1263 bp, Zea mays
  misc_feature (1)..(100): optimal_loci_296698_G1, chr9:335896..337158, Cluster 29
  modified_base (831)..(831): a, c, g, or t
  misc_feature (831)..(930): n is a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
actaccatagtgacagtaagagtcgtggatgcatgtgtaattttaaaataatcaaggggaaaagaaaacttaggcaaaagtcattactacacactacctctaggtcccgaataagagatgctccctattagagccagcgagcatttttctagggaatgcaagcgtgcggtgagagcttgacacataacgagcattatgtagtgtatgaggtgaaactacatttttctttatggtttctttttatatggtattatcaatgtatttagacatatgttgttagtgaatgtattcactaaaacatcgaaatcataataatatgttcaactagatatgggtttcatctatgtaaataatacatgttaaaggatatttatagaagttcttgctttcggtattgcttatacaaagcctaaaatacccttgagttgttagactacaatcctttgtcactgcaagggtgatttagtcatttcttcttctctctctctctcttagtcattagttcttatcaacagtcatggtttataggcgaaacttcatatcttgtgagtttttcttgacttataaaagggagtcttggtcaagaaagctttgtagatcttgatgtttcatttgcctttcatagaaaagtgatcaagtgatgtcacacctcacttcggtatttgtagaaatgattcagtagacttcatctttgaatgcaaggcaaaaagtggttgaacggattgatacacattatagttttcatgaattgaaacatgtgtctcctctttgtcatggctttatgttagtacaaagttgatctgaaagcaaatgccgaataaagaaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccggaggaaatcagcttggattcgttatgttatataaacttggttaacacagtctaataactaaaagaaggaccggtcattgaatagggccaaattcttaaacaaatacataacaaaaaaatatcgattaacatactttattagttgaataggtttggctctattcggttcattggtttccacccctatttatctcctttttcctctaactttgaggaacttcactaggaacattttgtttcacctcctacaaattggaaaactaataagtaaaactccatcaatagcattttttgtttcgcaacgttaaatcaaatgaaatcatgaaata

SEQ ID NO: 4757 - DNA, 1012 bp, Zea mays
  misc_feature (1)..(100): optimal_loci_297221_G1, chr9:2265090..2266101, Cluster 29
taaaggtgaacactctctcatagtactatcccgttaggtaaaggtgaacgagcaaccgatcgagctataaaaaaggtcatactcgttttcaacttatatccttttttggctaagataaagtgtaatagttattcttgtgtgtcgtaacacatggatattatactagccacaagtaaaatggaaagacgagaagcaagcatagtcctaatccgtttatatacaattttttattaaactgttatccgtgtatatatatattattaaataattatttttagtgtagacctatatacataaaagttttattttataattattaatatttaaagaataaagaatgttttcctgtcttctatttatgatttttctatttttatctacttgtaattctattagaaattcttccttgtaatcctattaggaccctatagtgtaaccagctagaagacttgcctcctagactgtataaaatagaagtgggcttcccatcaagaacacaacacatcaaaatccaacgcaagataataggtctggccagatatatgatattacgctcttcaacggtttgaactagtataaattgttgtctatatgttcaccatcaagtctagcctacattgaagccacccaattcctactctagataaccatgtagcatgattgccgatcatcatacatcgacagttggcacaataggtagtgattttcggcgaaaggacggacaaaagcttgatagacctcaatatatacatcacgtttttggggttcaaattttgtatttgcttgttggatatatacaacgagcttctttaccaaactacatggtcgcttcgtggaaaccacaaagaacgaagtacccctagcttttctcaagacacgatgtacgagttcgtcaagaacttcaatgaattttcaatctccaacttcgaactagatagacaatcaactcaatctacatgagtcctagtcagatacaaccaagcttttcgagtcggcttcccagctgtcgaac

SEQ ID NO: 4758 - DNA, 1068 bp, Zea mays
  misc_feature (1)..(100): optimal_loci_309261_G1, chr9:73020525..73021592, Cluster 29
acacaactcttctatatattgtcttttaactacatatttataatcaagaaactcatagttatatcatagtcttctaactatttcttgcacttgaaaataccgatttaaaggatcggagttttggatgccctaatgctactattagaattgactgtgcgcgctcgtcaccaagctagctagctgaattgcggcaagggtagctttcgaggatcgagggagcacacgtactacccatgtctcgaggtgccctgtgccaagcaactccaaatctatctctcctagtctggcccaatggcgattccacaccggagcacagggaatagttagcacagggagtaggctctagcaagttgccatgctcaatctttcttttcgaggcctttaattaggccaatagccacgtcaccgtcatgcctcctagattccgtcgcctaatttagtataggacacggaggattggcgttgggtgctgtgctgcaaaaatctccgcaatggatcaccgtctgcactgtgcgctggtagtagtcactttcaactactttgcacctcttgcaagtccctggattattgtaacgggtcatgaccttattatcttttatttttataaaataaaatacatatattacattagtaaatcggattctctagatattttaagagcttatacaacaccatattaatgtgatctattgagaggtgtttaaagacaaatgaaaggaacaaaagatattcgtaaagagtctgtctctatacgactatctatagatatgatctcttaattatatttatgatcttaaagcttatagttgtatcatacaatagcttaattatctcttgtacttagaaaaccgacacagaggctcagagttatgcatgctctaagagagatcgcatgtaaaatgtacaaaattattgcaacccgattcaacactgcccattggaaagattctaaaatgacggaaggggtgttttggcaattcccaagcgacaacaaaactcttcgtagggtttgaacctaggagagatctcagacaatggagcagacatggatgagctcgtgagggagat

SEQ ID NO: 4759 - DNA, 1131 bp, Zea mays
  misc_feature (1)..(100): optimal_loci_309318_G1, chr9:73255026..73256156, Cluster 29
agggtaaccaacccaagttactcaactagttccgcaagatgcaagaattctatgcaatgcattaggactgctctaatctcactcaaaagatgaactaaaagctactagtgagtcgagtgtgttttcttgcctcaagaggttttcacaagtatatggagttgggagatgctagccaaggctgatcacaagtgtaaaatttgttccatacattttggaacttctaaatgaactagcttgaagactcgcctcgatgttgtcatagggtgatgagatatagggtcgttgtcttgctggaaccagagtagaaatgtgtgaggaattgctcctacatctaccccattgatgtgatggatttgggctagagggatgtgtactagcttaatgtgtgttctgatgacaatagagaaaagagtcgaacctttatgtgtttaggtgatgctggtagtccgaattgatccttgtattgactcatgtgtttgatggtgctggtgtcgttgctactactaaatttggaaaaaccaggcaccttgattttcgatgaggtgacatttggtcaaactcctccagataaggctttgcataggtgatcacctttcacttgggcaggatcccaaattgatctttcaggtagtccaatagttgctcctgcatgctggcagcgttggcgccccaaaaaaaatgtgtcttggctactgagagccggcccactgtcgtacttggtgtgacactcaagtaattcatgatcatcaatcttgtttttatcattatctagttgctgaggttgttgctcgagctcatgaagtagtctagtctgcacatgaatcaccctactagttggttgtcgattgatgggatctcatgcggcatcctaggatgatacatgatgcactctacctatgtgcctttaggtgcgttgatatacattggcttcatcagtcgagtatcgaacaacttcttgccttgatacaactcaaacgtggtccctggtacagtgtagtatctggccaaaatggacttgtcactcgtgttgtgaccccctctatgatgttgaggaggatttttgattgtcgcaccatcacttaatggattatgtagttcatctcctaccagagggcagcactacactccttc

SEQ ID NO: 4760 - DNA, 1208 bp, Zea mays
  misc_feature (1)..(100): optimal_loci_313744_G1, chr9:99702731..99703938, Cluster 29
taatgctaattagttcattaaacaagataaatgatcgaataaacagtataaaaaagtcgattgaacacaaatgtcgtactactgtatagatagcattgttgtggtgttcaaatgggctaaataactatttatgctaataaggaaacaaataagttgagaccctcatggtccttaggccagggagcataattctatcatattaccaagttaaagtatcttaaaaaaagtattaatatctctttgctggaaaggtgaagaaccactctagtggactagtaacactacattgcaaaatttagctcccggtcgtgaattcagtcttaaaaaatgtcgaatatttccgatctcttgggcagtgcacctcgctccatagctaggaccaggagtatttaataagtacaaggcgtagcatatcgtgagccaaaagttgtggttccttctgacgatctgatcgcatcggatcatccgaattccgaaggcagtatcagacgtgacttcgtgttccgtttttgcctcccgtcgttcgaattccgaaggcatattctaaaaacctatttagaatattaaagtttaatacacatataatcaaactttaattagttgtttgaaacataatatagtacacatatatatattcatcccttaaagattaagctaagctaagagtttttaagattgataaagtcatcgcaggtcttggtcactctttttattcctagaaggcatcaaaacaaggcaacacaattaataaagagagagagaggccttctcctttttcaatttatctccagcttccgagatgagctgattaggagaaggctaatgagattgaaaccttaatgaaattgagaacacaaatgcacaaaagagatcctcggagttgtaccctcttattattctcttcttacaaatttacaaatgaatacatttataccttcgtaagtacaagaagcaatctattggcgaggattaacttaactttggaggcggaacaatccggtgctacatgaataagtcaccctgtgcatagacgttgttcacctatatatatagggataactcggtatacggtgtagaattacaattatagcctcaaatcctatacacattactacaaaaattgccaaagacattaacgtaatttcttctgaagcagcagtgggtctcagggcctgcaatagttacaggaagcccaagccaccccatgc

SEQ ID NO: 4761 - DNA, 1221 bp, Zea mays
  misc_feature (1)..(100): optimal_loci_314275_G1, chr9:102369751..102370971, Cluster 29
cacccacaaccctagggagagaaacgacgatgacgactagagcgagtctctagcatgttatgcctttcatatatgtagacctcttctaatgggcttttacgctaaatgactattaccattctcataggtcatgattgccttttatacatatattcaacacataatccccaacaaggttctacttgaacttgattattcctccatgtattaactttgtatagaataaacaaagtctttctttgtaggatctggccaccacccatactttgatattgggtctatagatcgagccttcctcgtaggatcaatagattggtcgtgaagttctactagtagttttgctatagctttctcaactaaggaagaatgacctagagcagttgaggctacataggaattaccagttgtggcaacaaagttctctaggattagaaattatcatttccacccttgcatgctattattctatatccacttctacacatgaagaggtattcagttatacacatgaataacatgcaagagagcatagcagcaacaacaagaaaaaaggggtacatgtgtacataggagtagcaagccaacaacaagcaccaaggggcagagggtagaacaatagcatcacgcaaacataaagacaacaactaagaaacatcaataagataagagcatacaacatgtagtagatctaggcttccggcaacatcaagcatgacaatcaaaggcaaagaaagaagatcgaggactgtgaaggtaagaagtagtgaagtacactcaccgatggaggatgagctcaaaactagagaggcaatgagggagcataaggcttggtgtaatggtgtgcttgtgcctctcccttgatcctattttgtgtgttgtgtataaccctattagactgagaagccagaaacccagcccaatttttctctcctaagcccacttgagaatcctagagtggtcgctccaccacctaatcaaacgattaatctcatttactcgatgaccaatcaaataaatgaccaggtttttggtcgaggtggtagggtcagtagtcttggatgggtaggagaaccgattagctcgagtaatcatgactaatctgatgacttataaacagtgagcatgactagtaaagataagtaaaaaaagctaggtctttagttttacacaacacaaggactaaaaggttctagagaaacttggctcattgtctcgacaatg

SEQ ID NO: 4762 - DNA, 1265 bp, Zea mays
  misc_feature (1)..(100): optimal_loci_314282_G1, chr9:102382498..102383762, Cluster 29
cctttgtgatttatgatttcttattactcttgatgatttctatcacatagtcagtttgttgcttgtggaggactgttgagaagatcttggtgattgttgtagtctttgattattccatgctgaggaaactccttcactctctcttgcttatccccgttggagaatcacaaagagtaagtctggtaaaataaacagtggtttgaagaggtccttggtaatctaccatattcgaagggaagtgtggtgatataaggatccaccctaatacaaacgtaggttgcatataagcaaccaaatcttggaaaaagtctttgtgtcactttcccttagtgattcgctctctcaacatttgcattataatccataagttgtgcttgtgttgttgcttggtagcctaacctagctctaggaagtagtgtagttgttactttcattagtagcttacttgttgctagatgatggttttagttgcttgattggttgtgtgtttagttattgttgttgcaactatacttgtgtaagtttgtattgtatagcctatacaactagtggatattagtatcatctcctttaccaacatctttgcctagtgtttgtgaacttgtagaaatttaattaggctattcaccctgctctagtcgtccatagatcctttcaatcactgccgcatcaaatggtttactcacaataatgaccacttcatcatcatcggatcaaatgatacactggtggtgaagtctcttcatctctaaatcatgtgtcggaccaataatgatatctactttatcaccactagatcatatgttgggacaacgataacgaagtttgttgctgccaatttttgaatcagtggtgatgaccttagttatcactttatactttcacaagcgcgtacatgttttgcatacatttaagccaaaaacattatggcattctatattgaaactttaattataagaactatttatttatgagaaatctattatacatgtatttttctgataaaaattaacatcttgatcagtaggaaaggttagggcagcaacaaagctaaggtcattaatgggtttgattgcaataatgggacgtgatgacataggacgatcaattagataaggttgtttggtttagggccaggggttgggacagaaccatccaagtgtcgtccccagttgttcgttggaattggatggaagagagaggacacctggaggttgtccccaactgttccagttgtcttgcaaccaaacacaacccaaaggcac

SEQ ID NO: 4763 - DNA, 1015 bp, Zea mays
  misc_feature (1)..(100): optimal_loci_31763_G1, chr1:195177058..195178072, Cluster 29
  modified_base (304)..(304): a, c, g, or t
  misc_feature (304)..(403): n is a, c, g, or t
  modified_base (305)..(305): a, c, g, or t
  modified_base (306)..(306): a, c, g, or t
  modified_base (307)..(307): a, c, g, or t
  modified_base (308)..(308): a, c, g, or t
  modified_base (309)..(309): a, c, g, or t
  modified_base (310)..(310): a, c, g, or t
  modified_base (311)..(311): a, c, g, or t
  modified_base (312)..(312): a, c, g, or t
  modified_base (313)..(313): a, c, g, or t
  modified_base (314)..(314): a, c, g, or t
  modified_base (315)..(315): a, c, g, or t
  modified_base (316)..(316): a, c, g, or t
  modified_base (317)..(317): a, c, g, or t
  modified_base (318)..(318): a, c, g, or t
  modified_base (319)..(319): a, c, g, or t
  modified_base (320)..(320): a, c, g, or t
  modified_base (321)..(321): a, c, g, or t
  modified_base (322)..(322): a, c, g, or t
  modified_base (323)..(323): a, c, g, or t
  modified_base (324)..(324): a, c, g, or t
  modified_base (325)..(325): a, c, g, or t
  modified_base (326)..(326): a, c, g, or t
  modified_base (327)..(327): a, c, g, or t
  modified_base (328)..(328): a, c, g, or t
  modified_base (329)..(329): a, c, g, or t
  modified_base (330)..(330): a, c, g, or t
  modified_base (331)..(331): a, c, g, or t
  modified_base (332)..(332): a, c, g, or t
  modified_base (333)..(333): a, c, g, or t
  modified_base (334)..(334): a, c, g, or t
  modified_base (335)..(335): a, c, g, or t
  modified_base (336)..(336): a, c, g, or t
  modified_base (337)..(337): a, c, g, or t
  modified_base (338)..(338): a, c, g, or t
  modified_base (339)..(339): a, c, g, or t
  modified_base (340)..(340): a, c, g, or t
  modified_base (341)..(341): a, c, g, or t
  modified_base (342)..(342): a, c, g, or t
  modified_base (343)..(343): a, c, g, or t
  modified_base (344)..(344): a, c, g, or t
  modified_base (345)..(345): a, c, g, or t
  modified_base (346)..(346): a, c, g, or t
  modified_base (347)..(347): a, c, g, or t
  modified_base (348)..(348): a, c, g, or t
  modified_base (349)..(349): a, c, g, or t
  modified_base (350)..(350): a, c, g, or t
  modified_base (351)..(351): a, c, g, or t
  modified_base (352)..(352): a, c, g, or t
  modified_base (353)..(353): a, c, g, or t
  modified_base (354)..(354): a, c, g, or t
  modified_base (355)..(355): a, c, g, or t
  modified_base (356)..(356): a, c, g, or t
  modified_base (357)..(357): a, c, g, or t
  modified_base (358)..(358): a, c, g, or t
  modified_base (359)..(359): a, c, g, or t
  modified_base (360)..(360): a, c, g, or t
  modified_base (361)..(361): a, c, g, or t
  modified_base (362)..(362): a, c, g, or t
  modified_base (363)..(363): a, c, g, or t
  modified_base (364)..(364): a, c, g, or t
  modified_base (365)..(365): a, c, g, or t
  modified_base (366)..(366): a, c, g, or t
  modified_base (367)..(367): a, c, g, or t
  modified_base (368)..(368): a, c, g, or t
  modified_base (369)..(369): a, c, g, or t
  modified_base (370)..(370): a, c, g, or t
  modified_base (371)..(371): a, c, g, or t
  modified_base (372)..(372): a, c, g, or t
  modified_base (373)..(373): a, c, g, or t
  modified_base (374)..(374): a, c, g, or t
  modified_base (375)..(375): a, c, g, or t
  modified_base (376)..(376): a, c, g, or t
  modified_base (377)..(377): a, c, g, or t
  modified_base (378)..(378): a, c, g, or t
  modified_base (379)..(379): a, c, g, or t
  modified_base (380)..(380): a, c, g, or t
  modified_base (381)..(381): a, c, g, or t
  modified_base (382)..(382): a, c, g, or t
  modified_base (383)..(383): a, c, g, or t
  modified_base (384)..(384): a, c, g, or t
  modified_base (385)..(385): a, c, g, or t
  modified_base (386)..(386): a, c, g, or t
  modified_base (387)..(387): a, c, g, or t
  modified_base (388)..(388): a, c, g, or t
  modified_base (389)..(389): a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
tactattcttcttgggggatgagcatagatggacgaactagtacatatatagtagcattggaaaaaaaaatcaacttctagggtttcaaaagtattattctagaaggaaatagtgaccaaagatacaattcgaagacctaataaaagactaaattaataagcactgtaggagtattgtttttatggaatgcgtatgcatttttctccaactccaaccccaaccccctatcccaagtcccccaactgtattgatgacttgcgagtcgtgagtcttgcgttgcaaatgatcgaaggaagtggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatcgtgagttttgcgtggcaaattatcgagggagtggcgtcccaatgatccggtatacaaaaaagtcgggccgggccaaaaggagaccagcgaacagaccaatgattgaccctccttttcttccaatcaggagcacaataaaaacctctttgcgcaaaataaataaagcgaaaattaaaaggttagagtcgatgggtccaccaagcactagctagctagtgtgccactggttatattagtggctactgctatacaagctgtttgtttggcgtcgctgtccggccattgctgcctggcgtacacatttttcgcatcacgctagccatagccagaggcgagagcctgagtgcaagagaaaaaaaacggcgttatggattttttttttttgtttttgtggttgtagggtacgggtggcggtgaggtggatctggtgtaagcatgccatcactgcatgcatcccttactctttttcttattttctacctctcgcttaatttatagctttgtgatgttctttatatacagttttcgtccaatacatgtcaaggcaagaagaagaataagaagaggtgggggagggaggtttgtagctaggctagcgttgctggt

SEQ ID NO: 4764 - DNA, 1198 bp, Zea mays
  misc_feature (1)..(100): optimal_loci_319482_G1, chr9:130826353..130827550, Cluster 29
taatcgttagaaactatcttcccagcctatgattgctaaagcagtttctatatagagaacaatttaaatacacacacaaaaaaagagagagatgagctggggtagcgacaaagtggcctgcgcgtatacatctgtcctctcactcgcactacagtacatcacatgcaaacacattcatatagttgcatgcatgctttatatcaataataccaattgataagtaataggtgtcatatttggtaacaaaataatctaggattataatcattagaatatatacatattaaactagatatgtatccatcatcctttgtttggagcttttttctagattaggctggaagttcaataataggtttggctgcattatttgatttctcttttcctccaacatgtggaggtttttgatggtttttttgtactcctacgctgtgtgtggaatcgcagagacgggaacttttgaaggttctattatctaaaaatgtatccatcatccactctctctctctctcggtaatgataaacgataatgcgtagtaattaaaaataaattcagtagaatagccatgtcagtacgtccatctctcgctgggtctgtactttagacgcacgtacagtacctccatatatgccacgtacaggagaactccaaaagtcgtcatctacaatgaaaaagagttaaataatgagtttttagttaaacaaatgaacacttaattatggctacatatatataatataaatttgtacagaccactatgaaatcattcatacaagagtttgtctaacaaattatttaagtacctaattggaattcccaaacttatgccaaatatgtttaatcaagtctaactgaagttgcttatgagtagaatgattctgaagtctagcctttctttatactgtagtatttctgacatcatatctttgggtaagctccatgagtgattattgtagctacctgtactactgttgatgtgattgcttcctcgttcaaatccgtaggaatctattccatacccttttcatattcctcaattaccatgccggccggacgacgtaaaatgcaaaagcgagattgcagagtattacaaattaacgcacattcaatgccctagctttcttattattgtctggggacacaccatgcatgcacgaacgcggatgaatcattgacggctgctgcagcatgttgagg

SEQ ID NO: 4765 - DNA, 1058 bp, Zea mays
  misc_feature (1)..(100): optimal_loci_319986_G1, chr9:133500567..133501624, Cluster 29
cggtcccatgatgtagcccaggaaacttttatgatccttaactaatatattaggtggggactctcgtccccatggtggaggaagaggtggaagctctggcacacgtccgcgtcatcgtcctccttgcattcctgaagaggctcgaggtgagagattcacatttgacggatctcatgtccttttttagaccttctgttttcgtgtacgagctcacattacattacccgttgtaaaccttgacgtacccatgaaactctttctgatccttaattaatatatcagtggggactcttcgtcccctcatacgtttgtctgctttcaaaaaaaaacatttcactactatgttttggtatcgaagattttgttagggttgcgactggtgcggaattgtgttcttgacctgcacaacatcggggtctatggtttaatgcgagtgaacatgtcactatcaaaaggaatcctcttggagatagagtggctgctgagaatatttctgatgaacttcatcaatctaaattgcatcatctagctctttggttgtagaacattgcattaggttaggttaggctaggctttggactatcgactacctttgaacatcgctttttaccgtcactctgttggggcggacttttgcatccttctaacggctctagtcctattatgaaggcttgtgttacctctttagtggtcaggatgcttctactaatatttttcatatacatatatggcttcggctaggtaatatttgatctcggcgatgtaccatgttgtaatgaaattggaaatttctattaattcctcctaatattattggttaaaagtcaaaaataatttcatatgaatggataaaacaaatattcgaaatgacaagatgattaggtagaaagaacctatttttactaaaaaaatacagacgttcagcaagatatggtggcatcgacataaagtgacgaaggacccgctactgtccggccataatatttttccatctactgcaggatttcttcctcttaacttatttgaattagatggcggcaatgcgtgctatttgatat

SEQ ID NO: 4766 - DNA, 1062 bp, Zea mays
  misc_feature (1)..(100): optimal_loci_319990_G1, chr9:133502710..133503771, Cluster 29
ttttgcttgatgtgcttatatgttgcgtgcacaaaaactgtaggttctttgttgttggaattctggtggtgatgcagacaggctggtaaaccaatcagggcaaaaataatcagggccgttagggtttgtttactttgcaaaataatcagggcaacctaggaggcgtctccttcagagccgttagagggtgtgttcgttagttcgagaaggtagcagccttggcagagattctgcgcttctccaccaagaaagctgaacatgatgctgctcaactcatcttgtgatgcatgcttatcttattgaatttgtgttaaataagcttgtgagtggatgatttctttggttagcattagtatgtttttggtcttgctcactccccgttgaatgtagcttttgattgtttgggaacgctatctgaaactgtgaacccatttctgaatttagcaagacattacctttctcagatcagtacatagattacagttccatcaaatggtgacatatagctgcatatttggtacataggttacagttccatcaaatggtcaagtcagtaagtagagctcttttacttgctcttgtagtgttgtctgtctatttggagtagactgaacctgaagtcatagccttttttgctcatgctgttcagaatgttcagcttggtttgctacttttggtcagtgccatataaatttttgactatatattttttgttttcttttgacaaaaaagagctgtcagtagaacatcaccagtagtttctgcatgtccctgtgcacatgtttccacccgtttgaaccaaagttggttgtggccttggtcaggatatagtatgacataaatctgtaatgctatcgaacctagtatgaggcatcacatggtttgtacaaactacattaatcggattacatgtcttgatcttggacacatactttgcatgtgcccttaatgagcttgatagtttcgatgtactcctagcgcgctgcagatatcaggatgtatagccgccatatgggccttcactgatgctggtttcgttggcggtagagtggagtagagtga

SEQ ID NO: 4767 - DNA, 1146 bp, Zea mays
  misc_feature (1)..(100): optimal_loci_320608_G1, chr9:136142400..136143545, Cluster 29
taagacattttatatcttattatatattatttttattatgtgcctagacatattgtatatatcaaagtgcaaaatgctagtatttcatagaactatgacccatttaaaatatttaataattacaaacgcttgtattaaaataaactatgtatgatcctttagccctgtataagtggttgatgaaacaactgtatgatttatatggttggtcatgtctatctaccttgattggctgagaaaatggtcaaggcgtgccacacatgcagcgttgcgcagcaaaggcgaggcatgacatcacatgttgccactcacgttagatagtcatttagaagttgagcggagacacacaaactactgttggagttagagcacatgagtttttaaaggtagtcaatgtatatgtaaataaacattctagacacacatacaggtacattcaattttgtccttaatatatatcgggcccgagccataaaaatttaacgacatagcctatagtaccgagcccgagataaaaactggttattgttccatcatatctgaggtgtataagcgcaatgttttcggaaaaaagggggaaaatggaaacaatcagaatagacggcatggagaaacgtaagtattgggcccgtggcggtggttgcaaaacttggcagactagccaccgtaaaattgatggctgatgggggtgggggaataattgttattttgccctaacctaaccattatgagaaaacaaaaggatgacggagatgcaaacaaacagaatctgcagattccatcatccggggcgacctcccgatccagggatcgtgttggccagctactacccgccaaagtgtctggcaagttgcaagggtcatcagcaggcagggcagccaccgtcagcatcacgccttaatcgctgattgaaggctttcttccccgtcaccagcgagggccatgatatgccgtctccgaaaggacgcgcgctttccgacgacaatccaaagggctagctccaatttgaggtgattgatgtgtattgagactcattcaaaacgtatatgggacttcacatacaacaaaaaatagtttcctctgtcgattgtccaagtcgcacagtttttttttccttaggagtttcgtgattctatctatcactgt

SEQ ID NO: 4768 - DNA, 1131 bp, Zea mays
  misc_feature (1)..(100): optimal_loci_321028_G1, chr9:138251380..138252510, Cluster 29
tatgagagtaataaaaatgacgcaattctccactgagactaggtggaggattcaatcgcggcacccatttttttcttgaagaaaaaaagaatctgtgtagagtaataattcgtaccctgtgaatctcttgtaaaaagctagaattgaagtgcttctaaaccagcccggtccgtatacaaagcaggcccgtagtaagacctgtcctactcccttcgacgttgctttgctcctaaccacattattccatatgggcctcctgtcctcaacacactggcccatgaactcttttcagatgatagcgttgtgccggttcttcatttctgagtctgactttcgcatcaatatccaggctgtgggactgtggcatgcgacgtcttcttgctaagagcacattagcgaggggtatttatttttttgccatccttactaataagtggaaccaactgagtcactgacacctgtctttaatttgtcattctctccgtaaggatggcaaaatatcagattggaccattagcttcatagccttctgttgagccttcaaactgccttcagtttcagtagattggattccatccagccttatcagttatttcgcaaggattggatttgtatagcacaaagaaacgtcttgtatcgagaaacatcttgatggatgtaggctggaaaaggcagcagtctttttggttgtacacttctacactacacaccatggagccacccagttgtgcactcttccagtggttcattcatcttcgaaataggagaaagctaccaggttcggacatctccaccagtagaaccacgttcaggggtgcgcaagccttgtgccgtcacaatcgggtaatgttcagtatcagaaattcagaataatagcggaaaatgtgaccatggagtggaagcagttctacaggtggtactgccgcatttgatgtgatcttggccacttggtgctatttagatcagtgatggatgtgtggacggtaatgtaatcagctactattgttagcagttacatggaaactgacaacgctatttgttttgttttgctgggaaactgggagtgcccgtttcgcccttttctcttttctgttttgcttaggattaaaaaaccggttatttaaactggct

SEQ ID NO: 4769 - DNA, 1286 bp, Zea mays
  misc_feature (1)..(100): optimal_loci_321139_G1, chr9:138907975..138909260, Cluster 29
aggtacacaaaacctattataatccaacgcaagacatcacgcttaactggacgtaagatattatgctatctaatggtctaaaccaatataaattgttgtctttacagtcactgtcgaggatgccacacaccgaatcccacctattcctactcgatgtagatccataacaaaattgacaatcatcagacatccatataatgtctctgcatatcaattatgtaatgggtaaagaatatagatggctaatatttgttataagatttagtcttttataatatagatacagatagaaatacttctaaactagtataaattgttatctttatattcaccatcggggtggccacataccgaatcccacctatttctactcgatgtaaatccataacataattatcaatcatctgtgcaaatcaatcgtgtaatggtaataaagtgggtaaggaatctagatgactaatatttgttctaagatttgctcttttataatatagatatagatggaaatagagatagaataaattacgataggagactctacgcaaaaacgacacgtactatcgtgagtatgggctatgtatgtataaggctctctcaacctttcggcctgctacaagcacagttgatccattccgctgagaaatattacccactagtcattaaaatgtattctctttgttctaatttatactctctctgtaccaaaatataactatttctattggactgtagggaaaatgtgttccttgcattaaaagaacttgtttttttgcataatttccgttaaattcttgcttctatagcatagccttaatttttatataggactaacacaaaatataagtttaaaacaaagccattgactccaccatattagtgcacttagattccgtttggatcagccgaatttttgtttttagctttttgtaagatttagtatgattttttatggattagatagaactttcgcagcggctatagtagttatttattttagtttatctaaacaggatcttatggacacataggcaagatgtaagtgtaaccatatctcatcgttaaagatggcaatttttctggttggcaggtcctcgcgtggacccgacccaaatagagtggggacgaaaattccctcgcgatgatggtagggcgaggataaaatttccccggtggatatccgatggagacactaggagttaggctctttccttatgtactctacgaaggttgaatccaataattcgtctcactacatcttatataaagatgtaaaatcatcactcact

SEQ ID NO: 4770 - DNA, 1070 bp, Zea mays
  misc_feature (1)..(100): optimal_loci_321754_G1, chr9:142181371..142182440, Cluster 29
ggacaaacattgtagtgcagatgagtagattatagtcattttgctgagtaatttgggtgagttattgcaaaagaaaggatatctttctcctgtatttagttagaccagtctacatgttcctgtaacagtagcacatcatttgtagttcttgttttgctagtataatccaaccaacttttatttaagtcctctatgactaaaaaacttcttgtatctttgttatgtactatgaatttatatttatacatctcttacattgtaattttatcaatattttcttgtttattgggttgtggtgtttcaattattaatgtttctatatgttttttttactattaagattaataagggcatgtctaatgcagtggcgagagctctcaccgagtcaggtcatgggtttgaagcggtctatcgttatttgtggaggaaagcttgtcttggtgtatcctctctttagacctccctcaagtgagtcctgcggcattgagtatgcccttattattattaaggttgagtacatatctctaacaacttttaattattagactgtaagcttaaagaagtgtctattggaccctaaatgtgtggtttctcatcactcactcaccatataaccttaatgtttgatagctatttacaacttagtgacaccttctatcatcctaacatgcttgatttgtgctccctggactaagcagatcaacttttatgtcactctatgccttctttatccagtttgtcttattgttgagcaacggatgcatgtcacaaactgtatatcattccccacaaagtaagaatatgaccaacatttcacatgaacaatggaagcatccactatgttcacttgtcacttatggcattatcttgagtaaaatatatttactgtccttaaacttgtcgtcatgtgacaagttttgtgcgtgtagaagaaaactgaacaacactaatctaatatatatcccgaacgaattaatagaaacaacaccgggtgagtagtatacattttttgtgtgaatcaacaaggtgtgttatctgtgtacattatcaagtaagcaaatttaaagtgt

SEQ ID NO: 4771 - DNA, 1152 bp, Zea mays
  misc_feature (1)..(100): optimal_loci_322570_G1, chr9:146411900..146413051, Cluster 29
aacagagcacaattcattttgttactattaaagctcattgaaaagggcaattataaatgtgatacttataaaaataaagggaaactaaagcgcatagaacacatgaacttgtttaagataacaggttaaaataagtgacaattacctcgtcgacaaatcctgtaaggatcggaggttatgctccacgtatttcaacgaaaaagcagaaataaacagaacctgaagcatatgcaacttataagttcagtccgtagaatgaaattgtaatcatcgcacagcttgtagtagaacactagtgtgaatgaagaacatgttcaaaaggcagcgcgaataaacaacaggctgaagtaaatgcgaattacctcgtcgaatgaaaaacagtaagtgcgattacctcgccagtgaaagctctaaggatcagagacattattcctcgtgtctagatgaaattatgtcacaaagaagatgcagccacaaaacattaaaatcataatattaactcttctacacaacaatagtaatacaataaatttctagagcgtgtttgacatccactattttgcagaagtcagagtgaagacaactgaaagtcagacgctttccttagtttgagcagttctttccttagtttagtgctgcctaatatgtttggatggggaggagtatttcttggaaactttactggctttggtgaaatctgaagaaaagggaatcatccccgatatcatccaccaggttttggtgacgtagccagttaaaccttcacgaatgactcacccctagaatcatgtagctcgtgtatcgtagccttaggccatgttgtttccctcctagattagattatataagttggattctagttagaaagtagaaaggtaaaataccactttaagactacaaataagttatgcaataacatcttattttagcttatttgtgatttcagagtgatattttaccattaaccttcccccataattcaacttatgtaatctaggatgaaacaaacacactcttatgctatctcccaacaacttactcatccttatatttaaactttactctgagaatagtgtatgagtgaaatacaggtgaactgctggaaacagtcttatatggtggcgtgggtatgtatgtttatgcgaaatggtc

SEQ ID NO: 4772 - DNA, 1024 bp, Zea mays
  misc_feature (1)..(100): optimal_loci_325528_G1, chr10:5621757..5622780, Cluster 29
agaatggaataagtgcatatttatttcttgtcaagcttgtatatacctatccaaaattaacaatttgtcattgtttgcagtagaaatattggaagttttatttcagtgattggctctatagacctagtctcattggtcagtgtccaagcaaaagaccaaaaaacaaggacatatcgtagccctgccaatattgagcaaatgtagcgttgaagcccactacacctagttttcttggagcttggaataattcattggtgcagttatatggttgattataccttccaacggacttgaaattcaacttgtagcatatatcgactttttccaacagaccgctataaaatgtgactaggagattttaattctagacgtgaattcgatgatacaattagatagaagcaagcaatgcaatggaagttaaagtgtagatcggcttgtggctagttttgttaagctccacaaagcgaagttacgttgtacagaaatagagtttactttaccctatatatcacgatacaatgagtggtatggtagggagatgcaaagaaagtgggttgcccagtagaaataggataagggaggcagaaaaagttaaaacacaactcatgaaggatctcattattggactatctaatgagtgtttaatttattgtatttctccttataggtagtaaacaacacaatgagcatggcactatggtggcccattccatgtttggtaaaaggaagcccaagaagcaggaaaatgaagatcccatgcatttggagaaaaataaggcagggataacttgaggcacccagggcagaggctggtcgggataggggttggccggggtgactgagggaggcgagggatgcgtagtcagcaattgggagcagcgacaagcggggattggagcaacagataagcgggcacgtgggaacgatgtccacagacaatggtggaatcctatattttttgtcgatcgtgctagtggtcgacaaaaattaactaagatcggttgctaacatggttgatggaagt

SEQ ID NO: 4773 - DNA, 1164 bp, Zea mays
  misc_feature (1)..(100): optimal_loci_33369_G1, chr1:204085193..204086356, Cluster 29
acacatgtgtttggctattcatatgtttgatttagtgtacgaacatgtcacgtttgtgtgtttcttttgggatcattggattgctatattaggtcacaatacaaaagggtgtcggggcttcctagccctaattcccggattgttattttgtttatcctgtcgctgccatttctccctggttctctatttgctggtgtggaagatcttctacatgtcttgggaaaccacgtgagtttatcggagctaatcccacctctgctctgctcgtgcccccctgtatgattgtgcctagtgatccatatcattctatggccatataatagtgggtagggatcactatcttgtcttgtgtcgcttgtgtgtggatgtgtgactgcacacctcacctgatatgttgttgcgagctggcagggtcaccactggcttggtgccctagtgcggcagagggctagggcatggggattctgatcgtatccatgggagatagcagtttccgatttcaattggtacacaattacgcgaacatctttgtgttttgttcgtttgccataacctttatcttactagtagcaataatctcgctataacgaaagctgtagagctcttcaatatctttcgaattaatatctacataactttttcgttctgtaaatcttgagttatgaaatttcgaattcaacagcagtttctgtcacagttcggtttaacagaaatttcaattgagcagctgcaatgtggagctcttttgagtgttttagaatccgattcaggggaacccataactgaaaaggatgtagaggatttcatgagctttacaatgagtatctatttacagattttcattgaaatttgtggaagttatgggattctgaatttgggtgtctcatcctgtcaaaaaattagtttcagcctgtattgcagcatcacttcgagttttgcgacacaatttaaaatttcttagaggcagactcgatcctgactcttatggagtgttgtgtagtgggatttttggcctttccaaggatggcttaagccccatgtttggataagtggtctggaagactttctattacaacatagttgttagtaatagcaggatggacctatcatctttttctgaagaataagcaagatagatgtgtgaattttggttctggtttgaat

SEQ ID NO: 4774 - DNA, 1033 bp, Zea mays
  misc_feature (1)..(100): optimal_loci_33376_G1, chr1:204099143..204100175, Cluster 29
tgtagtactaaactagaaatgcacatatgaatgtgtggtctggcacagtgactagtcaatacattttgaaaggctaacaacggagaccaaaaggagttgaatgggtgtggattctaatttttccaaatctgatggctgtcccaaatcgaacccaaagctcaaaaaaaaaatccaaatctatcgacatgataacattcaagccaactactaacttgagaccctaataaaacatctttaaaaatgccccaaacatgaaaagtcaaacggatgagaaagatatcaaaacgggtgaaaacgctatccgacaggaaactatgtagcagaactagcttgaccagattactactcatccacgccaactttatcaatttactgttcacgccaaatggtctacaatcccatcagcccaaaaactcccttcctaaaggtgattttgatgcaatcaaactctaattgatcccaaattttatggagatgtttcttggaatattagaaggtaaccccaaggatcaacagaaagcaacttggatctaaaaatcccaagaaaaatagggttttctcccaatttcctccacaagttggatctacatgttcacgaggtttctgcccaaactgtttttgtggggatgctcctcaaaagttttagcacatatacatgcactaaaaccattcttagaaacacagaataacatgatccaacaaaacactagagacgatggcgatagggagaagaaaaaacaaatccaactcaaagtaagaatatagactcagatctcctataatgattgttttatttctgtgatcaaacaagtctgcttcttatagagcaaagattaaatagaatagagcattgcatatatcaacaacaaaaagagagaaacgcttaagctactgcaactagagtcttctactaaaaatgaaatctaaagacatagctagttgaggcagcctcctatcttagttatagagttattacatatttctaacatacccttatatattctggctgaaccactttacctggagaaaaata

SEQ ID NO: 4775 - DNA, 1275 bp, Zea mays
  misc_feature (1)..(100): optimal_loci_33378_G1, chr1:204101099..204102373, Cluster 29
ctgtggtttatgatgaaagagacctcgagcaattggtatagggggtacagctcctacgtacatttcgcacagctttggtctttgtactgcaccgtatgcatgaagctatatatagcgggctcacggccaatggaggaactgaactgattctcatctggaaaaaaaaaagcttgctcagatgacgatgaactggtggtggatcttcttgtggtgtaccttgtgatctagacatgcatcatgtgttgttgtgtagctatggatagaatgtctctcctctggtttccttcggtgcctagctggactgtgtctggtacttcacagtaccgccgcgtcagtattcgtgccatcatgcatgtgccattatttgctctgcacgcacgcatcatccataatctatacacatagatatatatagatgtagagtatatatatactgcaataatatatatgaattccaactagctagctaccaataagtggcaagtggggcatctgaatcagctgtgcttaatctaaattttaggtctttaaataagtggtctaaaattagctttaacttcaacctatatatatcatatttaaagttttttggagtttaaaactgcgctaaagtgctctggtttttttagagctctaaaatttaaaggaggggatgcgaaggatctgaattgccatcttaccaacttttgcaatcattattccgtacgtgcgtggttgtatgaattctgtccgtatgagatcaatcgatataatactcctacaacgtttgggtatatatttcttttgttatcttattggctgaaagctccattggctaggttattaacgagctttgtgctgctgctgagcttattatagaaatagtagtatgtttttcctccgagagccatgcatttatctgacggaaaaggcatccgcaggtcgtcagtttttcctacaagctaagtgcggcacgtgcatcccgttatcggcacacaatcatataacgaatgatggacaaaagatcgaacctatatatatatcaatgaacgatatcctgatttcgttccatagaagagagacattgtaacattgttttttatctaccacaatggttttctcgtatagattgtttctacataaacttctccatacgcttgtgttcacatttttgttcccttcgaaatttctcttcttccttttgcctttcgtggtgttctaaattctgaaaacaaccacagagagaatgaaagcataacgtctgctaatgcagttactgtgcacgtccagttaaac

SEQ ID NO: 4776 - DNA, 1068 bp, Zea mays
  misc_feature (1)..(100): optimal_loci_336861_G1, chr10:76518104..76519171, Cluster 29
aatgggtagctactaaaattgaggagaataagatgatagtagagactaacgatgatagttccacttggcttagcgtacttcctagcatgtgactacctctctagacaactcttagattttgttgtttgactccaaaggggaagaagagaatatgcgagataggggagagctagtgggaggaatttggatcttttttgtgctctctcatgcatcacattaacattatgcattgtatttatgtttatttacttgctagcttgtaccttatgatactttgtgacatttatgtgctctcttttaccatgtaccatgtcatgtatgttgctcgtttttcgtgcttccattacattctatgtcaaacgagtactttgttttgtagcatgcttatttcatgtactttgtgtaggtgatgtgggtttagctcgcatgacctcaccctaacccctgtaagacagaggtggaagttttccaatatactaaaagctaacttgtgtattttggtcaacaaaaatccaatccaacatctaggtacccgtatttttaatggaagaaaacattttcgctcacctctaaaaacacaagaattcgtgatttctgactaaaatttcgaaccatgccttttcctataggaactagagtcctctattttttacctgcaagaacccttcaatccaaacgagccctagaaatggtcataaaaggtgtaacatctcacaatagaactataatcattcatgatacatatggaaagtgatagcataacctctcatgtggatatggtaagaaatggaccagatgatacaagcatatttactggtgcaaaagatgatactcaagtgatattttcctgatgccccctgggcatactttcaaatgataatgatcaatttaggacatacatattcttcctcggaaaagcatagtgatagataataggggtctaagagggcaagcctcatggttaacatctttgcaggaaataacatctttggttggtattttaagaaagctatctagtcttcttaaccatataaaggtgattctacttcatcaattgtcgtgggacaa

SEQ ID NO: 4777 - DNA, 1161 bp, Zea mays
  misc_feature (1)..(100): optimal_loci_337393_G1, chr10:79147059..79148219, Cluster 29
  modified_base (488)..(488): a, c, g, or t
  misc_feature (488)..(587): n is a, c, g, or t
  modified_base (489)..(489): a, c, g, or t
  modified_base (490)..(490): a, c, g, or t
  modified_base (491)..(491): a, c, g, or t
  modified_base (492)..(492): a, c, g, or t
  modified_base (493)..(493): a, c, g, or t
  modified_base (494)..(494): a, c, g, or t
  modified_base (495)..(495): a, c, g, or t
  modified_base (496)..(496): a, c, g, or t
  modified_base (497)..(497): a, c, g, or t
  modified_base (498)..(498): a, c, g, or t
  modified_base (499)..(499): a, c, g, or t
  modified_base (500)..(500): a, c, g, or t
  modified_base (501)..(501): a, c, g, or t
  modified_base (502)..(502): a, c, g, or t
  modified_base (503)..(503): a, c, g, or t
  modified_base (504)..(504): a, c, g, or t
  modified_base (505)..(505): a, c, g, or t
  modified_base (506)..(506): a, c, g, or t
  modified_base (507)..(507): a, c, g, or t
  modified_base (508)..(508): a, c, g, or t
  modified_base (509)..(509): a, c, g, or t
  modified_base (510)..(510): a, c, g, or t
  modified_base (511)..(511): a, c, g, or t
  modified_base (512)..(512): a, c, g, or t
  modified_base (513)..(513): a, c, g, or t
  modified_base (514)..(514): a, c, g, or t
  modified_base (515)..(515): a, c, g, or t
  modified_base (516)..(516): a, c, g, or t
  modified_base (517)..(517): a, c, g, or t
  modified_base (518)..(518): a, c, g, or t
  modified_base (519)..(519): a, c, g, or t
  modified_base (520)..(520): a, c, g, or t
  modified_base (521)..(521): a, c, g, or t
  modified_base (522)..(522): a, c, g, or t
  modified_base (523)..(523): a, c, g, or t
  modified_base (524)..(524): a, c, g, or t
  modified_base (525)..(525): a, c, g, or t
  modified_base (526)..(526): a, c, g, or t
  modified_base (527)..(527): a, c, g, or t
  modified_base (528)..(528): a, c, g, or t
  modified_base (529)..(529): a, c, g, or t
  modified_base (530)..(530): a, c, g, or t
  modified_base (531)..(531): a, c, g, or t
  modified_base (532)..(532): a, c, g, or t
  modified_base (533)..(533): a, c, g, or t
  modified_base (534)..(534): a, c, g, or t
  modified_base (535)..(535): a, c, g, or t
  modified_base (536)..(536): a, c, g, or t
  modified_base (537)..(537): a, c, g, or t
  modified_base (538)..(538): a, c, g, or t
  modified_base (539)..(539): a, c, g, or t
  modified_base (540)..(540): a, c, g, or t
  modified_base (541)..(541): a, c, g, or t
  modified_base (542)..(542): a, c, g, or t
  modified_base (543)..(543): a, c, g, or t
  modified_base (544)..(544): a, c, g, or t
  modified_base (545)..(545): a, c, g, or t
  modified_base (546)..(546): a, c, g, or t
  modified_base (547)..(547): a, c, g, or t
  modified_base (548)..(548): a, c, g, or t
  modified_base (549)..(549): a, c, g, or t
  modified_base (550)..(550): a, c, g, or t
  modified_base (551)..(551): a, c, g, or t
  modified_base (552)..(552): a, c, g, or t
  modified_base (553)..(553): a, c, g, or t
  modified_base (554)..(554): a, c, g, or t
  modified_base (555)..(555): a, c, g, or t
  modified_base (556)..(556): a, c, g, or t
  modified_base (557)..(557): a, c, g, or t
  modified_base (558)..(558): a, c, g, or t
  modified_base (559)..(559): a, c, g, or t
  modified_base (560)..(560): a, c, g, or t
  modified_base (561)..(561): a, c, g, or t
  modified_base (562)..(562): a, c, g, or t
  modified_base (563)..(563): a, c, g, or t
  modified_base (564)..(564): a, c, g, or t
  modified_base (565)..(565): a, c, g, or t
  modified_base (566)..(566): a, c, g, or t
  modified_base (567)..(567): a, c, g, or t
  modified_base (568)..(568): a, c, g, or t
  modified_base (569)..(569): a, c, g, or t
  modified_base (570)..(570): a, c, g, or t
  modified_base (571)..(571): a, c, g, or t
  modified_base (572)..(572): a, c, g, or t
  modified_base (573)..(573): a, c, g, or t
  modified_base (574)..(574): a, c, g, or t
  modified_base (575)..(575): a, c, g, or t
  modified_base (576)..(576): a, c, g, or t
  modified_base (577)..(577): a, c, g, or t
  modified_base (578)..(578): a, c, g, or t
  modified_base (579)..(579): a, c, g, or t
  modified_base (580)..(580): a, c, g, or t
  modified_base (581)..(581): a, c, g, or t
  modified_base (582)..(582): a, c, g, or t
  modified_base (583)..(583): a, c, g, or t
  modified_base (584)..(584): a, c, g, or t
  modified_base (585)..(585): a, c, g, or t
  modified_base (586)..(586): a, c, g, or t
  modified_base (587)..(587): a, c, g, or t
cacgattttttagaaatacctctttagatatctcagtagcttctgtattaaacaccattgcacatggtcttagtggagtatactttaggagtaaaatacaaggtcaaaggaaaactgcatccctttgtcttgcagacgtgataagagtgatgacgtcagcttcgcatttttgcatgtgtgtggtgggctttaattttaacaagaaaaatggcaaaagacgctgcttttttttgtccatttgagtgattatattccttgggttccctttcctttcccctgtttctcgtttaagtgtctttcacaattttcatatagattatttttgttttccccatatatgccttttcacgctgcttaaaggtccgtttggatccgaggaactagattttagtcctttcatttgaatactaattagggggtggaggttattgtactaatgttttgcccccgcctgttctccggggggggcgagggctttttttcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggaaggacttttgaaatgaggggtagagtctttaaggggggacgaatattggatttgtgtatataaagttataggagtagttataaaaaaacaggaaaacagggagagataggaggacgagggggggtcaaccccgaaaccggccccccccttagaaagtataaagtatagtttaattatttagatttatagctatattttttataccactatataatccactactttaaataaatctagagtcatcccaacaaataacctgcggacgtagactaccctctatgcaccaagaaaattaacacattaaaaaacgaataatatcttacttaaatttcccttttatcttatccactcacatccaataaatgatattcttagaatcatctctcgtatcctcatccccacgctctcacctcacatgccactgctccaccttcaatcttcccttctttcattttttttattttctctctctttctttatttttcttatttccttcattttctttattttctttcttccctgccttcaatcatgtacaatgcgtcaatcacgtatgctggcgtcaatc

SEQ ID NO: 4778 - DNA, 1267 bp, Zea mays
  misc_feature (1)..(100): optimal_loci_341139_G1, chr10:99585828..99587094, Cluster 29
agattaaatgaaaagtgtgagttaggaagcccttatcatttcaaacctataaggctatacaatgaaacgaatcacgatcataatagacagaaagggttcatcaaacggtgggtgtttctcatcctcttggtgtatgaccaccctttctccaagagtttgtcaaggtaagcgacatgctgctatgatgtgatctttgatcatgtcagggtggcatggtgtcaccaccttactctggttgatcttatactaagtggtgttattggcaagatctgtgagttatcatgtgtagttttaatctatttcctctaaacttcatgttattagattgatcttacaccaccacatatgtattcattgaccggatgtgcgctagcagggactgaagttctcccacccattccctcgtccaaacaaacatgaagtcagcccaaattgctcactggagctctctactgccgtctgagtactcctggttcacccatcacccagattttatgctcagcgagtttactatgtccaataatggcctagcagcaaaccaaagacctgttcgaacctcatagtgtccgacgtagccatcacatgcgatccccgtcgcggaggacgaacattgttgcgttcccgccacccgcacatcgcttctttaatctgagatgcacacgtgtaatccaatggtctgagtccaccgatacaaccataaaggttagcacacggtcaaatagcactaacggcgtgaatctttcaaaaaagtccttcttttctttgaaaaataatccatagtccacaactgttcattctaaggaccagaaatttacctttttaaccccaaactctatagttagttagaaatttacccttgatagtttaaaacgaataaaaatcataaaaatttatttttaacccaaattaagtgttttttctcaaacaaattgtaaaattgtatacaataattctaggactattttaagccaagtttttatgtttgatgtattttttcttatttttgtacccatgttgttgtatgcgcatgagtagactcagaaccttgcaactttcctgaaggccccacttttgaggccccaactttcaaaaggttcaccatgagacttggggaatggctcatcatgtgatgcaacgagtggttttcagtggttattttactgtaacggttcaccatgagacatagtgaatggttaattgtgggatgcaatgatcgttgaagttactagattgtaacaaagtttttcatgaaaaatgttttagaaaa

SEQ ID NO: 4779 - DNA, 1036 bp, Zea mays
  misc_feature (1)..(100): optimal_loci_342369_G1, chr10:106938675..106939710, Cluster 29
cagggatgatactaagagaaaggattgggagaatgacggatatgaggaaaaacctaaagattccaactatgactgatcccgacaatgttagctctagaagacctctcgacgttcatggttaaattgttctggccaattgagcagagtaatatggccaataaatttcatgtccactccggtcgagtcatatgatcgtcgctctaatccatcggattggctctagatctacccgttgtctatcactacagcaggagggaactcatcagttatgacaaattatttgctcatgtgtcaaagctctatagtcagaagtggctattgaaactccatgcaaattttattgattcatgggaatagatgaagtgacaattcatcaacaactttaggatgatatgcaatcatgagaaaactcagtatgaccttgagcaggtcacccagaaagaagatgagtccctacacagttacatcaagtggtagcatgatgtaaagactggcatctctagcatgccggaggagacgaccatctatgttttttgcaaggacctcatggaccgagagttgtctcagaaactcatgcgtaaagctctaaccactcgagcttccctcttctaggttgctaacaagtacgtcatgagcgaggaagtcttcaagcatatatcaacatcccataaggacaaaggaaaaatagagtgaaaggacgatctagagaagggccaagacagaaagcgcaaatcagagtagcaagtcgcaatgattgttgaccaggggcacgacaacaaactactcgcccaaacaggaataataaattccaatagatcatggagggtggtgtatttgtcatccgaatgggaagcacatgactcagaattgtcgacacattaggggttttgtagagaatctactcaaagaacctaattaaacctcagactcagaatctagagacaagcaagaaaaatgacttggacatggatgacaaggacaagttcctagagctgatgcaagacatcatatacatcatttatatacataatttggg

SEQ ID NO: 4780 - DNA, 1207 bp, Zea mays
  misc_feature (1)..(100): optimal_loci_343303_G1, chr10:112311727..112312933, Cluster 29
tatatgcttgttgtaacatctttctatcaatttgcagtgcattgagtgttgatgtgaagatgatgtatgtggagcttcttccatcgctgtgcttcggataccttctatccatatatgttttctttgattactattttatccatgtgaagataattgtttagttaatgatcttcttctaaaaatgatattggcaaataaggccaacttgtcctctaccctggacaatctatgaggatgatgcttactctttagaaatagtttttgctttgctaattgtttttggtattctatgtcttttcctccagtgattcttaatatcctatctttactcggtattattgtattggtgttggctatggaatttctgaggatttgttttcttaattgctttaatgataattatttgccactaaggcttcttaccgagctggctaaatatcagattgttgagaggttgttggcttcgactgattttgtatgagatgattcattacaatagggtcatagttgaataagaatggcaaatttaaacgtgttgttgataggtttttttttgtaatagaatggttagtataacagatgaggcgaagatagatcttgaattacatgattggtcacttttggctgagagattgttattgtttcctcttgtactttgtcgatgcttttctttatttttaggaacattttaatgtgtcacctacccctttccatgcatgacacagaaaaaaattctaggtcttagtagttttcgtccgctagttctacctcatctctatcctttgtggttggatccatctatgataaatgttttgttgttgtaatggtttctttttatagttgcttcagcagttgtcgttgcattgttgtggttaatgtgatttgtttgatgaaaataggaagaaggtattcactcgaagtctattggcctaaaccgattgtgattatttgtactcgtactagggagctttgtttcttcttcaactctttttctatagcttttgtctaatttgcaaattttttgcatgactttgtagagttgggggggtactatttgggttgttctctagcaaaatgtgatgcatatatatataaagccccttaattcaacggagtttatcttgtgccttttgcttaatctcaggaggagagagtcttcgtcggagatgcttccttaatcttgaggcttcatctgtccttcagttta

SEQ ID NO: 4781 - DNA, 1089 bp, Zea mays
  misc_feature (1)..(100): optimal_loci_344431_G1, chr10:117772948..117774036, Cluster 29
  modified_base (389)..(389): a, c, g, or t
  misc_feature (389)..(488): n is a, c, g, or t
  modified_base (390)..(390): a, c, g, or t
  modified_base (391)..(391): a, c, g, or t
  modified_base (392)..(392): a, c, g, or t
  modified_base (393)..(393): a, c, g, or t
  modified_base (394)..(394): a, c, g, or t
  modified_base (395)..(395): a, c, g, or t
  modified_base (396)..(396): a, c, g, or t
  modified_base (397)..(397): a, c, g, or t
  modified_base (398)..(398): a, c, g, or t
  modified_base (399)..(399): a, c, g, or t
  modified_base (400)..(400): a, c, g, or t
  modified_base (401)..(401): a, c, g, or t
  modified_base (402)..(402): a, c, g, or t
  modified_base (403)..(403): a, c, g, or t
  modified_base (404)..(404): a, c, g, or t
  modified_base (405)..(405): a, c, g, or t
  modified_base (406)..(406): a, c, g, or t
  modified_base (407)..(407): a, c, g, or t
  modified_base (408)..(408): a, c, g, or t
  modified_base (409)..(409): a, c, g, or t
  modified_base (410)..(410): a, c, g, or t
  modified_base (411)..(411): a, c, g, or t
  modified_base (412)..(412): a, c, g, or t
  modified_base (413)..(413): a, c, g, or t
  modified_base (414)..(414): a, c, g, or t
  modified_base (415)..(415): a, c, g, or t
  modified_base (416)..(416): a, c, g, or t
  modified_base (417)..(417): a, c, g, or t
  modified_base (418)..(418): a, c, g, or t
  modified_base (419)..(419): a, c, g, or t
  modified_base (420)..(420): a, c, g, or t
  modified_base (421)..(421): a, c, g, or t
  modified_base (422)..(422): a, c, g, or t
  modified_base (423)..(423): a, c, g, or t
  modified_base (424)..(424): a, c, g, or t
  modified_base (425)..(425): a, c, g, or t
  modified_base (426)..(426): a, c, g, or t
  modified_base (427)..(427): a, c, g, or t
  modified_base (428)..(428): a, c, g, or t
  modified_base (429)..(429): a, c, g, or t
  modified_base (430)..(430): a, c, g, or t
  modified_base (431)..(431): a, c, g, or t
  modified_base (432)..(432): a, c, g, or t
  modified_base (433)..(433): a, c, g, or t
  modified_base (434)..(434): a, c, g, or t
  modified_base (435)..(435): a, c, g, or t
  modified_base (436)..(436): a, c, g, or t
  modified_base (437)..(437): a, c, g, or t
  modified_base (438)..(438): a, c, g, or t
  modified_base (439)..(439): a, c, g, or t
  modified_base (440)..(440): a, c, g, or t
  modified_base (441)..(441): a, c, g, or t
  modified_base (442)..(442): a, c, g, or t
  modified_base (443)..(443): a, c, g, or t
  modified_base (444)..(444): a, c, g, or t
  modified_base (445)..(445): a, c, g, or t
  modified_base (446)..(446): a, c, g, or t
  modified_base (447)..(447): a, c, g, or t
  modified_base (448)..(448): a, c, g, or t
  modified_base (449)..(449): a, c, g, or t
  modified_base (450)..(450): a, c, g, or t
  modified_base (451)..(451): a, c, g, or t
  modified_base (452)..(452): a, c, g, or t
  modified_base (453)..(453): a, c, g, or t
  modified_base (454)..(454): a, c, g, or t
  modified_base (455)..(455): a, c, g, or t
  modified_base (456)..(456): a, c, g, or t
  modified_base (457)..(457): a, c, g, or t
  modified_base (458)..(458): a, c, g, or t
  modified_base (459)..(459): a, c, g, or t
  modified_base (460)..(460): a, c, g, or t
  modified_base (461)..(461): a, c, g, or t
  modified_base (462)..(462): a, c, g, or t
  modified_base (463)..(463): a, c, g, or t
  modified_base (464)..(464): a, c, g, or t
  modified_base (465)..(465): a, c, g, or t
  modified_base (466)..(466): a, c, g, or t
  modified_base (467)..(467): a, c, g, or t
  modified_base (468)..(468): a, c, g, or t
  modified_base (469)..(469): a, c, g, or t
  modified_base (470)..(470): a, c, g, or t
  modified_base (471)..(471): a, c, g, or t
  modified_base (472)..(472): a, c, g, or t
  modified_base (473)..(473): a, c, g, or t
  modified_base (474)..(474): a, c, g, or t
  modified_base (475)..(475): a, c, g, or t
  modified_base (476)..(476): a, c, g, or t
  modified_base (477)..(477): a, c, g, or t
  modified_base (478)..(478): a, c, g, or t
  modified_base (479)..(479): a, c, g, or t
  modified_base (480)..(480): a, c, g, or t
  modified_base (481)..(481): a, c, g, or t
  modified_base (482)..(482): a, c, g, or t
  modified_base (483)..(483): a, c, g, or t
  modified_base (484)..(484): a, c, g, or t
  modified_base (485)..(485): a, c, g, or t
  modified_base (486)..(486): a, c, g, or t
  modified_base (487)..(487): a, c, g, or t
  modified_base (488)..(488): a, c, g, or t
tgtgcgttggcaaacacattggagcgcgataatattatttctgcagtgcttggtgtaagcttccttctatttattttttccttcctagatttgtttcctctgatacatttaaaagtagagagaaaaaggtttgcctccattgattcagttccaccgttacagttaatcgacccctaatcgtttcatgtgtacctcctaggaatgtgcatctctattttctacctttccttccccttctttggtaccatagacttatagacaccatgaatcggttttacagttcagttacctcactgtcactagcccaattgttcatgcaccataactttttcagttttgtcagctagcgcctacgaataaagaatcaagcatgatttctaccgggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgcttcagcagttcaaataataatcatctcaatgaaaatttttaccgacataagtattaggtgcacccttctttaaaattgtaaattcatattgtatgatatagatacaaaccacgttgttttagcaagtaacaacacatgtccctcatgcatcttgacagttacctattcattgaagcttattattatccgctttatatgatcctgtcctaggttacactaagaaagccttatcgtaaaattgtttagttacttgagataccggaaaaggacatattgctccatttcggaaagaacataggatatctctccataaagaaaaggtactactatcatttgctcaacataaatactggtactatattactactttcaattttcgtcaagttctacaactatgacacagttctgtctgtttctcctggtttactgaccaaatacaaaatcctgagtttagtgaaatcacaaactaagcatttggattttcattttcacataaatttgtatactatccgcaagagaagaggcctcttatcgtctttttcgttcgttcggtgcgtacctatataaatgatttgcatgggagaaattcatagtt

SEQ ID NO: 4782 - DNA, 1027 bp, Zea mays
  misc_feature (1)..(100): optimal_loci_346833_G1, chr10:132194845..132195871, Cluster 29
gacatgtacaatcccattaaatatgaggtctcgtaaggggtcgtaagggggttaaattaaaaaatacaatagactcgcgaagagcacgtctctacaaattatccgtacatattttctgttaactacatttataatctaaggactcagagttatatcatataatctcttagttgtctcttttacttgaaaaactgatcctatcataatcaaaaactaatcctatcataatctcggggttgcatatgccctcagtccgatcaacaaaacaaccattaaaacctttcggtgtaacttttttaaaaatacattatttttttaaaaaaaagagaggtaaatccatactccagcatattgtgtatataaccgaagactattttgcaatataaataacaatgtttacaaatttaagtttgaaataggcataagatatgagagctattgttgatagccttagggcatgtacaacctatatactatattgcggcttttattttttatgtggagaatattttagagggtccgctagactcagcctaaattcggattcccacgaggttgtgaaccaaataggaccttagagcatctccaccatattgaatacaattaattctcctccaaaactactaataaaaataattcagtaaaataattcctctttttgtcaaactacctatagcaggaaacatgaatcgtctttctctaatctttttctcacttatttttcaaatgagaaaaccacttcctcgaagaaacgacatttgtgtctcgtagtcgtaactcgtaaggacactccaaacccaccggccgggatgacgccggcttccctgcttcatacccgacttctctactgtacactccaccaccagacttctctaccatttcactctaaggacatgtttatttaattatttaagctcttgtgtagcttatcggcgtgaagaaatagaagccgaaacatacaactagctttttgatttatcttctgcattctagaaagttaagagatgagaaacaattaagtttatat

SEQ ID NO: 4783 - DNA, 1340 bp, Zea mays
  misc_feature (1)..(100): optimal_loci_347678_G1, chr10:136277537..136278876, Cluster 29
  modified_base (1096)..(1096): a, c, g, or t
  misc_feature (1096)..(1195): n is a, c, g, or t
  modified_base (1097)..(1097): a, c, g, or t
  modified_base (1098)..(1098): a, c, g, or t
  modified_base (1099)..(1099): a, c, g, or t
  modified_base (1100)..(1100): a, c, g, or t
  modified_base (1101)..(1101): a, c, g, or t
  modified_base (1102)..(1102): a, c, g, or t
  modified_base (1103)..(1103): a, c, g, or t
  modified_base (1104)..(1104): a, c, g, or t
  modified_base (1105)..(1105): a, c, g, or t
  modified_base (1106)..(1106): a, c, g, or t
  modified_base (1107)..(1107): a, c, g, or t
  modified_base (1108)..(1108): a, c, g, or t
  modified_base (1109)..(1109): a, c, g, or t
  modified_base (1110)..(1110): a, c, g, or t
  modified_base (1111)..(1111): a, c, g, or t
  modified_base (1112)..(1112): a, c, g, or t
  modified_base (1113)..(1113): a, c, g, or t
  modified_base (1114)..(1114): a, c, g, or t
  modified_base (1115)..(1115): a, c, g, or t
  modified_base (1116)..(1116): a, c, g, or t
  modified_base (1117)..(1117): a, c, g, or t
  modified_base (1118)..(1118): a, c, g, or t
  modified_base (1119)..(1119): a, c, g, or t
  modified_base (1120)..(1120): a, c, g, or t
  modified_base (1121)..(1121): a, c, g, or t
  modified_base (1122)..(1122): a, c, g, or t
  modified_base (1123)..(1123): a, c, g, or t
  modified_base (1124)..(1124): a, c, g, or t
  modified_base (1125)..(1125): a, c, g, or t
  modified_base (1126)..(1126): a, c, g, or t
  modified_base (1127)..(1127): a, c, g, or t
  modified_base (1128)..(1128): a, c, g, or t
  modified_base (1129)..(1129): a, c, g, or t
  modified_base (1130)..(1130): a, c, g, or t
  modified_base (1131)..(1131): a, c, g, or t
  modified_base (1132)..(1132): a, c, g, or t
  modified_base (1133)..(1133): a, c, g, or t
  modified_base (1134)..(1134): a, c, g, or t
  modified_base (1135)..(1135): a, c, g, or t
  modified_base (1136)..(1136): a, c, g, or t
  modified_base (1137)..(1137): a, c, g, or t
  modified_base (1138)..(1138): a, c, g, or t
  modified_base (1139)..(1139): a, c, g, or t
  modified_base (1140)..(1140): a, c, g, or t
  modified_base (1141)..(1141): a, c, g, or t
  modified_base (1142)..(1142): a, c, g, or t
  modified_base (1143)..(1143): a, c, g, or t
  modified_base (1144)..(1144): a, c, g, or t
  modified_base (1145)..(1145): a, c, g, or t
  modified_base (1146)..(1146): a, c, g, or t
  modified_base (1147)..(1147): a, c, g, or t
  modified_base (1148)..(1148): a, c, g, or t
  modified_base (1149)..(1149): a, c, g, or t
  modified_base (1150)..(1150): a, c, g, or t
  modified_base (1151)..(1151): a, c, g, or t
  modified_base (1152)..(1152): a, c, g, or t
  modified_base (1153)..(1153): a, c, g, or t
  modified_base (1154)..(1154): a, c, g, or t
  modified_base (1155)..(1155): a, c, g, or t
  modified_base (1156)..(1156): a, c, g, or t
  modified_base (1157)..(1157): a, c, g, or t
  modified_base (1158)..(1158): a, c, g, or t
  modified_base (1159)..(1159): a, c, g, or t
  modified_base (1160)..(1160): a, c, g, or t
  modified_base (1161)..(1161): a, c, g, or t
  modified_base (1162)..(1162): a, c, g, or t
  modified_base (1163)..(1163): a, c, g, or t
  modified_base (1164)..(1164): a, c, g, or t
  modified_base (1165)..(1165): a, c, g, or t
  modified_base (1166)..(1166): a, c, g, or t
  modified_base (1167)..(1167): a, c, g, or t
  modified_base (1168)..(1168): a, c, g, or t
  modified_base (1169)..(1169): a, c, g, or t
  modified_base (1170)..(1170): a, c, g, or t
  modified_base (1171)..(1171): a, c, g, or t
  modified_base (1172)..(1172): a, c, g, or t
  modified_base (1173)..(1173): a, c, g, or t
  modified_base (1174)..(1174): a, c, g, or t
  modified_base (1175)..(1175): a, c, g, or t
  modified_base (1176)..(1176): a, c, g, or t
  modified_base (1177)..(1177): a, c, g, or t
  modified_base (1178)..(1178): a, c, g, or t
  modified_base (1179)..(1179): a, c, g, or t
  modified_base (1180)..(1180): a, c, g, or t
  modified_base (1181)..(1181): a, c, g, or t
  modified_base (1182)..(1182): a, c, g, or t
  modified_base (1183)..(1183): a, c, g, or t
  modified_base (1184)..(1184): a, c, g, or t
  modified_base (1185)..(1185): a, c, g, or t
  modified_base (1186)..(1186): a, c, g, or t
  modified_base (1187)..(1187): a, c, g, or t
  modified_base (1188)..(1188): a, c, g, or t
  modified_base (1189)..(1189): a, c, g, or t
  modified_base (1190)..(1190): a, c, g, or t
  modified_base (1191)..(1191): a, c, g, or t
  modified_base (1192)..(1192): a, c, g, or t
  modified_base (1193)..(1193): a, c, g, or t
  modified_base (1194)..(1194): a, c, g, or t
  modified_base (1195)..(1195): a, c, g, or t
gaagagtcgcctccgtagtattgtgaagccgccagatgcccttcggttggctagaccgaacagaggtttggtgagggctcctcctttggtgcgccacgaagggtgataggacttctctctcggaatgtggcgaagtcttagttgttgtcgtccggtgcgacccctcaatgctggacccgcttgatcggagtctctgcaccagcgaacctacgaagacaataaatggtggggggttccgttagtttggaaccagggcgagtttggactccgctcaacatggtcttcgcgatcttctccctaacagtaaatatattggtgaactgctcgatatggtctaagagaagaagagcatgaagcaagcaagtaagttggtttgtttatttttgatgcccctttcagccagcgtcagcaacatttatatgttttacaaatggccttcggctcatattctctactaccagcggcccatggcccaatattcgaattctcgcctctatatggtattcccacaattctcctcttcttctatctgatgatcctcatgtatgacactccttgccgagctccgtgcaggcactcctattcgtcgtcaatgactcaatgccgatctctgcttcgcacgaagaagacaggagacccaccgctgtcgctcatgtgcctgctcctcacctttgtccttggccgagtccacgccaacaaaaccctagcaaggtttatgaatcctaccggcttgtgatgtaattttttattttcactatgcaatgctattgcctatgatgtcattgttattttttctttctactatgcaaacgccactgcctatgatgcctaattttagtgctgagcaaatgactgcttgtttaagcagatgattttgtttgagaaaatgctgaattttggcaagctcgatttgttcctgttctgtgtaagattgaacaattcaatttattgaatggccatagctcatatgtttaggaactacgcttgagtttgatgtctaggctgaaaggtatttttatcttcatgcttgtcacaggctcacagccacctctggactgtttacgttgttcatttggttttctttccagaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaagtgggcagccgataagagattcgtctgtattatattgattagctggaatagttctgggtctcaatccgaaaaacaaacgggacctaactatatttgagatgtaatcaactgtatgtctgggatgcatcctgcaccctga

SEQ ID NO: 4784 - DNA, 1097 bp, Zea mays
  misc_feature (1)..(100): optimal_loci_348043_G1, chr10:137926380..137927476, Cluster 29
tagcccgtgtgtcctattagggatagactaagtgatgtaactctggcctatatattgtaccctatttccctaattaatcaattattcaattatcctctagcaaaaattgttggcatgatataataacttatttcattacataacatttgttttttagttctcccaagttcattgtattgtttttggtgaatctatcttggtatcaggtgcctgaagctgcatcctctactgccaaaccatccaatccttctatcgttcaaacttacatgtcaattttctttaggttagattccttcaattgtttccataaaattaatgtttcaagtgcttaaacactatcttaatttttcagaagtacattgcaggaagcatggaatttttgttgctagacaccctctccgtgtgttatgtgtgtcattgcttgtccctgtcctcttatgcattggtctctttcgcctcaaggttgaaacccgaccagaaaaggtacttaatttattgcaaccattaattttcaacaattgctgtcttctcatagtaagacctacctttggtgaaatactcataatcagtttgagatctgtaattaaatttgtgttttggtatttgatatttattactttacccattcggtgcaagtattgcacatttcttctgacggttactactcatacatttgcatcctgtgactttggagcatgaaaaatgaaagtaacaaacatcacaagtaatttatatttttgtgtgtatgttagattgatcgcttcactctcttatttataagactagtgactagatgtgcatttttaaaaaataaaatggaaaccactaatatccctctatacaacagtgcttttttgataccattgtatccttatgttagagttgttctctaaatggctgtgatactttttgcatataccagaacttcaatagtgcttcccatgtgctcggcgaaggccgacatggcgatgcccgttgggtgccgttttcctctgtgtgcatctatcaatgaaccttcccattctctcgtcgtggatcttctgggtgaaaacctggtctttgttggatggcgttgtccgtgttgtgtctggtgcatc

SEQ ID NO: 4785 - DNA, 1161 bp, Zea mays
  misc_feature (1)..(100): optimal_loci_35744_G1, chr1:216287083..216288243, Cluster 29
gtttccacatatttttatcagctctagttttagttctatataattataggttgtccacccctctagtcatctaggtcgtttcaatggtcctagatggcatgaccttggtgccgagtgtgtctctcatcaggatggccctatggtgtggaccagtcaagataaagctttgtctatcacaataaatgtgataaaaacattgccgtgaaaagagtagactatcatcatgcctaaggacacaggtgtacttgtgaccactgtttgttgcacgtcattgtcattgttgtaacacctcaggtgttaagcaagtcatctcatagcatatgcatatagtaatcttcttttatcacaagtggcatgaaaagaaaagttgagaaaatccttggttaagccttgaacctagttaaaagcactagagaggtcacaacacaccaagttcatgttgaagaaatggttgaattggcctccaacccctagttaacttaataagcttagaagggtgaaattttagctaaactagaaaccttggcttaaaagcttaactaaaagtggacccaacataagtggtagataattttgtggggaataaaagttgtaataagcccaagctatgaaaccccatggaaatactcaaaagtgcaaaccaaagtgaaatccaaaaagggaaaaataaatttcttctaagtcctaaatcaatcctggagcaaaaacctttcatcttcattaacctacactcacaaaatcaattggtccatcttatgaaacttgtgcccaattatgtgaggaacatcatacaaagagttggggagcagttaaattgatttcacacagtttcacacgcagtttccacagcctttaagacaaaccaaagttcctaatctaataactctttaatctaacctctaattaactcgagccctgcataaggtagcaagtgtatacaacaagcaacttatcttatgtggtgatctcaggtagatatggaaagatagttggcctatagtcgtttgaacacgaatagaggcaagcccgccacaatgccacatgttccatggcgcgcgtcaccccacgctcgcgcactggccatgcgttcgcgcttgccgcgccattgttgttcctatccgtcgcgctcacgcctttataagcccacctgtgtccgactaa

SEQ ID NO: 4786 - DNA, 1273 bp, Zea mays
  misc_feature (1)..(100): optimal_loci_3640_G1, chr1:18822280..18823552, Cluster 29
tttcatcaaaacataagtctcaaagataagttcatccatagtcaatataaactcgattgtcatacaagctcgtacataacttgtactcatacaagtcataaatggccaagtctaatacacaaacgagattatataacatggcgatcattcgagctatgagtgttaccttcggaggcaaacaaattcttcacaaactgggatgctaagtcagtatcatatggagtataatacacaatgtgttaaaaacaaacaagtacaaatctcataatgacaatgagaagcgataaacatagtagcatccaaaattacaagacacaacccctcccctttgtctggttaacattcacttgccaaccattgtatgaatcactagtacaatggccaaaatctatcttcatgatctatttaaaaacaaccactatgtcattagttgtagacataaatagttatagagtcaaacatttgatcgtcgcctaaaaacatttctaggggtgttactataaagataaatgtctttaaaaatcttatttttagggtcgattgttttacaataaccattcttataaattgatttttagtgtcgattgtgttagggcaaccacccttgtaaatgggttttcatgggtggttgctataaggaaactgctcttctaaattaatttttggtggcaattgttgtatgacaatcacacttgaaactgtttttatcgacggatgtggcaatgcaatgactattaaaaacatattttaaggagttgttagcttaagaaaaccgtccctagaaatatatttacaagtgtagttctacaaattaattttaaacttttgaatcccaccatatttgaaatcatgttttcccacacaattttagagcctattacaacagattcaaagtaacttcatatatatactagtgaactagttagtaatacagttttgatttataaagcatttatatgatactttagtttaatttacattatagtactgagtagtgggttctttctaaccctcacacacataataggattggactaagcattacaataacataagaccatcctatgtgctagtactatgcatagcactaagatactatagtccgatgttgcctgtcctatgcccataagaacaatcgatgctcatgcaatgagcccagtaaaggggctaatggtagtttatcctcagtggctattaagggagtgatttgccaaccttggctagtgcttagcacctttgggacttagtatccatgcttggtttgcaacattgt

SEQ ID NO: 4787 - DNA, 1001 bp, Zea mays
  misc_feature (1)..(100): optimal_loci_38138_G1, chr1:228725929..228726929, Cluster 29
tagagaccgataaaaccgatgttgattatattcttcgtcgatagattttcaaacgcctcccgagaagatctctcaaagatgaacacgtagaggttgtccggggatcagcctagaacaccgtcaaatatcatcaagagacatgaccgacaacaggattaagtgaaaatgataaaagagatagtagatgcatttttaattcactggatgttggatatctcaagcagtttgatcatctcatatatagaggaggtggttcttatccatataggaaacaacttcaaaacatgttctctaagtttccacatcaaaaattgatttaaaaacggatcggtttgaaactccagaaaagttggcctagccgactttgaaaattagatgactagaattcatgggagacatgcactgtagttggtctagcaataggaagtcggtctggctagcttttgagggtggcctggttgactttgagaacctagcttggtcgggtttggtggctgcccacaaggatgaagctagaaaatttttaggaggggcccaactaaaccactacatcgacataatctgactaaaccacacacaataaataaatataatagtataaagtaatcttatattgaaacatcgataaaacgatgaaaattataatatacataatggaaaatatagcatgcaatttatccataccaaaaggttaaatcacgaatagacaggggcaagagatgtgtcagtgctgcagtaggccgataggccgcaacaacacaggctatagggcacatgccacatgtgtgtaacggcgtaggacagagagcgtcgtgcgggaatggcagtgcagtggagtatagagagagagagagagagagggagtggcatgcaggggaccaggagagagcgatgtgatgtgcagggaactggagaattggggataagtttgttgttagtattaagcttttgatggtaagatctaaaattagtggcccaataattttttacatctcggtctt

SEQ ID NO: 4788 - DNA, 1234 bp, Zea mays
  misc_feature (1)..(100): optimal_loci_38330_G1, chr1:229696005..229697238, Cluster 29
ctgatggttactttcttttatgtaccacaacttatagtggttcttagtgccttcttcctctatcttgtacacaactctagtgttaatgctctagccatttgtcgaagcaccggaccatatggcaatctaatgttcatcgagtcttggtccatgtgtgctactttagtcactacaacaatcatttgttttatctggtggtgctattctatttgttaactgattatttttgtatgatttgcttatattcttcacacgtcctactccaaacttcatttcttcgataccttgggctactcctgcatatcgtacaggtccttaacgaatgcttgatcttccttgagttgcattacctaagtacatcactttgcatccataagcgatagcactagtatctaatatactagcaaatactattagtcctattagcgatgttatgacataatcactaaagacacaattatcttatttagaggataattcattcttcatagatagttattccttgttataatagggggtttcccctttccaatcatgcctccatattttccattgcaggcaactttttggatgtcaaaattgtcaagataaaatcaaagaggaaggcaactaactttttaggcggtataatcagatttaacgactactattttgcctatagtatatgaaacaatttaggatggaaaaatacatctttttaattgaaaaatataagttttttgtcctctttatccatctccctctatcaaaatgaccagaaaagacatttgaaatggttcttatccatgtgtttaatcttatccgtctctgccctgcttccatgtgggcaaagacctatatagagaatactagttaggttcccatacattgctatggtttgcatttatacttcagtatatagtataaaatgcgaagacgtgtgttctgttggctagatagatgtgaacgtgggttaatttgaaactggtagtagagaaagagggtcttgatcttgataatttatccataatttctagtttattagtttctttctaataacacaaagtacgtgcacatgtatacttcacttctcccctaaaatataaaccaccaaaaaaatgttgcccctatatcagtaataagctctgctacaacttacaagtaatctgttatttttatacatttttgttataaaacaagcaaacatagtcaatttatgtatttcacctacacatttcatcctttcatacatgca

SEQ ID NO: 4789 - DNA, 1269 bp, Zea mays
  misc_feature (1)..(100): optimal_loci_42957_G1, chr1:253200259..253201527, Cluster 29
tagaaaaataaaatctctaagaaaataggttcccaaactaggtcttacatgttactttttaccgggaattgctcggtcgtctctactaggaatgcgactccgttttcacatcatcattttaaagattgcacatatgtctttctttttttaaaaaaaagaacagtcagtttgtccttgttctcttaacttagctcacaaaaagatgtttacacccttatacagttgcccctcagtttgtccttgttctcttaacttagctcacaaaaagatgtttacacccttatacagttgcccctcagtttgtccttgttctcttaacttagctcacaaaaagatgtttacacccttatacagttgccccttcttttatccatagtttgcagatttgttcctactttgttacaaaattttggaatataattatgacataaatctctcaatagattttgaaaatcaataatccaattttaaattttaaaatgtttcaaaactaatgaaaataaagtaaacttgatattaaattttggcaaaatgacaatattttaattatgattttgaatatattttaattataatttaacactactttaagaacatgttatatacaaattcagactactgtctgaatgaccacgcatatcacaccatcaagaaagacaaaaaaacattgtcatttgtatatatgaaatgttctcaaaatagtgttagatcataattaaaatattttcaaaattacaattaaaatatcattgtcaaattttaatattgttgatttttaaaatttatgctacaattatatattgcgaacttttataccaaagtgaggagaaatttacaaataattaataaatagagatacaatgatgcggagtatgttttttttttgcagactaagttaacattgtttagtacctgtttctttaaaaaacggggggcatatgtggtgtgcaaactttaaaaacagaggtaaacatagagttacacatcccgagtaaaggcaaccatgcaatttccttttgtgtatttatccgttggcttcatacagacaatccccgagaggttgaatccacatgatttgattgcgggactatcctcgaggtatgaatccatatgatttgattgtggggctatactaagaggttgaatccacatgatttggttgtggtggtttcgcagcggttgacataagtggccaatagttatttatctagccatatggatggcattcgagtctttaaattgatagtcacttgagtgtgtatagtttaa

SEQ ID NO: 4790 - DNA, 1068 bp, Zea mays
  misc_feature (1)..(100): optimal_loci_43176_G1, chr1:254263332..254264399, Cluster 29
atcttgaaatattttagaaaattgataaaaaaagtatttcttttagttaattatttcagccacaacccaaaatagagatttaagggtgtgactagcagaggggttttctgcatatagatgtgattatcaagctgtagagcgcttatggagaagaaagaggcaaaggtagagaaaaaaaggtggtgtgtcagatcttgaccaaccgttaaagaaaattcaagagtgtcccacccctttaaaacacctgacttgtatatggacagatcatttattttggttgaataggagaaacgagaagtcatactatactatatatgacaagtaaatcaattcagatgatgtgcttgccacgctagaaaacaaatcaatgaagtactatgcaccaagaactgaggtagttagttaatcctcacaagggaataattgttaatgcgcgataatggatgcatcaacccgttctgtccctcccctgctacatgtgatcgatcgatagatccatccatctagtacgtgcgcgtacgcccggccggggacctgtacaggaaggcaacgatgggcaaataaaggtggcgaacattcaagttagtttgtcagtacacatgcatgcatcaggtcgtcacgtacgtaggccgggggtcgatgtcagtaccctcatgcgtccaaattactctatctggctcgtctttatgctgtacgtgcatgcataattcgcttgtcgataatttaatgcagttatatatgtgtgccctcgaggaccagacagtaaatgcatcccaaaaatgatcaaacaataagttcattagtaaagtttgcaaagagaaatatgaattaggtgtagtaggggcatgcccctgggatctgatttcctagtcaagaaagatgagtagtcaatgcaccaattcgtcatagctaccatggccatggttcaaagccatccgatctgtacaatgtttggatgcaagacctcagcataatgcaatttttcacatggctcaacattacgctagaagacggttttttcttggtggtgccgattcttttaactagtggaggggctactgatgacgc

SEQ ID NO: 4791 - DNA, 1084 bp, Zea mays
  misc_feature (1)..(100): optimal_loci_43836_G1, chr1:257670456..257671539, Cluster 29
ctcactgtcgtgttgggcttgggtagtttctcatagcctattgtcaggtgagaagtgggggagaagaacatatatatccttttcgcacgtgacacattacacacgaaattggtatttttaaaggagtagcgatttaaaacttgttagggatttacaaatttgtgaatgaacagacccgataaacaccctgtagtggttggcacttgaaattttaacaataacaccctgtagtggttggcacttgaaattttaacaataacactttggtacaattaatgatcaataatgcagggtgatagaccgtctaaagattcaatgatgccagaaggaaaaactaataggttttcaaatatatgccattatgaaaatcgaggattgtaaagatgtcattataattcatgatatctggtggctagctaccattatgaaatcagaaaatttggtctataccattatcaacgctcgcgcatgtaatgtacattaatattgcccctttttacccttcttcctcgctgttgttctccctctctattcttcctccctatttccgaaccctctctgtcttaaaacaccgttgtgctgaaggtcaggccagtacactggttggtagcgaggaaggcggtcgaggcagcgtcgtggctgagtcaataagggcattttcgtcttctcagatgagttttgtacgtgtgagcgtaaataatggcacagaccaaaatttctgatttcataatagtagacactggatatcatgaattataatggcatcattagaatcattgattttgataatggcatatatatgaaaacccaaactaaaaatatgtcggtcatagctgaggttgttatttttcgagaagctaggtgatttttgctgtctggttttttgattaataattgtccttcttgatgattttccttgtttcgtcgttgtttttgagttgtctcttcatagagtttttagttgtgaagatttttttggtttattctatataacaggggcgaggccaggatataagattaggggatcaaattagatgagagactattggaaggactttttgtactccctttgttttttatttga

SEQ ID NO: 4792 - DNA, 1354 bp, Zea mays
  misc_feature (1)..(100): optimal_loci_4427_G1, chr1:23055512..23056865, Cluster 29
tatggatagctcgcctgtccagatagcatagcatagcattacttgatcgagaccctgaagatattttttcctctctctctctctctctccaaagaatcggaaagatagcatgcatatatgcagctggcattccgaaggactatatttcggaaaattaaaagcctgacagtgctagctattatatatatcggtggaatgaaatatctccgagatttattttctgtttgttttcctttcctttttaatcgtttttgtaagctgtagcgcgcgggcgtgcggcatcgtgactgagtgccctcagcaaatcccttgccaatgcaatttctcgctctccctgcctgctggttttgtcgagtgtgtggtatatatgccgaaagcacgcacgcactgcccgatcaacatatatcagttagttaaccgatcatcaggcgatcagatccaagctagaaaagatatacgtactatgggcgtgcgtgaaagatgacgacgtcgactcgatcatatacatgcatgtgcgggtggtcgactcgagtccattgaaaaatcacaagaaaagaagaatgtgcgatacacactcgtattgatctacgtgcacgcggatcattggcctacaatcgcggtaagcataattattagttgcatgcatgctgcatgacatgacggctagctacaagcacaagcacagcccggcaaaaaaagcagcacctgaccatgatgatgaggattcatgtagtcacttcacacgttgcaacttgcaagcaaaacttggctgcgaatatcttgcgaccacgacaccatgcatgccggcctcgctggctgattattgacaacttaggtacggtatggaagctggggagaataatccaatttttttttggctctaacgcttaaaactcagggaagcttgggagaataataatccattctggctgtttacacgaaagtcgcgacttccatctaaatgcgtcctagagctagaggagagcgagcagagcagcggtattggatcttcatctgaatccttcatacttcatatatagggtagaagcgtcttgttgctgacaaatatattttctatcgtactaagaaacagcgtcgttatattctataataaataggttttagaataatataaacaatcacatcaagttgatgactttaacttcaatggacacattctaccacgataactttaaccatacgagcaaaacccagttatttgacttctcttctgatttcgtgtaccatgacctatttgggactgcttctccccgccttattatggcgaaaacaaaagaccacgaaactaaacctgtggttgggagggtatgaacatacccggctatatatacaa

SEQ ID NO: 4793 - DNA, 1088 bp, Zea mays
  misc_feature (1)..(100): optimal_loci_44624_G1, chr1:262131118..262132205, Cluster 29
accgacatagtgtttatttaagcgaggtacgttgtgagtgtggtgttgtttgggtttcatactcttaatataatgatacacaacttttttgcatgtttatggaaaaaacgaggcagacaagtttgccattctaccttggaatttactggtctaaagtattataattgcttatcaaacactacatcacaatgatttccttaattaatccaatgtgttggtctagaaaagatgtggctcaatgtattaagatggcttatttgctctcattttttttcctttgaacaatttgcatgcttaagcatctggagaagtatggaattcctgtgcccagttatgctcttgtcaatagagaatatccggaccaagagctagactacttcatcgagcaagaagattttgttgaggtccatgggaagcggtttttgaagccttttgtggagaaacctgtcaatggtaattcatctatacataatcattgtaatgtctgctatttgctttattggatctgaatgctgttcctcttggtaccgtaatggttggtttgactgcatgcaagatgcaactaatggttttttgtgtggccgaggtatgagagaggcaaaagggatatctgttattgcactacagataattaatttctgttattatgatcaaataaatgtattctgattcccctttttctgtgtttttaacaggggatgatcaccgaataatgatatattatcctagttctgctggtggtggaatgaaggaattattcagaaaggtgaacttctgactcaaaattgtagtcatttgggagcagtttgctgagaaccagctgtagtgttctgcatttggcttactttaatggcatatttgccattttgatttctaatgtaccaattgctttgctactttagactacacacaaaagtctaaaggttcttcataataatgatactcccttggagttttatttttgtcatttaaacaaatatctctaatttttctttattattagtacataggaacttgtaaaaattgagacatcttgcttgcttcatttattttggaaatgacctatttgaagactaacacccactata

SEQ ID NO: 4794 - DNA, 1194 bp, Zea mays
  misc_feature (1)..(100): optimal_loci_45301_G1, chr1:265751503..265752696, Cluster 29
attttaattaacatatatacattaagctttgtgttgctgtcatctacccatggaagtgtaacttcttcatttggttcacttcacaaaaccgctgcagcttctatcttgagtcggaataagttagttctcagcacgtttggtataagccgaaagttgttaatgccttggcattggccatgaccattattataaatactcaatcaactcagttttgcaaagccagctgactgctcagatcaggttgaagttccaagctgccgtccaagggtaagtaatccgacatactcctgttatagctgctcaaaaggcatacagctgtccaagggtatccggaaaaaaatagcagtaccatacatatctgacctgagcaatgtagtaccagaggttttttcagaacaaaaatagcagtacgatacatatctgacctgatgaatgtagcaccatagctgagctctggagtacatggaactgcatatgaatgctgctgggcctgttcctcgtattgcagtatatagctgacatagtttataatttatgtatcccactggcagtatgccacacctacctctttcctctctgttcttctgtccgcccacagcaaggcttctgttaaaacaaaggttatgttcttttggaacacgaaaatctcagacaatattctgttcgttctggtatgcagaactatttatcattggattaagaagaatattatataatatattcacaccacttgttagaaaattctatatctttgcaaatgcatatacatatttttttggtttttataaaaatcactttttaccagatgaagctgttagttaattgattattgctaatggttcatgttacagttggtaatctagtattaaattaatagaagcaaaccatgtacaaaagagtaaagcatccataagaaaatgttatcgatgtgatatatgagggtggatgtatcaactatgtcaacatttagcaccattgtttatccaatagatctaaaaagatgctaggtaggttttgtcaagcttcaaccatatataaaggttaaatgactattctaagggcaaaaaacttggcataatactactttcttaaccctgtagccaatcactcggctcgtttcaatggataataatggttaatgaagccttcccctttggctatctccatctacttactcatctccatatctatatt

SEQ ID NO: 4795 - DNA, 1067 bp, Zea mays
  misc_feature (1)..(100): optimal_loci_48250_G1, chr1:281773421..281774487, Cluster 29
taggtctcaaaaatatcatctcctgtcctgcctataatcatttttttgaggtctactttcagggaacataagtcaaagaatttgcttgattttcaagtattatgcccagaataagcaagcaattgccatttggccccgagagtcgttatcgatgacacatggagtgatgacgcagggttgcgcttttgtgtcagcatggttcttttgggtcttctctgggaattttgatcctctctctctctgtctctcttgcattttaggcatgtcgttcgtgatatatataatcaaagaggtaggtttttctgtaggcaaagaatttgatgagtggaattaatttgaaaatcgcaggctcatcgtttcttttctcccttccccatcatgctagctgcttgtgcacgccccatgatttcagaataattaaggtacgcgccatgcatgttgcaggtttgtttttgtcgtgttgaaactcaaggatgccatgaaaactcgtgtctgctgaaaaaaaaaggtgttcagatttgcaatcaaagtaattcaggcacgagaatatgacattttttttaccaaaagagagtagaggccagaagcaatgccaataaaaaaaaaaggagacaagtacgcatatatacgtattatttatttgccatcactcgcattctcaagaaccgtttagttcgtcttaagaaaacataaataaaaactgtactggtttggtttgcaggtgaaactggctttgtctgtataacagggaaacggccacggtggtacagcacttgacatgacaggaggcaaagaaaagtggcccatatgttttagcgggctgaggtgaactgggcctttccaggtttactggtctactcgaccggcctttccaggttagatgagcattgcaaggcccaattgccactgcattccaggtcttctttgttgtttgtcgacaaggttcaagcgagtttttcgtgtttctgcttacctctgccctttgcttgtgagcagcagagacagagtccgggcgtgcatcgatgcaaacggccgttccacgtcaggtaccagctggttggtgttac

SEQ ID NO: 4796 - DNA, 1146 bp, Zea mays
  misc_feature (1)..(100): optimal_loci_48569_G1, chr1:282736519..282737664, Cluster 29
gatatacgttgtagtgggcgggcggcgatgcgattgaggaaatgacctggagctggaggtttaggttgtctgcactggggactggatgtgctgcgctacccgagatagtgttaccctaagccaaaaatttgttgtagtcgcatgccctatcactaacgctattttgttgtaggagcgctggaacgatagatgtagtgtttgtacaacagtaacactatccattgcttggcaacggccacgttctcgtgcgctcgaatggaaggagagaggggtagcagctgaagatggttgaataagatatatggcaattagtattaagttctagatatagagtatagtgggtgtagaaaattgtgtcgtataaaatagaatcttgttgaacaatatgaaatattctttttagagtatagatatagagtaagatgagtgtgtgaattatttttagagtatagatataaagtaagatgaactttaggggatgtgctctaggcattttactagtagaagaagacgccaagaaaatattcgtgacagagattctactttgatctaggacgtatcttgaaaatgttgtatttatgaataaaagaaaaggcatttgtttaattaagctatgatgataggatgaactaagtatattccgttgctattttaattgagggcctatttgatttagggtggctaaactttagttactacttacccctttggcacgactctttcggtagctttagcttgctatcaaacggccacaaaaaacagcttcccatcgagagccttccaagagccagaactgttttcttactagaagccagagtacaaaaaaatatgcttctaccggctcctcttacccaacctttgataaaattaccgcccctgtcaccatccactcgaataaaactctagagaagccattttgccaaacaaaatacaaaatggctctagctcctttaaagaagccaaggagctaaagccagagtcgtttctaaaggagtcagagctctcgtaaagggggtctaaattttggtcagggtgactagaagtcccccaactaaagcttagtgctctagttgttgagcggtaacaaaaaatgactaaattagtatttttactgtatctatcctttaccttcttccatacgtccta

SEQ ID NO: 4797 - DNA, 1030 bp, Zea mays
  misc_feature (1)..(100): optimal_loci_51796_G1, chr1:301147604..301148633, Cluster 29
cttttacacgaacaaagcgctactaatcggccggaaaacatggcccttatagtcagtcatcttcgatggccgatgacctgaggacatgcgtcacggggtgattagcctcttatgcattgtttattcaattaaatatgctagcacatctgttcagacttcagacacatgttttatcggcaaagtgtgccttttcagttagtagctggaaattaattttcacaaacaaatagagtatagctctatttccatctataattttgctttaatgttattcaataaaattgaagaacaacattggcacattgatcttggaaagttgtaagtatgttggcactcatacatatcgcttagatatattatagctatctagatctaaccatgagccacctcaccaaactaacccgacccgactcgtagagaaaacccccgcccaaccaatacaatgggcagtgcgaacattagtttttgaccccaacaatctacaggtcgaaccggatataatttttgatccaaaacccaatcggtcccaaaaaaattctaacccaaagtcaaaaatcccgacccaactcgaaaaaatcccaacccaactctgacatagaagcacggacgaacccaacccaacccaacactaacacaggtcgggtacggaccgtaccgacaatccacgactcgaccttgatccgactcatacctgacgtttgattagatctatagctacctcactgtacatcctggaacctgtaacatatataaatcttttgttattagaaaccattaaatatctaaaggttttttcaagcaaagtataacaggttaccttctgtaaccaaaatattgaaattttgattagctacaggtcgatgcgcagaatcttttttggttcttcaaaacggacctgactattttttcactggaaaatggttttgttcatgatattgcatgctttgcatcactgtttgcagaaagtcaaatgcaccaaatgtgagggtacgtacagacacaactgagggtacatacaaggacatgtcga

SEQ ID NO: 4798 - DNA, 1278 bp, Zea mays
  misc_feature (1)..(100): optimal_loci_53537_G1, chr2:9428951..9430228, Cluster 29
gtataaacagaaacaagcatcaagggagaattcaagatgggaaaaaaataatatcacaacagaaacatggtgggctactgcatagcattggtccatctaagcccaattgtgtacttgggccagcccggggctccttaaccacatccacatgtgttcagacccatagctaccgctctgacgctctccgatcggctagaacgccaccccagcttgcgcaaccaaggcccaacaaaagcatacgtatttggcagtgcaccttctcaagtctcatcaaattttactataaaatgttgggttaggttattgatggtaatcttgtcagtctctattagaactgtgagcgtgagatggacacgtggacaaagcataagcgacatggatcttggtttgtagatttgactactgctctgtgagtgtggttagatctgctagtctgcggtgacgggttgttgtaagtgagccgagattttctttttggcctggacagtaggtaaaatggctttggatgcataggttagaatatcatagattttgcggacattacagtcctactctttctagtttctgattctgccgtgccttgtagctatggcaatcagtagtttcagatttttggtcggtgtcaaaatgcatgccgcctagcgctgcacctgcaccagcaccacctctattcctcctgcttcccagcgaaacgcagagatgccgtgcatgatccacatccatccacaaaacttgcggcatccggaaaactcggcccgtggtgcggccggccggtgcggtgagaataacaaatgtccacaaggcttttagcccagccaacccattggaaagcaagagcagcaagggctaattaaaggaagacaaacccaaacagaaaaaaagactcatataactaattaaatattttatttgaattatacctattggagatagttactctgggaaatgacacgaatcctaagtaaatttgagttccccaacccactccaatttcataggagatttgagtttccaaacttatctattttttcctttgtacctcctctaattcagaatgagatttgaattttcaaactaacctaagggtggatgacgattcatatcgtgtgtagtactagtacaaagtgaggagtaggttctcctatttaaaaaacgtatcacgtgcaatcgatacagcaaagacacaaagatagaggtagaatcaccttttaaaaaaaacagagagaggtggtagggttattttaaaaaacaatatttctaaaataggccttatatccc

SEQ ID NO: 4799 - DNA, 1042 bp, Zea mays
  misc_feature (1)..(100): optimal_loci_54009_G1, chr2:11767362..11768403, Cluster 29
gtacggacattactcgtgtatctcaatatgcttttggaagaacataaatggcccacatgagatattttgatattagcttagcccaacccagtaaagttgcgatgcgcaatgtagcccatttatctctgtatggataggcctaacaagccttcggagttgatttcaagctccttgcctttctccataaccataacgatattacaaaacgtggagttaacattcctgttcccgttgccgacctaaacattctttcttgtccccctatattgaaacatggtacattatatagtcatattgtacgctttcctctgtatagaatcaagtcttgttgaatgcctaaatcaaaatacagtccttatactatatccaacgaaaattcaagacatgtaactcagattaaatctagctttgtgctaatcaaacattacgagtcacgggagtttctagcaccctatttttattgtatcatagtatcctgaaaacaatacaccacaaagtggttgtaattcatgttttgattagcaaccactttgtaccacaaagtgtaaagcaattcttggtgtaatttatgggaggtgacgttcatgctcttgggtctcttaatcgatcacccataaacaatgacgtgaagtctttccattctgcagataaagtttttggccaagaaccctttaattctgcgtccagtagtcttaaccaaggtggtggcacccttgtgaggtacccagagttgctctacagtatttatgcaaaatgtttaaaattaaagctaatacgaaaaatgatggaatgttacagtcgctcagtccagagtcaaacaaccacgtcttgattgctcttcaagattggtttagatcaaacgagctttgtcaaagaccgtcgattggagaagatattactcacatgtcgggcaagaaggaggtatctgttgaagacactctgagagcaagggtcagcgcctagcggcaaagcgcaatctagaaatcagtgagtgctctctgtttcttttaagcctaaagctattgcaaccaatcttgaagcc

SEQ ID NO: 4800 - DNA, 1036 bp, Zea mays
  misc_feature (1)..(100): optimal_loci_54249_G1, chr2:13293855..13294890, Cluster 29
tccttccgctatgattcctttcgtttttctctcagagtctcagtgcagcatcgtcactcgcaagtcggtcatattgtaccgcaggaaatgtggcacacgtggacacgtggttcaggtccaacgtctttttattagtctactctttacgcaattacgcgtattcccttggtcttctgtcttgccttcagtcgatccatttgcattattgttgatgcgttgtgttttctttaattatcgtctgcgctgtgttttgtttgcatgattgattagtgtacatctctttcgtcgagcccaactgcagtctgtagttgttgggtcattgagtaactgcttcgatttcaagcatttatatattattcaccagcttcttatgcgtggttgtgcagtcatagaatcttattctcggtctcctcacgaaaaccattggtttaactctactctatatatactactccgtattatgctactagcttgtagcggaatttagatgcaaattgagctagttgctttaaattatctttcatagtggaattgaagagttaattctgtaatttatatgtaggattaggggggtttgttttacccttttattgggtaaaatatacttttttagcatgtaactcataacatagtccgattttcaacctttctaactataagaccagataactcacaccttctagccacagaaaccgaaaaaatttagtcttctgactggttttaaaagtaggtttttttattttcagaaaaacaacataataaaaactggtttgttcttaaaaaaactcatactaattagtttatgttaaatcactaaaaactatgaaactagttctatttttgtttaaaaaaatatcatctatatgttggtgctatatttagaattgtttggatattacttgtttttatataaatagcgagtgcgaccaccaacaataaagcaattaatgggaaccaactccaaataccatatgttacaatacaagtaaagaacagttttaggggggaaaattgtactagtttcacatcgtcacgt

SEQ ID NO: 4801 - DNA, 1139 bp, Zea mays
  misc_feature (1)..(100): optimal_loci_55499_G1, chr2:20015329..20016467, Cluster 29
tctacgtttaatttttggaaaaggtgagaaccatagtaaaaaaatgaacgaaaagaggagacacgtagctagctcaaagacgcgcggagagcggtgtgtttgagcatgccgtgtttcataaaaaaacattaaaacaacacgatacaaaaaatgatttacttatttagttgataatgtacatttacatcttgcaagagttgtgaaagtgtcaagtaattcgaaagaagtatgtgttcaatcaaaatctcagagatatccgcatacaactataaaaaagatggcatttatagatgggcctacgggctcgtctgagagcccaaagacccgacccacacaatgctaggaaagtctcacgggcaaggaagtaagagaaagatgaagttgacaaataggaagataaagttgacaaggaccctattcgattaggatataagattaatatttatgtaaatatgatataattacagcgaatgacttcatgataagttcggtttccacccccatcttgtttccgacacaaattcctattctatgaacaccgtcccttgttgtactataaaaggagggtcatcataccttaagaggacaaatcatcttattatattgcataagcaatagacaccacgataaacaggacttgagtgttatctcacattgaaagaccgacctgtataaatgttatagtctccaatgcatttatcttaagttctcgagcacatgacctaccccataaatccatcgaataatcctcgatagttagtacattaggtaatagaagttgtgatgatcatcaaagttctgttggcaaccatcggtttcacatcgggagatttaactatctttggagccctgagatttcccgctggctcgcttcaaaatcgggaagacatgtacctgctatatccgaggtagttcaagacaacccaaaagctcactgtaagataaaaggcaccaccaataaaacatgacccagaccaaagacgactctgacatggtcagggtcgaccaacgttgcctcttgtgatctataggcctggtcatcccgatcaaagctacctcaggcccggtccaaatatataactatactctcaagttataaatggtgcttaaccaaaacccttaaccaacagacttacttt

SEQ ID NO: 4802 - DNA, 1266 bp, Zea mays
  misc_feature (1)..(100): optimal_loci_55532_G1, chr2:20114719..20115984, Cluster 29
  modified_base (810)..(810): a, c, g, or t
  misc_feature (810)..(909): n is a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
  modified_base (828)..(828): a, c, g, or t
  modified_base (829)..(829): a, c, g, or t
  modified_base (830)..(830): a, c, g, or t
  modified_base (831)..(831): a, c, g, or t
  modified_base (832)..(832): a, c, g, or t
  modified_base (833)..(833): a, c, g, or t
  modified_base (834)..(834): a, c, g, or t
  modified_base (835)..(835): a, c, g, or t
  modified_base (836)..(836): a, c, g, or t
  modified_base (837)..(837): a, c, g, or t
  modified_base (838)..(838): a, c, g, or t
  modified_base (839)..(839): a, c, g, or t
  modified_base (840)..(840): a, c, g, or t
  modified_base (841)..(841): a, c, g, or t
  modified_base (842)..(842): a, c, g, or t
  modified_base (843)..(843): a, c, g, or t
  modified_base (844)..(844): a, c, g, or t
  modified_base (845)..(845): a, c, g, or t
  modified_base (846)..(846): a, c, g, or t
  modified_base (847)..(847): a, c, g, or t
  modified_base (848)..(848): a, c, g, or t
  modified_base (849)..(849): a, c, g, or t
  modified_base (850)..(850): a, c, g, or t
  modified_base (851)..(851): a, c, g, or t
  modified_base (852)..(852): a, c, g, or t
  modified_base (853)..(853): a, c, g, or t
  modified_base (854)..(854): a, c, g, or t
  modified_base (855)..(855): a, c, g, or t
  modified_base (856)..(856): a, c, g, or t
  modified_base (857)..(857): a, c, g, or t
  modified_base (858)..(858): a, c, g, or t
  modified_base (859)..(859): a, c, g, or t
  modified_base (860)..(860): a, c, g, or t
  modified_base (861)..(861): a, c, g, or t
  modified_base (862)..(862): a, c, g, or t
  modified_base (863)..(863): a, c, g, or t
  modified_base (864)..(864): a, c, g, or t
  modified_base (865)..(865): a, c, g, or t
  modified_base (866)..(866): a, c, g, or t
  modified_base (867)..(867): a, c, g, or t
  modified_base (868)..(868): a, c, g, or t
  modified_base (869)..(869): a, c, g, or t
  modified_base (870)..(870): a, c, g, or t
  modified_base (871)..(871): a, c, g, or t
  modified_base (872)..(872): a, c, g, or t
  modified_base (873)..(873): a, c, g, or t
  modified_base (874)..(874): a, c, g, or t
  modified_base (875)..(875): a, c, g, or t
  modified_base (876)..(876): a, c, g, or t
  modified_base (877)..(877): a, c, g, or t
  modified_base (878)..(878): a, c, g, or t
  modified_base (879)..(879): a, c, g, or t
  modified_base (880)..(880): a, c, g, or t
  modified_base (881)..(881): a, c, g, or t
  modified_base (882)..(882): a, c, g, or t
  modified_base (883)..(883): a, c, g, or t
  modified_base (884)..(884): a, c, g, or t
  modified_base (885)..(885): a, c, g, or t
  modified_base (886)..(886): a, c, g, or t
  modified_base (887)..(887): a, c, g, or t
  modified_base (888)..(888): a, c, g, or t
  modified_base (889)..(889): a, c, g, or t
  modified_base (890)..(890): a, c, g, or t
  modified_base (891)..(891): a, c, g, or t
  modified_base (892)..(892): a, c, g, or t
  modified_base (893)..(893): a, c, g, or t
  modified_base (894)..(894): a, c, g, or t
  modified_base (895)..(895): a, c, g, or t
  modified_base (896)..(896): a, c, g, or t
  modified_base (897)..(897): a, c, g, or t
  modified_base (898)..(898): a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
atgtcaggttgtttagaagctctgattcactataaagttttatcccgagcaagagtacgaacctaattttagcaacatatgttttctgggcctcagaaagttcacttaaaattgttcataaaatcaacacgtcatgtttaacccattttaaaatttatgtgttaaagtgtttcgctaataaacacaaaagtggctactgatataggtcaagaattcttttaactcaccaaggcaaagagaggatggagatctagatagtctagttgatagggactttccaagagcaggagttttatatcttcacccttcctctgccttggtgagttaaaagaaatcttgacctaatatcagaagttacttttgtgtttgtaggcgaaacacttcagtacataaattttaaaatgggacataaattttaaaatgggactgaacaagatattgctgaaattggattcaaatccttaatcagaatgaaacttcacagtgaaccagagcttttaaacaacctgacataatggctagttagtctagttgatttaaggttaataactttgaaccttaagaaagtgtttatcaatagtaataatatggttccaaaggttgttgagcttccctttagaggtacaaaagttgagcctataaaaatcaatccttgtgattatgaaccgaagcgtcagtcaactaaagaaaggaaaggattggctacactcactcttcaagttatgatgaaaggtctgtataataaagtatgttttttgtatttattttatgattctttatttatgctaatacttaatttcaataaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaaaaaagaccctgaaggtgatgatttaaaaaaaaaaagtgtcaaagattacagagaaaggtttgttggacattacatgttgtagaaagattagttatgatatatatgattatatgttataaaacagatcacacaaattttccattgttatgataactaataatacaagtctaaagttaagatatgttgtatttgttaagtcaggttaaattgaacataacaaaggtcaaactacaacatgttgcgcgagatattatataacatattacagagatgtcaccaaaggagccccaatcatttaacatacctgatgtgttaccgcttaccaggtttactaggttagtatttgattag

SEQ ID NO: 4803 - DNA, 1333 bp, Zea mays
  misc_feature (1)..(100): optimal_loci_5836_G1, chr1:29692148..29693480, Cluster 29
tatctcgaccatttacccatacacctacctacatcccaaagagcataaattttattttcaataagtagccataaagtacggatctacttcgcacgcaatatcacaagaatctgaagaggtgactggtgcagaaaagggattaggaagggtggattgcagggagcaggactaaagacgggcagggaaacgctagctgcgcttctttttccggtatttatgtgatggaaggggcgttggcatggtcagaattccacctagttgaaccttttgacgcaacccttctgttttcctttgcgatcatcggaccccgccgctgcgtcactaagcaaagcacacacatcactatgcggacaacaattaaggttttattttgcatgtgcatgggagtcactaagcaaaaaggtgcggttcactacgagaacgactaccaaagcctaactagctgtccttcagttttgatttgtccatgtacagggcaccgcgcactgttacttcgtatatgcgtgctagttggtagcccagctgatttgacaccagacactttcatagtttcattccactcaggcgtggttattagaggtttgtgtcatggatgtagattacggagatccaaaattgtacaaatttaaagcggggaaatttaatatgattttgttatgtttctagcaggccttttttgatcgtacgtcatgaactcatgatgcttaaaaaaaatcgatttgtcatctttttcttttattttatgcaaaaagggcaaaggtaatatatacacgtacgtcgtagccacgtaggggtgatatggaaaatttggatgcatagctatcgtatccaaaatatgcaaaactgataccgagattgtttatgcgttaaggaacgcatacaaaactgataccgagattgtttatgcgttaaggaacgcatttcggtccacttagtatatgtattaataagactagtcacttgtcgctctatatgcatgaaagtttctcaaaagcatgagcttacgtagcagaagcatcctattccgtgaacctttccacttggaggctaagtagtgttcaaccatggctcatgatttggtatcagttagggttttttagagaaagatttgctactgcacttgtccacctttctgttgaatacacttggcccatcctttttcttctttgtctttctggtatctagaaaggtgaaagaaagaaaattagaatctttatcttcatgcagcattagccccaaagaaaggaatcaaggaaccatcgaatatgggcccacaaaagtataaaacggaggaataatgtagctgtgaaaattctcaaatgtatatgctggt

SEQ ID NO: 4804 - DNA, 1044 bp, Zea mays
  misc_feature (1)..(100): optimal_loci_58634_G1, chr2:38109081..38110124, Cluster 29
gtccttcacaaggacaaaagggctcccaaaacgactaagtataggagcacatgaaagatcaaagaatataattggtccatgccccaagggcagacttatgcctaaatgtatggcactacatccaaagtttgttgtcgtcgacatcatggtcctagaactatttgtaaggctctgtatttcacattaaatgtgaagtgtgacattacgatctgatagacacactagtaccgtgacataagcctcaatcgtactcaagaccagtatatgatacatactattgtccctctagccatgcttgagtatactagagtaccacgaagtattatgaagtacaaactactatatcgatttccaattgtgtcgtacctcatggtgtggactctagtactcgttgatacaatagaccatgcctacttctacaacatgtcatatctatcgttgtagcaagacgaccctaacattgtagcacgaccaaggcatgccaccatgtacgactccataaccatgacaagttgttgggtctttgctaagtgggactcatagtctatccgacatctaaccttgtctcctcccttgttctataaaagagaggaatagagtagtgtagagaaaaaaatgaatgaggccaatccaaccaagttatatggacagacataaaggtgaggtagggaccattatgctagaactctcaccaaaaaacatatggtagagctaggaggtcatggtgctcatatgatacttgagcttgcatttttattcacctttgcattttcaatccatgatacacaaaagaacattgagtattatatgctccaaggactaaacctctctaaactgcctttgtggtggtactaggctgcacccatgtttaacttacatccaacctacacccctactctatccataatattttttcatattttggatatgttcggtacccctgtgttgtgccatgatgataagctacattggttggaacatccattctcctactacaacatggaagcatgagatctttcaaaacgacatctataagcaagggca

SEQ ID NO: 4805 - DNA, 1354 bp, Zea mays
  misc_feature (1)..(100): optimal_loci_59569_G1, chr2:43696810..43698163, Cluster 29
actctacgtattttgtgtgaaatttctagacgtgccatatgaaatttctacgttctaaataaaacattagtatttgtagccacccaacgctcaaaaattgcagagagcgaatgtcacaagaaacctatcgtattttactgtatctaaaagaggctctaaagaagtgtcaacgttaatatttatggacgaactagaaaaaaatagatccttaaagtttctacaataataaaaataaccagtactataatcatctatgttaatagctattggatctattatattttataaataattgttcatttatgttattataaaatatccaataaaactggttaaagtaatatacatgtgatgcgtatcaagtacacctgcatggataagcaataattatatatattatgtttcaacaatcataaaaatttatccccttggtgactcaaatatgaatgatactaacaactcatactaaactcattcaaaactatactaatatccatgtcatataatttatataagttgccacttcaaataattatatacattttaactaaaaagctcaacatattttgatagtaaaattggaagaacgtaaaattgtaagaattctacatcctagtatctgagatttgtttggattaaacagtgactcaaacgctaaaatattaatgttctctttaggtttgcactgctatggatcttgaaagatgtagtgcaagttgaagtgactgtttgttccgtcgtacaatttaggaatacaatctatcacctaaaaactttattttttatgaaatacaaaaagatttaataaatgatacaatacatataagagttcaacttaaactaaaaacaaaatgtatagcaagtagttttccctaaattgtaaattgacaccttgacatctctaactaatgaggacatcacacctatcattacacccataaaagtttaaacaagatgagctcattcctatgtttgcacaacaacatatataactaagaaactattgttacctaatgtctacatattaaatgtgttttagagaataatttaagaatgctacaaatcttgcattggagagcttcttacgtggcctttataacttatgggacatggacgcaccaccagggacaaatttagaggggtttattaaatgcattgaaagagataagctttccaactgcactagtacccaatacccatgttaaaattctacaaaatcaaagcactagtacccatgttaaaattctacaaaatcaaatgaaaattgttggaataagttggcattcaaatttttgcattataacatgttaggactccttaggaatgtgaatagagtccttggaaaccccttaga

SEQ ID NO: 4806 - DNA, 1219 bp, Zea mays
  misc_feature (1)..(100): optimal_loci_59928_G1, chr2:45971409..45972627, Cluster 29
tacatttcttgatatgtcacatgtatgttgctatctccatgtccgtggcatatacttgttccctggtttgaagggcaacttgaaacgtaatgttattatctccatgttcatgtatataaaaattaaagtgtacggaagatatgaagtgtaatgcagtatatattgccaaaacgacgatactctcccttcccttcgttttaagttataaagatatgttatattctagaactctaggcatagtttttattattatgtgttacagtgtatatttaagtatataatatagaagacgcaattctagagagaagctaatttacattataatttataatttaggacggacgaatctgagtgctatatatatatgcaacgcaatgtgcaacaggttaaaacagaacattattaaatccctgctgcgtttatcttgagaacccaagcaccacgcattagtttatcgctcaatcaagcctgcactagcgcaaacgcaaaacattagaattaacttagttataaaaccaaaccaaagcgaacgaagcacaaacccctcctgaagcagtacgtgagtgtcggatgcactacaaacttcgtcctaatcctccggactttacctgcccaaaccacagcttcaaaagctaaaactcccctcatcctaaaccaaacgtcgtctcaccagtttcccccggtgtagttaatctaatccccatttggcactcactagctagctagtggaacgatctcccatggccatccatctatctctcccctccacttgtttcctccccagtgttctcgcctttataattgtccaggccggggggcataatgcagctagtttaagacgctgaggacccccaaattgcactagtttgcttccaaatgtttgtctttgcttagagagtgcgtgtaccgtttgcgtcttcttgtgaactgaagctgctttgccaaatgctaaccagctggatttagcattgttcttgtatgcttgtttatgaccactgtagccggaatgtacccacggtaatgtttcgcaatgcagggaaggcccaggaatatttgggacatgcttctgatgagagttactgtgtgtgacttttctctgtctagttttgtatgccacgtttgcacaaaagattgagctgtgtttaggattattgctagtcaacaagaggttctttgggaccacaaaaaaaggtccacatgaattgtattggaattctca

SEQ ID NO: 4807 - DNA, 1041 bp, Zea mays
  misc_feature (1)..(100): optimal_loci_60452_G1, chr2:48832628..48833668, Cluster 29
gttagattgtttatgtggattagacacacaagctttgactagcttacagttacgttgacgtgtcattatgtcgagcaattatacatgtcgagagcaattaatatatcataaggcgaacagtaacctgatgaagcttgtttccaacgcagctacgatcgatcggtatgcatacgtaccggccgttttcctttaggtatgcatataataacaacaactagtcagtaagtttagctagccagccttttttatgtcatcaagattagcaccaattaatcggagataactagtcagtataaaaaaacgtcatcatgtgactcttaagcaaccggcttgaggttgaggtttcagtacccccagggagttgagtgctgtactcctactcttgtatagtcatttaaaaggtaggtaggtatcgtatagtatagtctaggctagctagctaggcggctcaacttcttgtcacctcatgtacgaaagggaacacatgcatgcatggcccaaggcctgcaccaggattgcaacagcatcagccatcagcttcatttgttttcttccagaagctcattagcagagggctagctatatataccatgcaatgcatgcatacacagcacatctgaaagtaatataaggaagagtgctgtcgtcgactaattatattaccacctaaagctaactactacttgctagaatttccagcatgaaatggaccatgcacgctggtgtcctgctaattaataatacccctatacctgtagtaggagtggatcttgctaatgctgcgacagaactcctcatgtgtcatgcaggcgtcacaacgccagcagcatgccctcttgaccattatattgcttttgccctttgctagctgctatcacttgtaggcttagcttgtggcacatactaacatatacacgcctcccccaccaaactaaaaaggtatcagggagttcagtggagctgtgggaaagtacagatcagggagagcatcacttgggcatgaagccacccaacttccatttctataagccattttcagtt

SEQ ID NO: 4808 - DNA, 1006 bp, Zea mays
  misc_feature (1)..(100): optimal_loci_6518_G1, chr1:33452129..33453134, Cluster 29
ccgaacagcaggcagcaggtgtacaggctacaagataacaagatttcattattttcacgggaccagtagcttcagcaagcgtggagtggaatggattaatcatctggttcgcttgcttgctcggtgatcgatttgaattattttgctaggcgacggaaatcaaagggtggtctcagtctgtctcaatattaagtaattgttcaccaaatttttggcttgcaattaaatagctcgtttgaagaaggacaatctagcaagtttttgagagaggcttgatgtatactcggtgatgtgatcatcgattgactctatccaattcaagcatgtgtgtgcgcaaataaagccaacctttctgttctgcatgttagaatgacgtgaataatcatacaatcaaaataactcagtagttaaattagaatgaaaaaaatcatcccatactttctattttttttatctcagcagttaaataactaaatagacacatatacataatatatttttatgttgttctgtgttgtaaatgattttttttaaataaatttataggagtgttcaacaatgtcatcatgatcccaaaatactgtaaatgttgtaaacttgtaaagtcaatatgtatttatagaactgtgtaaaaatcattattttttgttaaactcctaataacatgtatattaaattagaataaaagaaatcaccttgtactttctgtttttttaactcagcggttcaataactaaatagacacatacttttatacgttgttctgtgggtgtaagtaatttttataaagttacaggtgtgttatatagacgcgcacgtgctcaatctgttgaacactcctataatttatagaatttatttacagcacaaagtaacataaaagcgtacgcgcctatttagctatttacagttaaaaaatagaaagtatatgatagctttttttattgcaatttgaagtacatattactgggaataataattttttttttgagaaattcgggggggg

SEQ ID NO: 4809 - DNA, 1071 bp, Zea mays
  misc_feature (1)..(100): optimal_loci_7377_G1, chr1:38215539..38216609, Cluster 29
gtgtgagtcaatagttacaacttctgatatcactaagggaggtttggacgctgaaacagaatcatgcaaatataagtttaaacaaaaatattatcagagaaatattattaaaagaaattacagagaaaaaaaactaactttcagaaatcggatcactatccggtcggatggagttaatgataggttcatcagccctaggatagattccactttcagtcattcaacggtttccaatataagcatgaagcatcaaatatatggatatctttgggcggtgcactttacatgcacaagaaaatgacaaactgtctgttacacacaaggtctaccagtgcgccccacagggatgaaactaaaattatgttctcttcaactactatgtaaaggtgtgtttgttttcctcgtatattatataagttagattacaacgaaaaagtataaagtcaaaatattattttatgatcacaaataaactaaaataaataagtatagagtaatttatttcaacttatttatgatctcaaaataatattttactcttttactatttcactgtaatctaatttatataatctaagtccacacccgagtctccagctcagataccataactatgggacaataattttgtctgcttttgtttataattgatttatttataattgtcgtacagggcggattttctaacatttttgatcgtgctagtctaaaatcatgaagcgatggccataataaccaataaaaaatcaaaccaaaatgtctaaagagaccctcacgtctttgaacattaattcgattttgagagcatattcgagaattgtaaagaacaactctctattttatatcctaacaggaggaaaactgcccttcagtagtttggtaaaaagattctcttaaccacgaaaagttgccaaattgttttctctaactttaagtttccgtaatcgacaaaaaacttcatattcgcgctctctcatacgtgtagtgtagaccaagtaaattgaacctagggttaatttttttaaaaaaaagaggaccacggacaagagaaacggcaagacaaaaaaacta

SEQ ID NO: 4810 - DNA, 1040 bp, Zea mays
  misc_feature (1)..(100): optimal_loci_7575_G1, chr1:39766063..39767102, Cluster 29
caactcgtacaccaaattcacgtgaggggaatgactcagggcatggttggagcccgtctaagtccactctctttgttattatttatttgatgaagttgacttttttctaaaactttaatagttcagtttattcaaaaaattaatgtaaacatataaaagtataataaatactaaacttaacttaacttaacaataggatacacaacaaaaaaatagatgaaacctacattttttgaataagaccagtgattgaagtttttttttaaaaaaagtaatcatgtcaaataaaaaagaacaaagcacagagaaattatttgtatgcatgttaaaattttgaatgtgccatgtaaagtgcaatttcatacacgacacatttgctctttcagcaactgttttgttcttggtcgtttagttttcttctcataaaatttatccggtgtgcttggatactcactcctccactgaaatttaggggacgctattcattttcagctcctgtaatttaagagtaaatttgtgatttcatcaactctactctataaactttattatagaattacttcataaaaactcaagagttttcatctctatatttttttctactatagagtgttggttacctactaaagctcctacacgaaaccataacaaggcaacatagttaaaggatacaccattttctcttcatcttggagtgtccgaagataaagaaagaagaagtaaaggaaataaatgaaacatacataaaaataatcaacataaggtttaacatggaataaacaatgaatattttctttcatatttttcttctcctcccttggataaaagtttataaagcagattacaaagtatacgccattttcccttgaatattatagttcttcatacactaagctatctgaaggcaacactgatttagggtgatagaatgctcaatcctataataatagtgtctgaggattgtttggttgttagttaatagggtagaccgtgagatcaagtactaaatgcaaaacacacatgagacacaaagatttaga

SEQ ID NO: 4811 - DNA, 1252 bp, Zea mays
  misc_feature (1)..(100): optimal_loci_7677_G1, chr1:40177663..40178914, Cluster 29
ctatggggaagctctaatcacccattcactaatcagtgatattaactgtgaagttgatccttttcaagtttaattaccagataacaatgtgcattacagtattacaaatattttatataatatttgaagtctagaaagtgatgtataaaagtcaaatacctcaatttaaatataaaggggagctgaaaatagggggaataggagaaatatagggatgaatgaaagagggagatgcatttaaaaatgaatagaaaatataaatagggggaaataagagggggaatggttagaatcagtaaacttttgctctctcatctataggttagtgacttgcatggccaacttgtttataaaagacatttcttgttttctgcttataaaaatgctagcgaagttagaattgcccataagaagtgcaaatgccttatggtagtactaatagggtcactttctttatggttgtttggtgaccaaagaaacggaggagatatatggaagatgaattatctttctattcaaaattgaattgaatagtttgaatagcaaggggattcttctcctatggatcttttttattttcttggttacggagaaactctgcacatatgcctatgtagtgaaaataaaataatatttaaactaggctataaatccataaagtcacctatcccaggtaaagccctacttatgatttggtctaataactactacttatagaaattaatctgtttagtactcaccctggtagctagattaggtacgataacgactactctcctaactgctactactcttacttattgaacgttttctatttactaccctaacttttcatagtattttcttgagtcacaaccctgttctcataagaaaggaatgtttttcttggttactgataagagaacaaataagaatggagagttatcgaagtgttctgctactccataatggcatataggaaagccaaagaaagaaagttgaacgtattatcgaagtgctctgctactcagggtctatattaacttgtaggatgagtagtaactacctgtattcgtatattgaaaaaaataaagaaaattccagtgtcgattaccgtttctggttcaagaaaagggaaagtgttcagttgataaaagaggggtttcactcattggtgtaattccgttgcatcggtgagtgagaattggtggctaatgctagctgcttgatgcattataaaaggccggctagctatgggccaggttttttttat

SEQ ID NO: 4812 - DNA, 1086 bp, Zea mays
  misc_feature (1)..(100): optimal_loci_80375_G1, chr2:173766773..173767858, Cluster 29
catgtcgcccggccggggctatccatcaggctagggtagccctgcagcccatgcatgcgtcgtggtcgtcgtccatcgcttctctcatctccctcgctcatcttttcctcgtcgtcacctctaggctctagctagcgcagccagcgcggggcctttttgcagcatgtcttttcacacgcatctctgtagtaaaaaaaccaaaactacgtagtcgtcatcgccaaaggcatgcatatgcatgtggcggtaaaaaagaaccgatccatcactctctttctcagctagctagctgcatgcgactgtacgtgcgagctgatgagcctgcaacttgtgatcactttgcgtcagctgccaaggtatacagtccgcggcgggatatatatattacatgcatacggtccacaagctagcagctagctactacatatatacatatatatagtagtacgttgcttacagtgcaaaaagtaagattcgtgcatgagaaaggggcagtttgatgcatgaataattaaagtgagcttatagatgcatgcatggctacttcttcggtgccatgcatgtttagaactagtagcgatagagagtgcctaataataaattctgatgcccggccggtggagtggtagattataataaaatattagaggccaagtgtgatatcatttgtattcaagaaatgacttaaacataatatggaataatttaaacaacatggaatgaattaaaacagtaaaatatcaaatggaaattagttaaaaatacctcagtagtctaaacataagtcaattaacaaacaccaagtaagatgaaatatctaaaacacacggaataacttaatttagttgaaaaaactaaaggagaattagaaagcaccgagtaaggttaaaatgtcccaaatacatgaaatgatttaaaattacatggaaaactaatttaaagcattgaataacagaaaataccagaaaaacagatggaatatcttaaactagctagatgaaaggaccgaaatgagagttgaatgttttaaactggttaacatgagttagaactagagtgggttgtctttaactagatatataaaag

SEQ ID NO: 4813 - DNA, 1196 bp, Zea mays
  misc_feature (1)..(100): optimal_loci_80592_G1, chr2:174604366..174605561, Cluster 29
cgattaaacaaagtgtgtggttgcaaaaacaccagggaccaaatatatacaaggaaggattgctaggggagtagggaatgagtgatggcaccatagagtatgcctactaggtcatgatactacaagcccaatacataaagattttatagaggttcaggctatagagtgcgtaatatatatcctatgtctcttagtgatggtggataattgcatgaagggtgtacataagattagaagttctaagtcaggggaactagaactactacttaggagaaaggtaggctaaagaaaactaaactaactccttgtactagcttggatggattgttttcaagtctcttggtttgagtttggtcttatgaccctgaattgaatgttgttctaccaaccgtttcatagtctaaaggagtagtagtgttcatgtatatacttcatgtggcctcgacctatcatattgccaagcaatcatgttctatcatgtgattgtatggtatatcttatggtaggcatgctctgatgtaatcatgtcattatgctcttgacgcattaatgctcctcataccttttgttacaagcatggttcttcgtaccatcctacacatgtaactaggatcctcctaatgcttggacaagtgggatctcctatctaaattttatagtgtattctaaactatatgcatatagtggctctaagtacacctgcccatcacgcgtgtcagggcagagggcatgctcataatatcacattaaacactaccactgtcaaagttatcccttggtatgataacccactataccgactacctaggtgggcattaaaacctacgacatcgacctttgcattgtggttatgatgttcgcatgtgataggctaccgataatgctccttatatctcatcgtactactaggtatgacatgcacttatttttcgagctataggaccgttgtgtgccctactagttatgttccgtgtctacatgccttgttagccctgttacgttgtccatcgcatgtataatgagttaaacccaagacttatctattaagatatcacattgaacaatattcaaggcatattgatatcgagcccatgtctcagtgtcatactatcctagtgggccctccacaccattcagccccacaacatctcgatgtggttactaagtcgttgttgcctttgggtggccaattagtc

SEQ ID NO: 4814 - DNA, 1074 bp, Zea mays
  misc_feature (1)..(100): optimal_loci_80792_G1, chr2:175680605..175681678, Cluster 29
acatcatgtccaccccaaacatgcagaagtaactgaaaagcttggccaagaagggtgtaaataacatggccagtgcccactaatacccacgaaagcttctctctcgtcagccgtcattccgtcaacacgtttttcgaggtcccatccgtgaactcaagccaccacctggtcctctcgactcgacgcgtcaaggtcccattcagcttccacgttgctgcgccaatggggagcaagagcaagagagctctgacaagagtacaagagcgatgtaccaacaaactatcacttctcgtggtgtgtaaccaatacaataaagtcaccatcaaagtggtatgaatagatcctctacctgatgcgcgcgttactcacttttagaatttcactctataatttcattctaaaattccattatcggccagccagctcttagattttgtgacagaatcgatctcacaataataatatctatataagccgatagagagatttgtattcgtgtagtctctggcttcttctcaaaatccacggagaaccagttccaaacgcggtatacgcactcatgataagtacagtaaagattcaaaatgctcaaaagttattagtgttctctgataaataatttcgtgattttcagtgttttctgcccttgtttggtaatggtacgtactagcaacttattttttttctccattttgtgataaagagagacggtgcggaccattccgttatactagcaatttatttgctcgcacaactggcaaataaaccaagctgtgctatggaccagtcctcacacattaattatttctgacaaagaaacgaactggtctcatgcccgtcaaacgagtagtagtagtgagcagtgggccagtggccatgtcgtttacaccttctttggccaaaccttttctttggttatcagcgaccagattttgtgcgtatctgtatatttgtggtggacagggcgtgaagcaaactaagatatcgtgttttatgtcgagtgatcttcagagatttagcaggattcaacacatacatatatagtagataccagtataatgtcccatatatata

SEQ ID NO: 4815 - DNA, 1086 bp, Zea mays
  misc_feature (1)..(100): optimal_loci_81339_G1, chr2:178801933..178803018, Cluster 29
attcactaccgaaatacctttatcttttgatctcacgacctacataatagattcacttgcaaaaaatccttgatagttggcacgctctataggagaagtcacactaattaccatagagatgatggtatccatggttttcgcacaggaaagaagtcatcttcggcaccctcagattcatcgtcgacctacttagaaactcgggctcatcctaaatcttttggcgattctagcgccccatgctcaagtttctaaagatccaatatacactttgctaaactagggttgatctggccttacgacatcgacacggacttggactcaacttcgacttggaaccgaaatcgatctatgacccaattcggactcgagctcatatagtacatatgaagattgcttcatattcatgggaggttctagagcactgagtaaatgaggcatggtcatctaatttaaaagtccctactcaaacacttagattactgagtccacgagacaataatcaatcagagttttgagtcctaaaactcgtgcatcaatgaaaggttttcctataaggacttcgagattactaagtgcatggaacttagtcatctctatggatgtcgatttgaagttaaaaatgggcttaactctgaagctaatactcaactcgagtgcattcaatacgaccatatggaaataatgatgagtccatatatatgagtaagttatctatgaatttcggaagcgttgagtttgagttcatgtaattcgatcatgtatacattttaggaatatcgagtttatggaacccgatcatctacaattttcaggcgtacctcaaagtttgagaatattcgaactgtttttctcatcatttgactactttaggtatgatgtcacttagtggcatatccaggaagggatggaaggagtggctgattttctagtgactagtggtgaaagcagcataagctagtaggagacttatttttactctattcttcctcctccttcctttctctctgacatctatatctttctccaattgaatatgggggtcatttttcttctttcttctatatttttctctacttgcgacctcta

SEQ ID NO: 4816 - DNA, 1280 bp, Zea mays
  misc_feature (1)..(100): optimal_loci_81887_G1, chr2:181189844..181191123, Cluster 29
ttaatcgcattggttggtagtcaaagtattgcacaactgacttatcacatgtcccatgaataatgcgggtcatatgatgtttggggttccacatctgacaattgagttaggagagaaaggaaaaaagttaagtatgggtgtgtcatttttaccttcttgctttctcacatgattcaccatgcttgtctatttctttgctccccctcgccttcctcctcctaagtcaggtactatcattccctcttgtctattcaacacgatcaccattgttattgcattagctattgacctcctgccgtgtggtaggatcctcaaccaggaaggcatggacaaggtgcatgagctcctcgggtgggtcagaccatcgacgtccaacaatgtttgcccaacgatgattttggcatggactccctaggaggaaataggagagtacatcatattctactctcatgtaatggtgggaatggacttatcattgttgaggttctttatttgtgtcctcaacttttacaatctttaggttgggcatcttaccctgaactccgttctcaccctcttggactatctagctaccaacacactaaatatttctagtcacaagatgtgtaatactctacgtcctctttgtgtatggtggattgatgatagtagtcatggagaacattatatactcaaatatcaaccgagtccgatgacaatctagctctccctttccttttgttctagtgagagttctagattatctggttcctagatcacatctagctgtttcttgaattgagtttgaatggtttatccaaattgaaccctttctatgctactctactactctcttttataggttaaaggaggagagagtgatacatgcatgttgggcggcgaccattgtctaacagagactcgcctatcttgtcttagacaaagtccgggtgcatgcctttatcgtgccataatgttaagattgttatgttgtagtgacatatatgttatgttgtagtggtaggttttgaagcccatgccgtctggcatgacatagttggtaaatggtacaagtggttgtactttataatgatttgctcgtatgctagtacattcaggcatgggaacacagatagtggcacacattgcatggtgcctcaggtattactactactacacattgttgtggctacatgaatggtgacatgtatatattacacagtagcgtcggatatgcctgcgacctccgtcttggttacagtgcaccaccttgaccgtcatatctcccatcacctatatgg

SEQ ID NO: 4817 - DNA, 1070 bp, Zea mays
  misc_feature (1)..(100): optimal_loci_82331_G1, chr2:183612510..183613579, Cluster 29
aaatgtgggttcagatattatctaacatgaatacaaattgaatatagtttgaattatagtaagcattaataaaatattcacatatctactcattttagttgataacaagtcccaatttgccttgcctatgtactttgaacaacaaatctatatgactagatcaaacacatgtagataaatatagaccataaaaccatattttatccaaaaaaatatttcaataatatcattaggaggatatatctagacccttagacatagggtagccgcttttcttggtctattggggttaatgttttattagcaggttagccttcttcaaatgctataaaaagttagaacaagctataatgaaagttattcattagtggttttatagaaagcatgaacatttttgattaatcgtgcatgaattcttttaatagtacaagattcgtgaacacaaataattaaatacatatataagatatagaagaatatgttttcatgtccattacttaacattcatcatatcagttgtgctaagtgatattattaacactcaatattcaactgttcaataactatcctatgatttattatattatttattaagtagagaacataaaggagagacatagattatagttttgtagactaaagaatgcacatatataccttagttaggattggagtgctaaaattatgttgcttctagattaaatagtggtgtttagcggagctaaaacattagaagtagtaatagaggaacaatcaacaataatatgatggtaggccattatgaaaaattatagcgtattatttaaaaccatgattgggatgctttcgtaacataactaggaaaccaatcctagtaaaaaaggaaaccaacttgtaatcttttcctttaggtaatataaggaggggcattacatggaaacccctctatgtcccttgatgtccctcacccaagagatacatcatcgtctagtggcacccctcaatgtcattcaatgtctttgaggttcacaacatgttctttggtatcatctagcatctctcgacgtcacttggcatccctcaccattatt

SEQ ID NO: 4818 - DNA, 1029 bp, Zea mays
  misc_feature (1)..(100): optimal_loci_82579_G1, chr2:184973075..184974103, Cluster 29
tgctgaccttgcaacgaaatctaaaatatattataatcagactatgtattatataggtataaatcgtttaactcactcgcccataagtagaactaatgagttcgaatcacatacaaactatggacgatgtaacctatatattttacaatcgaatttcatatctcatcgttagctagatttaagctattataattcgtatgcagtagtccaagtcattatatacacaaacatatacatagagagagagagagatttttcttcattattgtaagtcttggttagcttaatctgatgtgtttcttttatttatacaagaagagggtgatcttattctataataggggttaaaaattcttgcaaaactagttaaaatacaacttaaatgtgtaatggcccgtaaaaactggcctagccataaaccggttttcctatattagcaccaccaaaatatattttcttcatttagattttaaatgggatgagcttgctgatcgtgaaggcttccctgcaagtgaatttggagcacgaacaaaagtgaaataaacacgatataaagttgcaaggatatatgaagtatatgagtttcacaaggttttaagtctttattcgaaagaactaatcaacatagatgaacaagataaaaacagagggctaatgtttcacctgacttgatcttaacaatacaaatgcagtgaatgtccatttcatgagaaaaacaagattggaacaaaacctgaatcctaagagagtcagatggatatttacagagagccttgagtatcatccccattcccatgaggccatgaacacatcccctaataggctctaagatgataaatgggccaataaactaaaagacggtgtcatagcatcttggaaaattatagatgatgaattgtttcgacaattcatgttgacacggtatgaaatttaacatcaaatcgaagtttggttagattatcaagttatcttttcatgcatacgtagattgtcaaaaatgaaatctatatgtgtattggacacatcaat

SEQ ID NO: 4819 - DNA, 1124 bp, Zea mays
  misc_feature (1)..(100): optimal_loci_82751_G1, chr2:185841006..185842129, Cluster 29
gacgatagtcaatagcagcctgtaatagcagaccttctagctgttgcattatgctggttctaaccctcgtgcctatatgaaccgctagatcagctattgatcgtatgatcaactctgctattgaccatcgtcagcatgtttgaattttataattatgaacatctcaatcaatttagtcttttcaattttagcaaattttaaactgattgtcctgttttttctgggatattacgttttgcatatatgggatatcttacttaagatcacctaatttatacagtccagtcggcgacaccacactgcagtactcttgccatcctatagattttattctgccaattaaaagtacttatgtattactccctccgtttataattcgtctgataaaattataagtacggttttgaagttttcatttatccgtaaaaaaatgaataagaccagaaaattaaacttgataaaaaacaaataaattataaattaggagagagaaagtagtaatgttgccttgtcgtgttggttcttggttggttcaggatgtaaaatcatgtagtctataccatattaaagtgtcgtcatgctcttcacatctaaatagcaaaaatgataaaattatgtataaacgaagatttgaactatgattttattagctaaaagcctatattcatactcatctatccaacaaaacatatataactttatgttttatattctatactttattataaatagaaaccgtacacagacacttgaacagcttggttctctatatggtggcttggttctgttttacctgtttttatcacgatcgctattgtcaaattttgttccaaattagatcgttttcgtttgagtcctgtcttcgttcctgtttgctatcttttctgttttcgattttatttcttaaaataaaatgtaaaaattgaatatagagtatataactgtttttaggaccatatctaaccgcttggtggtcgaggcatgagtgcacgactcctgtacggaactcccctattacccaaggctggtctaatatatttaccggccggcccgcttagggcagagcccatgtatggtgaatggatgggtggcagataggcggagtcatttggccagccttgtgc

SEQ ID NO: 4820 - DNA, 1401 bp, Zea mays
  misc_feature (1)..(100): optimal_loci_83650_G1, chr2:190924313..190925713, Cluster 29
  modified_base (1251)..(1251): a, c, g, or t
  misc_feature (1251)..(1350): n is a, c, g, or t
  modified_base (1252)..(1252): a, c, g, or t
  modified_base (1253)..(1253): a, c, g, or t
  modified_base (1254)..(1254): a, c, g, or t
  modified_base (1255)..(1255): a, c, g, or t
  modified_base (1256)..(1256): a, c, g, or t
  modified_base (1257)..(1257): a, c, g, or t
  modified_base (1258)..(1258): a, c, g, or t
  modified_base (1259)..(1259): a, c, g, or t
  modified_base (1260)..(1260): a, c, g, or t
  modified_base (1261)..(1261): a, c, g, or t
  modified_base (1262)..(1262): a, c, g, or t
  modified_base (1263)..(1263): a, c, g, or t
  modified_base (1264)..(1264): a, c, g, or t
  modified_base (1265)..(1265): a, c, g, or t
  modified_base (1266)..(1266): a, c, g, or t
  modified_base (1267)..(1267): a, c, g, or t
  modified_base (1268)..(1268): a, c, g, or t
  modified_base (1269)..(1269): a, c, g, or t
  modified_base (1270)..(1270): a, c, g, or t
  modified_base (1271)..(1271): a, c, g, or t
  modified_base (1272)..(1272): a, c, g, or t
  modified_base (1273)..(1273): a, c, g, or t
  modified_base (1274)..(1274): a, c, g, or t
  modified_base (1275)..(1275): a, c, g, or t
  modified_base (1276)..(1276): a, c, g, or t
  modified_base (1277)..(1277): a, c, g, or t
  modified_base (1278)..(1278): a, c, g, or t
  modified_base (1279)..(1279): a, c, g, or t
  modified_base (1280)..(1280): a, c, g, or t
  modified_base (1281)..(1281): a, c, g, or t
  modified_base (1282)..(1282): a, c, g, or t
  modified_base (1283)..(1283): a, c, g, or t
  modified_base (1284)..(1284): a, c, g, or t
  modified_base (1285)..(1285): a, c, g, or t
  modified_base (1286)..(1286): a, c, g, or t
  modified_base (1287)..(1287): a, c, g, or t
  modified_base (1288)..(1288): a, c, g, or t
  modified_base (1289)..(1289): a, c, g, or t
  modified_base (1290)..(1290): a, c, g, or t
  modified_base (1291)..(1291): a, c, g, or t
  modified_base (1292)..(1292): a, c, g, or t
  modified_base (1293)..(1293): a, c, g, or t
  modified_base (1294)..(1294): a, c, g, or t
  modified_base (1295)..(1295): a, c, g, or t
  modified_base (1296)..(1296): a, c, g, or t
  modified_base (1297)..(1297): a, c, g, or t
  modified_base (1298)..(1298): a, c, g, or t
  modified_base (1299)..(1299): a, c, g, or t
  modified_base (1300)..(1300): a, c, g, or t
  modified_base (1301)..(1301): a, c, g, or t
  modified_base (1302)..(1302): a, c, g, or t
  modified_base (1303)..(1303): a, c, g, or t
  modified_base (1304)..(1304): a, c, g, or t
  modified_base (1305)..(1305): a, c, g, or t
  modified_base (1306)..(1306): a, c, g, or t
  modified_base (1307)..(1307): a, c, g, or t
  modified_base (1308)..(1308): a, c, g, or t
  modified_base (1309)..(1309): a, c, g, or t
  modified_base (1310)..(1310): a, c, g, or t
  modified_base (1311)..(1311): a, c, g, or t
  modified_base (1312)..(1312): a, c, g, or t
  modified_base (1313)..(1313): a, c, g, or t
  modified_base (1314)..(1314): a, c, g, or t
  modified_base (1315)..(1315): a, c, g, or t
  modified_base (1316)..(1316): a, c, g, or t
  modified_base (1317)..(1317): a, c, g, or t
  modified_base (1318)..(1318): a, c, g, or t
  modified_base (1319)..(1319): a, c, g, or t
  modified_base (1320)..(1320): a, c, g, or t
  modified_base (1321)..(1321): a, c, g, or t
  modified_base (1322)..(1322): a, c, g, or t
  modified_base (1323)..(1323): a, c, g, or t
  modified_base (1324)..(1324): a, c, g, or t
  modified_base (1325)..(1325): a, c, g, or t
  modified_base (1326)..(1326): a, c, g, or t
  modified_base (1327)..(1327): a, c, g, or t
  modified_base (1328)..(1328): a, c, g, or t
  modified_base (1329)..(1329): a, c, g, or t
  modified_base (1330)..(1330): a, c, g, or t
  modified_base (1331)..(1331): a, c, g, or t
  modified_base (1332)..(1332): a, c, g, or t
  modified_base (1333)..(1333): a, c, g, or t
  modified_base (1334)..(1334): a, c, g, or t
  modified_base (1335)..(1335): a, c, g, or t
  modified_base (1336)..(1336): a, c, g, or t
  modified_base (1337)..(1337): a, c, g, or t
  modified_base (1338)..(1338): a, c, g, or t
  modified_base (1339)..(1339): a, c, g, or t
  modified_base (1340)..(1340): a, c, g, or t
  modified_base (1341)..(1341): a, c, g, or t
  modified_base (1342)..(1342): a, c, g, or t
  modified_base (1343)..(1343): a, c, g, or t
  modified_base (1344)..(1344): a, c, g, or t
  modified_base (1345)..(1345): a, c, g, or t
  modified_base (1346)..(1346): a, c, g, or t
  modified_base (1347)..(1347): a, c, g, or t
  modified_base (1348)..(1348): a, c, g, or t
  modified_base (1349)..(1349): a, c, g, or t
  modified_base (1350)..(1350): a, c, g, or t
ccttgactatgcaaattgacaaaataaccaaaaggatagttgcagtctagagaggtaggctctaggcatatggaggcaaattgacctttggaagtcttgcctagcaatcgctcccgatttcccatccaagagatgtgggttttcatgagtcaaactttaattcaggacctgtttagtttagttccaccgctagaagatccaggtcagatttgttaagaagtttgtagattaaattaaagtagtttaaatagtaatatctagaccaaatttaaaacaaaacagacgatctaaattctctctatgtatgttaaatttagcttcatgattccttgaagctacaaattcccagctccaagagatccatctttttttaagattggtgttcttgcccctttgaaagctaattgctatctggccttgttttttttcaactttgcgatttagctattgattcctaggctctgttagctaaagattgaaaaacaaatcaagggaaaataaataaataaggacaatacttactcatggtcttattctaaccctcgtatcttttgctgatggttgactaatcatgcacaacttgttaaacttttcttatattctaaatatttgtaaattttgttgtattttttttaaatgttgttcatttttttgatgcctaaacagaggtggaaatagtataatactaaaatacgtaggggcaaattcacgtgataaaaccaatcatttttagttaagtggcactattaactcatctatgtaaaacatgggtcaactctaaaaaacagtggcaaaatcataaatttaaaataaatgtgggtgaaatcataattaagattcaaaatagggtagaaacattgagccgtttattttggaggctatgccaaatggagctttattatgtaaaacttatttttttttcaaaagaacttgcacgtcaccatgaaattcaactggtacagattatatcctacgatttatacattagattaatgtggtctaaatatatctaatctaaactacaagtagaatcatctaaatattcttaacatatctccgattttagctccaatatttgttggggatataaacctccaactaaaaaacatgtttctaagttgaagctatacaaaattgtccttactctctttggcttagattttgctacatgaatgcgctcgtcacaagaaaattcaacatcaacaatgtatatacacaatctaatagacatttatttgcaaatcattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagtgaaaatgttttatcgtaatgaggatattaataaactcactagtca

SEQ ID NO: 4821 - DNA, 1059 bp, Zea mays
  misc_feature (1)..(100): optimal_loci_8554_G1, chr1:44936295..44937353, Cluster 29
agttgtcctgcgcaatcgaatgtgttgtattttacatgcgcacaatgcatattacttgcctttacatatgcaatgtagccaatgaggcaatgagggatctagaaaaattagctagacaagacatctcctattatctttcatctctaaacaattattttaaattttcataccaaattgtaggagagagactctataatttgagttagtgagggttcgattccatcgccccactctcatgtgggatctgtacctgcatgtagccataactgctatatctttttcctttgtttggagctatacaagaggatcctaatgttcactacaacaaaatgcattccacaagggattgtaatgcattttaaaaggccatcgtcttgcctgtctcaactatatggttattagaaataaaaactatagaggcggacaaaacatccttacagtttaaatggaactacatctacaaaattattgaaacaatttaaagggatgccacattgcgaagctcattgttgtctcatcaccgagttggagctacctcaccccactaatccatagagttgagcaccatcacaaatgcaccaaagccccaagccgaatcgccatggatcaagtgtcatgtatctgctccccccaccatggatgttgtggatgagccgccatggatgttgtgcctccttgtgaatctgctagatgtgactactatcattagatataaagagtatgagggagagagaagggtcatcatagatcatacctcaataataccactcactaagggtctacgacctacgtgcgcctccatgtaccgccatcacaatcacaagcatgagatatagtaacattgtaccataggaaaggaaggatatgcatgcttgccaaaggggaggtggggtgtcatgacccaaaggccgctccaaataaatctttgcaaataaacatcttgaaaaccccaaaactaatcattagtcccctaccttgagccctagactctagtggaccctagatttttttgtctcaccagaccctagcaggaccatattatcgccatgctcagtgtaa

SEQ ID NO: 4822 - DNA, 1387 bp, Zea mays
  misc_feature (1)..(100): optimal_loci_858_G1, chr1:4553282..4554668, Cluster 29
ggtgatcataaataatgacgaccgtgtgaatttaagacactgtgctccatcatccaagcctattagtgtcttcatgtttttttgacagatcaagggcagaatgtttctgtttggcactgcgctggctctagctcttagcgactcttgccagttgccacgaagccttaccaaacatgacctcttctagctcctccttatagtttttgccttaaattataacaaaattgccattaaaactgtttatatagaacatctttcaaaatggctccacctcttctttgtagagctcttgggggcttaagcttccacctggcagtggactgttctgtagtagtcatatgaagcctttttttatcgttcatccatataactataagccagtgaagctactgctttctacatcacccgttcaccgactttagctttattggttgctatagcaataaactagagctggctaaagcttcactaaaaaaggatgttttcaaatgggaattgctttggcggatgtgaaataccgtacccaccagaggattgcttatatttgtgtctatattttgaatgtcaagaatgctaatatagatggaaggaaggagcatttgaatgtgaatgggtttaacctttttatttatatacattcccacagtatcaagttaactgttgtcctccaaatttaattctaatatattttagacatgtacaacctagattatggtacggttctccacgcaataagaaactcattcatacatcatattgtatctaatccttgtatcttatttactagaaccattcaagatagagacattcatgtgagttgtatgagtggaattgtacttaaagaatcgtgcaagagacattcctttacccttttttgcacttaccccttagataccccttaagatacgagtcatttatatgggttgtaggttcccttatgcatttattcatggatcactaatcatgttgttgtcagaagggggaaataccacatactaaggccacctctagcagacttcctatatcacactctctattatttcaaactccactatgtaaattgtatggtcatatgcatgatttgctgaacacggtctaaataggtcatgggtgcgaattgaaactctcgttttgggactgatatgatctgttatatatcacgattacaacctatttataggattgtttcacctaagctcattttaacataagacattttgacgatatataaaataacacgaatggactcaaagggtagtctgggtaggtaagccctcgactaccctggaatttggtccaaaaataaaccactcatgtttagacccaaagaaataaatctatgtaagttgcaacctaatttgatgaatttaaatgcattatgagacat

SEQ ID NO: 4823 - DNA, 1127 bp, Zea mays
  misc_feature (1)..(100): optimal_loci_86705_G1, chr2:209231588..209232714, Cluster 29
ttgggttaaagcccaatctggttctcgttaacaagttgtagaggatacatccaacagtaggctgaccccgcagaggcaacactagccactcttacgaaatctcttgatgtcggacaggtagattacgaagagaggaaggaactaaaataagtaaacttggagagttagaagctaaattcatctggatgtaatgataattaaagagataggtcacaatgccaacaatataactaaatagctcacaaatagaaaaattaaaatcaacaaagaagcctcatctggcaagttgaaagtgcaaaagaaaatcaaagaaagggtgaatcaacatcttcatcaagtgagagtgaaaatgatgatgaacaatttcaagagcttggtgatgttgctctatttgtaaaaaagatattataaggggttcaaaaataaaggatatagagttgtaaagagaatgtttctcaataaaaaaagagaacttataattgtggaaacatcaaccaattcatagcaatgtgcccccatgagaaggacaacaatcagaacaaaaagggaaggaagaagatgccatgagctaaatagaagaattgaagccatgccaaacaccattataaatttaatgtaaaaaatattatagaattgacaatagtcatttaaattgttttcaacaaatgttttaaaattggttttagctttacgaaagaagctgcttcaaagcagctccaccaaagaagttgcatctccaaagaaaccagttcattgtcgagccaactctaattacaaaattaacatcccatgaaaatttaaaatgcacatgtaaacatgtattcaatgacactaaatttctataacatggttcacaaattctgaagatgtttaggtaatcattagaaattgaatacattcttgaatctttggttgtgtgtgcaatatactttgaagttccccaaaaacctataatcatcaaagacaatcttcagagtagtttataatgaagcttctcgcaaacaattctcatcatgaaataatgcctgactttaggttgaagcataataaaaattgacagcacatgtgacattgtctcacatacaaaggcgacacatagccgacaaggctgtctaacaacaaatcgt

SEQ ID NO: 4824 - DNA, 1344 bp, Zea mays
  misc_feature (1)..(100): optimal_loci_87837_G1, chr2:215993442..215994785, Cluster 29
gattccactgatattatatgagggaaccttattgtgaccaatttatgacatattgattggaattgtgttgaaatgttgagatgatgtgtgtggatttagattgagatgcattgagttcttattgtgacaattttatgacatatggattagaattctccatatctaaacttattaggacttgtagattgtaatcctgctaggacttctatcttatagttctactaagactcctatattataaccaattagaatacttgtctcctaggttatataaagaagggcatagcttcttagactggggaactgcaacatattgcatttcataatccaacgcgaggcaatttctttgccaaacttacacttttcagtggcgtggaccaatataaaccgttgtttttgtgttcaccatcgagtttgtcttgtgccaaacctcctaaatcctactccgagtaacaccgtaacgggattgtcggtcatcagacatcgacaataattgtatttgatcatagaagaagtaaaaaattataatttttgatcgactattagccaaatcctaggaaaatttagagcatgaaacatgtatcaatctgtttatgcttaaagtatgtataagatagtgttgtttttaagccctttatattataagctaagggaaattaatggccaaaatatgtttggcttgcctctttttttttctctagtccaatacgtattaccatttttcgaactgaatgaatacatgtcaaaacgctacacagcaatacaatgcatgtgttttttttattagacaccgtagcgtatatgactttccttttcacgagtgcatgcatgtgcttgctttgcgcaatgcatatgcatgtataagacgttgtccgatcgaacgaacgaactagaaaagaaaaaaaagaaaaaaagaactgtctccggtcctttgcatgcgtgtaataagaagctagccaagtttttgaaaaaaaaagagaagaaaataaatgaagtggttagatacagacaaaacattgtgaaaagtgtatgtagaagctagctagtcggcactctttctgatgcccccgacccatatatttcgctgctaatactttgacgtgttccctttggttccattccatgcatagatgcatgcatgagtgactctcacatgcatgagcgaggtgagggtccagcagtgggtctcccctcccctccccggcccggcccctagctcttttgactcctttttcagctgtggtttgaacatataaagcttgggcatgagccagacaaataatccatggcgacgacaaggaccgatcatatcatgcatgcattatccctaccaatgcaattaaa

SEQ ID NO: 4825 - DNA, 1175 bp, Zea mays
  misc_feature (1)..(100): optimal_loci_89386_G1, chr2:223715413..223716587, Cluster 29
gatgggagaaaaggaaatgtaactcaatagttgtagtgttgcgtaggttgtgtagagggttttgaaacatgtgcaggtcatcattttagagactgggaacagagtgatatggtctattcaattttaggagcaaccaaatgagacattttttgaaactgattcaatttgagccaattcaagggagcctaagaaacccttaggaataagatcagaaatgtgcctcaataaaggtaggatagaggtgtaatgataagttaggtttcacaaaatgaagtaaaaccaagtgaagttctttagtagatgatcatgtagcacattgctccaaatatattttctcctctaaaaagaaacatatactaaaaccaaatactgaattaaatcattgaatagcatcatgtcacttgcattagtggtgcatcaagaaataggtcaaagtgggggctgaattatggattagagagtctggagatggctgcgatgcgaatgaacggtgttgtcacggagagggtgcacaaattacaaacatgtttgggttgttgcgtgccaacacatgggggatggcctgattaacctatagcatgctattatgcacatgcatcttataactatgagccttctttccatgactatgctaaaattattgtaggatattaagttctacttaggctgctggattggggatgcaggaccgctaccccagtcctggatcaacccctactttcattgccaccaggcttgttacagtcaataagcgatttaaaggaatttaaatctccaagaacaattcaattaataaaagaaatgaggtgttgaactaggggcacaaatttaaaagtcctatttgtataaccatgctacaggatatgcctttttacttaggtaagaggggtcatatacatcggtaactcttcatttaatacatctagctttatctatggtgatgaggaatgccacatggatgcctagtcaatggtgagtgactaaggttttggcaagctgctaacataattgtgggaggtgcaaccaggatggcaatggaccaaatgagagcaacaagatgttggcaaaccataggaaaaatcagggttgactggataaattttatgtataatgcttattcaaagggtaatagtgtgccatatggtgccccacatcactatagggatagttttaca

SEQ ID NO: 4826 - DNA, 1027 bp, Zea mays
  misc_feature (1)..(100): optimal_loci_92543_G1, chr3:2583385..2584411, Cluster 29
agcccctcgatttttggtacctcgtcttcacatttcctcttatcaaagagtcgcctccgatagcgaaacataaatttaccgtgtcctatcgtggattaacggctcttcctgttgcgtggtttccaatttctttctcctcgtctcaacatagatttttttttatctatttctaaaataacattattatttttataaaattatcacgttggatcgtcccaatactctagcatgatcaatcgtgtcggccaatcactgactagcgaggctatgtccacagatcatgtatataattatataaaacattattttatttatttaaacattagttataaatatattttatatataaatgattttagatagatcgaatatgttataaaacattagttgaatgcagtagcatgtgctctatgtttgggttatttatttatttaaacttttgagttgacacatttatgtttattttaaatttggttagcatttttaagctttagtttattactaagaatatttagttttagtttagttagttttaaaggaccaaaaacaaatatataattaatcggagagggacatcagccgatgacaaaaagactactccaagaacaaagagtgcaatccattcaaaatctgagccaatataaaaaagagacaaagaagtggtataacaagaaaataaactaagggaactatcacctatatgctttgttttaaaaataaaaattcagcaaataccctattggcaagtttcaacaaaaaatgggaacgaccatatcttataacaaaaacaaattgaccatgatcattccacttgagaacacacgagtggcaaaaaaaaaaaacttgacgacacctagaacattgaggtattacgaacatattaacatttggactactacattatagttttcaacttcaaagcgaatataaaaatgagttaacatttgtactattacatcctagttttcaatttcaaagcaaatataaaagagttccactcttcttccacgcgacggagatccttcac

SEQ ID NO: 4827 - DNA, 1131 bp, Zea mays
  misc_feature (1)..(100): optimal_loci_92579_G1, chr3:2642438..2643568, Cluster 29
gtcaacaattcatacaaggtttgcgcaacatctagcttcctacgcaagtagttgtacttttttcaactattttatatctttgtttgtgatgctcatgcagctcaaggaagctatgttattgttctaaataaaactcaatatgggtggtttcaagttcatgcattgttggtgcatgttaaaggatgagatgggggttctgcaaactttgagtccaacaaggacctaagtgacaagcaatgcactcatcaaatgttgccccaagatttcaagacctctaggaagggatagggcaaaaaacaaaaaaaagcaatgttagttcatcatcataaacatagtgcttagaggtgctccggaaaatgtccatggaccatcatgcttacgaagagaggtaagagattaccgaaaaagcaagaagtgacaggcaactccaaattttagagaggaaagagacagcaaaagcggcgagaagtgaaagacaacttcaactcatagagaaacagacaaccgcaacagaggcagatttacctacaagaaatgatgatgaggaatcagcgggaggacaaggaggaaaggtttatgtgttctgatgttgataagattataccatgggtcagggactactacatcaggaaacagaagcaaaccagtgctaaatcagctaacgagggaactccctgaaacgaacacaaagaagtactggtcattgtcgacaatgttgtttagggtcttgataaatgtggtctttcacttggcgaactgagtttaaaagttaattgtgttgtcctggtctttgtttcaatactattgtcatggttgatctagatttggattggttgagaacaagtaatccattcgtttgtttggttgttctattgttggagaacttgaacgcttgattttgcttaagaacttttgaattatttgttgatgtgtgcacaatatttgttgatgagatttactatgtggtgccattgtagttgttgaacgaatgagagttactctgatcatttcttttatcacaactttctttcactccattcaagagacagaaagacacccacaaatctattaactaatgctgtagcagttcgcaaacatgttcaagtgcacaagtatcctggtccgcacgac

SEQ ID NO: 4828 - DNA, 1354 bp, Zea mays
  misc_feature (1)..(100): optimal_loci_93761_G1, chr3:8324807..8326160, Cluster 29
tgggaagattccacggcaatgttgagaatgtgaaattacaacatatttcgaactgcagtgctaggtactatatgttacaaagaggagattgttacataatatcagatagtggatgcaactgcatgaacataaggatcaaatatgaacaacctattaatgaaaaacagaaattgaaggttaatggttctggatggtaacccagattgtgtgtataattcttcctagttgaacaataacttatttcgcagaatatgtgttaactgtcaaagatacaggttacgatattcggatcttgaggttcggagtaactcagagtatgaatacaattctccacaggtgtaccaaacattattcatgccctgttcataagacagacgtcacagaccatatgcatatgggaatgtctcaaattacctccagcacattttttcgtcaacaacgaaaggcagccatagcttgatgaagaaggctgagattgccctagatcagcataacgtgcatcagatgtcttagaaacagattgaaacctagcacgaccacgcttctgtggcttccttgaagcttttggtgaatcattgctttcatgatcactgttacttccatcctgtagttcagaacaggatgtccttgtgagtattttcaataaatgtcatagaaatacataacacgattttaaagtgtaaacaaagactactcaagtagcatatgccactacataagtagacctaccattctgcaaccacatctcaaataatgaatcaatgtctcagcaagtgtcaaatgtttcagaaaccaattgaaatattattgctaataaatgcacatgcaatctgataactgccaagcatttcggtatatctacactgatgaatacctcaacaaaatataattctggatatatttttttctctaacaggcagtagacccgtgtatgagtctttttgtatattaaaggagaaagggtagaacccacacagaacacagccataaacactcaaaccatcagttattcaacacaaacacaactgagattgaatcgaaaataaccatgaactaaaaacctaacgcaagcgcttgacaggttggggatagcggcacagcaccatcgaagacaacagttttgatttctcaaattgtagttctgggtctaagaacttatgcttgatgccaacttagttacaactttcccatggactaataatcaaataatttagtatatcagaaacactctttgacaatgcattttacttgatactcacaaaaaggtaatcaggaaagatattacttgctcaagctttaactttaagagatgcaggttttcgaatgtggtcattcaacgcataaagttctataa

SEQ ID NO: 4829 - DNA, 1074 bp, Zea mays
  misc_feature (1)..(100): optimal_loci_94324_G1, chr3:11228087..11229160, Cluster 29
catttacttgtgcttatttcctaacttttaggcaaagatcctgcctagcatgcaaacttaaaatatgtggtcaataacatgaaaaggataaacacacaaaatttatcaattacttatatataaacaatgtttatcagaaatcacatgaatattcttttgaagaaccaaaaagccatctaacctatatattacaaattaaattgtgtataacatgttacatgtcacatgccttgataccgacattggaatatgtgattcatacatgttgtgtgagatgcaagaccacgtgtataacaggaaacagtgggcaggttgtctgggacttttaggccaatagaaatgtggcgaacttaattaatgcgctaatcatttctctaattcccttatggtgccaggtcaaaggacaagcctgataaagtggtaagagttgtctcactgaatcatcatgttgcgggttcgaaaaaacctctctgtatttagggaaatgcttgtcttggtttatcaccattctctagactccattaataggaatctcgtgcattgaatgtatctttttttattgtgtcaggttccaccggtacaagggcattatcaccttgatcatataacataaataggatgataaaagataggtcagattgaaactgtacttgctgtagtctgacatgggcaggctaatggaacagagaagccatttagcaagaacagtccagatatgactaatataagtacgcagaaggtatatgaagcagatatatctatctgaagcctgacaccgactcatcaatatgccactgcttccctaaggcaaataattgataacttgcagaaattacataagaacagctaaacacaaagctgtaaagaatgcctattgcacaacaactgtgcgtgatatggggacggatgaccatattatcactataagcatacctgatggcaggacatatttcccatgctagcccagcagtttttggtattcaattcatgtttactggatctggacctgagttgactacactgcttacatccgctttatccaaaatttccaatgcaattgtgatttaaggggtt

SEQ ID NO: 4830 - DNA, 1205 bp, Zea mays
  misc_feature (1)..(100): optimal_loci_94618_G1, chr3:12782680..12783884, Cluster 29
tccaatttctgcttcctgtgcacagccatcttcatcatgcttcagttttatgaagtacatagctaccaaggcctcacctgattctggccagagtgacttggaagcaaattattggactcatcaaataaatgcctatctgacagcccttcacagagaaaagcatacattagatgtcaggtcttcaaaaacgacttcaggtcgaggtctttacttgtgctttctgcaagctgcctatccatttatctttatatgaccctcaaacttattgctccatctaatttcctgcagtagccatatcatctctgataagctctgtagcatctgttttggtaatgcatccaaaacttggtacttctgcagcagaatctttggccatgcttggcacatcggacccaagattgggtatgccactttttgtagttatcctcttctacagcaagattctatgcagcagcggtaaattttcagcggaaatctcggtgagcaagttcatgttcctttcatatttgaatgcaaataatgaggaaccaaagcacactaggatgggcttctaataatcaaatctaaactgaaggacactgttaaaaattgatttttaatatcaatactgtggccttgcaaattgagaatccatgtttgtaaaggaaataggatctggatgtaagtttgtagaaggggtcataaactcataataacttatttctatgaacgagaagtagaaaaattgaggactactagtgcatacatacttgtgatggaggaggctctggtgacatgaaagggtacctaggttcagtcccttaccgctgctgggtggcaccacattgttggcagcccttacctccattaggcccagcctcttccccacaaggccataaccacctcctcacattgtatattctaccagccattgtctttaagatgcgcaatagttgttcttgctttcattaaccaccagtggtacaagtggttgagcatgctgaattgtggttccagttatctgatatgtacctaactgcaagtgctaatgctgttttgaattttggaacatgctacatttaactgcaagtgctaatgctgttttgtttttttggaacatgctacatttctgttttgcctcaactgcaaaagcaacacaaacatcgtcatatattgcaaaaagattagagtatatgtcatgtcttttggaagaaaacacggcacca

SEQ ID NO: 4831 - DNA, 1065 bp, Zea mays
  misc_feature (1)..(100): optimal_loci_94752_G1, chr3:13522195..13523259, Cluster 29
gatggtcaggaggtcgtcgcaggcggggatggatcacaggcggaggggaagtacaaatgtggaagggtcaggggcaaggccgagtcatttagttccacctattagttgctgttatctgatttggtccaactaatgatataggtatctagagattcagctaattaactatacatatttagatccaagagaagtagttattagcagataactaatatctgcaccgattcaaacagggcctagttaaacccgtagcttgtacgtccggttgccgtttctttgtccatagatcaactgagagtgagatggcgacctagccacagcttcaatttctctgtcgtgtgtatgttggtgtatagaagtacttttagataatatactgaagcaactaccctatatcgagatagatgagagcatcttgaacgtgtattacttgcatggagtatctcttaaagtttctacaagatatgtcttcgtgtccttcaatacatcatctacatgtatctttttaaaatagatagaggaacgagaggagagtagactttgagtaacacttaaaactcaaaactctaggttttgagaatagaacactactagtaccttatactgcgtttgttgtattgaggacaaaatatgttggagacgattaacctcacaatttctttttagctttttatcgatcattctgttgacctatatgtgagcagcataatttgaagaataattaaaaacgggtcaactcactcgataagcaaattaaagtttggtgtctctcatatgtattctacctatatcacggaaatttaattattctttgcctgccgtccactgttaaccgcgccattgtctaccaagtcactagctgtttgagtctatgtgacacaagaaaattattagacatcgttatcaagagtctgttgacatttgatttgtgtatatatagtatttttatttgattttgcatgatatatatgtttcttcgtgggtcgcatgcaataagaatatgtggggaatgaatggttccttccggacgtgctcatatgcttggtacttcctcctacaaccagt

SEQ ID NO: 4832 - DNA, 1128 bp, Zea mays
  misc_feature (1)..(100): optimal_loci_97232_G1, chr3:27463016..27464143, Cluster 29
atgtgaaggtaataccagtgagccgacactctgcatcaccagtcgaaaataatgcagcgcttgcagatagaaaaaaggtccaaagtgatggtttttctagaatcgcaagaattttataggaattcaattcaattttacgacgtggacaagacatggcgctggcgccgtagcctccgaccaaaagacgcagcggaagcagatcgaaagcgctcctgtgccctgtcccgccggctggcctggcatacgaccaccggcggtcatctcgtctcggtcgatggcagtggtagcctggtaggggaccggccgcccggcactggcagtggcagcaacaactactggtgtatcatatcatcgaccgattgcccatcccatcccatctgtttccacttgtactcttcctcgaccctcgccatgaatatcggccgccgtggtcgcgtggatcgatcacaggtcatctgtcatcaggcagagcatcagctagctgggacataccatgtactgcgagtctgctggaccatgcatggtctgtgagcatgcacagaaagcacaggagacctagagctagaggcagcccagctaccgcctaccgatcgatcttctccatcggcttgagctcacgcacacgctctactccatcatccaaacaaacgcaatgcaacgatgcaagcgcggccggggccgccagagctgcagccgcgatgcagtgctataagagacaacttcttcttcgacactagtaaagtttctggttttttattggttcttaaaatattaatattctctacttgacgttgaatgtaaatttagttttctatacaacactactctaacctaatggtgttaattttttatatgagaaaacagttttacagttgttaaataaatatctgaataattatttatatataaatacttgtaatattttttataaatattcatacatcagtattatcataataccattaatttttctttcccataaataattctttagatatttattcaacaagggtataagaactacgttagtgttatatagaaaatcaaatttatatttagtatagaacataaaagatttataccccacttagatgtagatattgatgcacgaaattggaattggaataa

SEQ ID NO: 4833 - DNA, 1345 bp, Zea mays
  misc_feature (1)..(100): optimal_loci_97235_G1, chr3:27465834..27467178, Cluster 29
tatgggtatctatatggcgctcctcaatatggacatatggtgctcctccatacaatgcttcatacggtgctcctcctatgttccttcccccatttggtgctccttccccacatagtgctcctccttcatataatgctcgaccttcatttcatcttccagttgacacggtagtgctcttaagaagcaatagtgatggctcttcgaactagcctgcttacttcggtgctccttaatttcaataatgaagggactattgaagatagaggacgaaataatggcaagtacacatgtatttttcttcttcaaattcacatatttttaggtccataatagtttattgagttcataaaatgtttaggcccatgcatggatactacacttagtggacctcattagcaacagtacgaagggatcaaccttatggggccaaatagccaacgcctataactccaccatagaggttccttgccatagtaccttgaagcaactaaaggataggcagtctacgaacaactgaaagatcacctctttaacgacatctacaaccgcttttacgtggcctgatctagtgggcagatgatgctatactatttaaagcaaccaaggagagcttctgcaacaagttcggtgaaacaacttcaaggttgagcatatgtgccacgctcttcgccatcaccctaagtggtgtgcaaggcacagtgatgatgactctagtgatggaagcaaaagatttcgtctgaacatggacctatatgataattatagctccacatcacaagaatgtgtggacgcaccacaccctattgactatgacaaagaaacaactcaatgaaagaaggactcaaccacaagtagcaatgagtccccatccatagagaaaataatgtttgtacaatgcttgccagaggattacacaaactaaactatttgagcaattcaataaattgatggatccctgcttacatggacaaagacacaaaaatgacccacacattggccttaaaagtagacaaagcaactaaaattagatgaggacgaagcgatagaagagatggaagaggaatataagaaaaagtaatagtatattaattatttttgtgaaatatgtgtttttaagttatgtaattttaattgtttctataaattatgtaaattttatttacttcattatataatcgaatacatttatatatatttatatttcgatgaaacaccatgtttcatgtccactaaaagcctgtaatagaaaaagcttcataacatgatgataaaagctatgcactagagcgctacagtagattagtgttgttgacgatgggtagcaacgctaaagtagataaacact

SEQ ID NO: 4834 - DNA, 1295 bp, Zea mays
  misc_feature (1)..(100): optimal_loci_9843_G1, chr1:52338033..52339327, Cluster 29
ccgtccaaaatatatcaaattggcaacccccgtcttatgcaccacctgaggcttcggatcggagcttggatactatactccacaacaaggtgagtctcaaaaaataccaaggatttgtttattctgataaaaaatcatggcatgaaaaacaatttatttatgtcacaatagtaatcgagctaccaatttgacattctataccctccacgtttgtactagttgttttaaaatcaatattgatacaaataccaacaccgactttaatgtgaactccgtgaagagtacattagtatcggttggtgtctctaagctaacacaaaaaatagagacacctttagtatagtgtacacgttctaacaaagaaaaggtactaaaagactatttttcattcttgctagaagttttgggttcccgcctaaattacattaatattggttctaataaagaactagtactaaaaatgaagggtttagaacctgttctttgctagaatctgcaataaagatattttggttcctaccataactttattttcccgtccaaacgtctttagtaccggtttttagttagaatcggttctaaaattcccccctataaattctttccctgagtctttctcatttgtaaccaccagtatcttgagtctgaggacaacgcatgcaacatcgatgcctcgtccggtcgtccctgatccctattatacattattcttatatatctttgctatagagttcgaattttttacacactcgcaaatgagtttgtccatgttttttgtttattgtacataacacttacatcgtttattttctataggaatcatactaacattgatctcgttgaaattgaggagaacttgaatcatgaactaacccttagacaggaaataagaaaatacgtccaactaaccactagcccttagttgaatatatcttttaatttcttgcgctaagggctagttagcactaagagcatcttcattttggtgagagaactctggctagagacgaagaaggaattgtgtcagaaaaaggaagtatggtctaagaagggtggagacgaaagaagaagaaactgagacaaaaatagggtcaaagaaagatttaagataaaaaagaaactttcttgtctatcagtactaaaagtatataatactccctttcgatttaataaagtgtaagaataaaacagaactacatgtacatttaggtatatgtcccattaaaaagaactttttgtacattttaatgtgcatatattaattaaagtaatatccatcaatatcaatttgtatg

SEQ ID NO: 4835 - DNA, 1055 bp, Zea mays
  misc_feature (1)..(100): optimal_loci_98623_G1, chr3:35425481..35426535, Cluster 29
atctgttgatcatgtattcatatagaagaggacgtttttcccccaaatcttgtctacatacaacttcaagttcatttgaatttgttctaattatttataatcttaacccgtcaaacaatccttctattgtcataaatcagaagagcaaatgatttactattaaggtgcagatgtgattgacaaatataccagattaacagtgcacgaactatcatcaagaacagataagactgcatctggtggggtccttggactccatgcaaacagcgatgtttcaacctacaattcacacgagattaaatgtgattgctatgtactcacagccaaacagaaagaagatcacctcttcagcagtccctcctccatggtcaccattcagggtttgaccatgatcacccattaccaaaagcaaagtattctcatgggtaccaccaggtttggatagacttctcaatgtgtcaataacaccctatagaagaaaataagaatggactgtagaacattcagaagattggaaaataaatgtggagagcatagataagataatgctaaatgcctcctaaaaagcacaagaagagaagaatagtatatgcatgagacaactgacctccaggatctgattgtattgctccaacttctggatcatcggggttgagtcaacaccaaatatatgtcctgcatggtcctaaacaaagttgatctcacaagtttccagctaaagataaaaggatgacaaatagcaggtaagtccaaattgaatgcacaataacttaccactccaagaaaatgtgcaataagaacatcccaatcatttttgtgaagagatggaagcaagtgctcaattacaccattatctacctggcatacaaccataattgataattcagtcaaacttaaaagaaagaactaagaggttcatcaaaaaacaagaacaaggatttgattgacagaatctcatactgtgtcaaggtctttaacattaaaggaagggtatgggaatgacttgttgaagtgttcagggtacagttgtatccatgtatcatcccccatcatga

SEQ ID NO: 4836 - DNA, 1275 bp, Zea mays
  misc_feature (1)..(100): optimal_loci_157315_G1, chr4:158710709..158711983, Cluster 30
ggaccctatacactgaagatctgccttgactatggctaaggctgaggcccaccgagcaggggttgctcctaaggctcattggagaggagacagttccacaccacgagtttgatagaacagtctagaacaacccggggccctataggcagctccaaccataagcgcttctagatttagttctcatggacggccgaggtcccttacgggtcatcggatctctaataaggtcctcagtcttattagagaatagcgtggtcgggtcctagctagggcctctccggacttaaggccggcctcctgatgagaagataaatgagttcctgatgggaagcaccagcatatcagagaacataacttattacgatttttttttgtttgtgcgaggagagcttattattttgatggctaggtgtagtcatcaaggtagaaaacgatctttcattagcacgaacaccttactgtaaataataagtagtcgtgtagaaaacatttgaccttcaaaggctgcaacgagtaaattaaaagaaacatgcatgtgcattattcaatgtttcaacgaaaacgtggaacttgatttttattttgcgtgagggagcttaattatttctgttgatgtgtaaacacgttggaaatggggcccccgaaccacacgtcatactttttttaattatttttgtaggttgctatgctgagctagtagctgtttacacggcgtctgttattctgataaggaactatatacaaaaccacacatgcacacgtggtcaaggtagtgactaatctcgcctaataccactgacaaatcatctctacttggttgtctcgacctatagttgctaaaatccatgtggctaaactttagttttctctgagttgacgattaattattacatatactttatacttgaactatagttacctgcatgttgtaaaattatctaaaaattcacgtaggtcaaatgtggaagaagtgccatagaaaacaacagtcccatattgtgcatcggcaatgaataataccacgtgctaccgaacacggtgaggattactggtcgttcgtcccgtgatcaagctggtaggtggtatatatgcagctcttatgaagttgttgagaagattgacgcagtgatctatcgtcaaactgaaacggagacgggcatcactgcaccttggatcgttcgtgcgtttccatttccatttctctgctgcccgcagccagtgtgcagccgtcgtctgcgcaagatagacctggtcatccgctagagcgagccctgt

SEQ ID NO: 4837 - DNA, 1231 bp, Zea mays
  misc_feature (1)..(100): optimal_loci_101003_G1, chr3:49233414..49234644, Cluster 30
cctggagttggattttgaacggctgacaaaccaaacaagcccggcagcgcgaagcaccattttcagctccgactccgagagcgcaggagcaccgagaactcgcggagatctcagactgggatagtaagttggcgtgcttggagaccagcttctcaaggacggaagagcacaggttgcaagctcattcttcagggactagctagaccatggcggcctttgacgccacagcgacgttggtgtttggttccttttcggcaagacgggaggtgtggtcagggtatacaatttcgggaaagacccgacatttcgggaaattcaggaattttaagccaaagttaaacaaatttgaaagttctaaaaataattgctcgaatttttatgtaaaccttttagccatcctacatcataaaaaagatataatgaaaaacaaatagtcttatatatggatcgtaacttacaagatcttccattgtaccaagactgcctagatgtcattctagatgcattctaaaatggtacaccagcatattctacaatatattaaacagtctcaaatattacatatcaccaatataggtgttgaattaatatcaattcatgttcaaaatataactgtccagaatcaacaaaatataaagagaagtagatgcactaaaaggatgtcattgccaaccttagaggcctgcatgaccagcagtagtatcacttccacatcctaacaaagcgctgtaaattcacaatttatatgctatgtaaatatgatatagtgatcaagtacagtagctaaaatgcatgataaatgttatagacatgtacagcagccaacaactaaggttaaattagttcaaggttcaggagctagctaccgttttagagtccactaacactcttgatatgagttggtttcttcttgcacaatcggaataacactaaaagtgcgacggtctgtataagttccaatggctaaggtcaaagccgatagatattaactaattgacgatgacggccaccagaaataaaattaacgtatgacgacttaccctgacagccgtcagaaatagataaaaccgggtataacggatccaagacgtcgtgcgtgtttcataataatgcgcatggacgtctgagagccaaggcgctgccgccagaactcccaccaccgcgcgttctcctctcccatcgccagcccccgctccatgtgctcgcgccgctcctccagcgcgcccgggag

SEQ ID NO: 4838 - DNA, 1099 bp, Zea mays
  misc_feature (1)..(100): optimal_loci_101094_G1, chr3:49568015..49569113, Cluster 30
ttgtttaattttgtcattgtataatccatgtgattgatcctatgattagaatttctacaatctcctaattgagcttctatccttgtgattggtccaataccttgtaacaatgcttgtctaattttgtcattgtataattcatgcatagtgttcttagatggtaaaaatcaagaggatgatgggtatcgatttgtagagcatcacatctatgtgttgtatttaaaaattatgttgtttttgttaaaaaaacgatttctgctcatactttgttgtggtgacgatgcaatgaataaagtgtggaacaacttgttgtatacttaagtacttcttttaatgtgatgtgaacttgttgtgagttgtagtaaacctttctatctatgtgatcctagatgaagtacaaatttagtgatttgagtttattatctaactaatagtagtaatgtaagacttcttagttattagctaaccattttaaggaggagatcttgacaagtgttgtccaagtttgatgtatatggttggtaacattaccattacaaatagcattccactataaaaaaagaaaaactagtaaacctactagtagcaagtataactctatgctcttcagatattaaatgagaattacatttctactaacaacaaagtcccaatctatgtatgcctcatgatcaaaagaacaaacaaaagcaaacattttaaattgatctgcttaaagaagggggcattattaccacaatagatataacctcccatataacaacaatgttggcgttatgtttcccacaccaatgtgttgcatgttggatgacatgcatgagaattaccatcattattatattgtcatagtcttcatccttcaaatcctcattggcaacatcatcgttgtgtcaatgtcattgtggttcaggttgtcattccttagcatcttcagtttcattgccaaagtgtcaagagtttacatgatacatgaagcctcccatcagataatgtgcacttgttgttaataagcttttggagcatgacctttcacacacactaaagttagtgagagaaactttatctttggtccctttacttgacattttagtagaaaaaa

SEQ ID NO: 4839 - DNA, 1047 bp, Zea mays
  misc_feature (1)..(100): optimal_loci_108231_G1, chr3:98463023..98464069, Cluster 30
tttgatcttgtttcagggttagccaaatgatcttcggtgccacagttttgtcatcacatatgactcgagaagcaacagccttgtcactactgtgggaccaagagacacttgactccatggagacaaacgagagtaggttagacgtgcacgactcatctcatttgagaaaagacaaagaagccctcgacaagttccatagactgtgtataggaagccaaggtaggtgtgtataccacatggagttatatgttgccatgactttataaataggtccacatcgcccatgcaggaaaaacaagttactctcaatcccctcggaacactcctcctctaaagaatcttaagagtaaataccttctggcaacactcaatatctcagaggtaatgatgtaatatcttgtaatggggagaacaatgaaaaggaacaatgagcacatcttatgattcaccttccttccttacatttttctctttggttgttcgtgtttgcttagccttctccgtgtggttcttcatctcttcatgtgtggaaatagggagaaggtataatgaacttaatcgtgttgcccttttttggtttcatataggaatctaaataggtgactaacaaggatctttagtaccgtttgatgttttcaactagtactaaatatttaagattttgtagaaccagtactaaatgtgtcggtaccggttcttgtatgaaacaagtactaaattacataatattagtaccaattagggacatcaaccggtactaatatcttttgtatggatatttagatttaaaccggcatgaagccggtctcaataccgattgctttagtctcaataacggttttaaatcaatcggaacaaaagttattggacagaaaccttattctcgagttgtggagatctatgtcatttcttaatccttcacaatggatgcaagtttcatgtttttataactcttagtgtacgataaattagaatatgaaaattgatatactggcagagtaaatcatgaagtaaattgatttgagaatttttgtgacttttagtagt

SEQ ID NO: 4840 - DNA, 1114 bp, Zea mays
  misc_feature (1)..(100): optimal_loci_10919_G1, chr1:58722074..58723187, Cluster 30
catactatagacacatttaaagctcccatctattttgtggcgcttatcagatggtagacacatcatagaacacacaggttcataggtggcatacacaaatctcgcataacgtagaacacatatctcttttcacctaattggcttcaaacttatcacaataaaaaaataataattatttatcacaatagggatcacatacatcacaatagtacctttgttcactacacattggctacatatatcaccacatcagctacatactagggtaattcacacagctgatttggagcatgagaataagctagcaaggacaacatgaacatatcgtggcacttcatacagttgatttgtagcatcataataaactccaagttgaataatcttgttcttcatggttgatttggggcataaaacatgccttttatattgatgatctgcaacacaatgagcatggcaatcttctctttaattacctccaagttgattggaatggttagaactttaaattcttgtatgatagcatgtagccataagaggaggcatcatccataaacacataaacatagatactatgtaaaagatagcatcaatgcctcatagctgagacatgggataaacctcatagctgagacatgggataaacttaaaactacattgagaaaaaaacaaaaaacattattgtctatgtttgcagactccattataataagctcaagcactcaattgatccatgtttactgattctagggttatatttcacaaagaaagaatcaaaacataaaaaatgcataggtaaaacatagtctgatgttatcgagagcttcaagcccaatcaatgaactcaagatgctagtacatgttttgctctcattctcaattagaaatctaggataaactgaaaacaatattgaaagataaacacaaaatttataatgaacgaaaataatgcaaacaaatcgattgtattaaactaaaagcagatagctacatagtaattgagaacaaaacatgaagaaattagttgtgccaactaacagaacttctctaacacaatcaacaaaacggaggaagtccttcatgtcatcgtgtagtcttattggttcatcgatcacaa

SEQ ID NO: 4841 - DNA, 1033 bp, Zea mays
  misc_feature (1)..(100): optimal_loci_111678_G1, chr3:122510643..122511675, Cluster 30
tcacatctacacactcgattgaagactccaatatgtccatattttttgttgggttgcaggttgtcgttgcgtaacaaaattagagtacttaaagtaccaaaagacaaagtttcaagagagagtagagagtagatcgacgatcatataaacctaggcacgagtgcaagccatcacatgacagttagagtggtttgggtcgctatgtggataagaccctgtgtcctcttgctactcatcggttaatgaacataaaggtaaaaaagattacaaactcatacacaagcgagtgtcaagaccttctagctcacccacctcttggttatggcgggggttctaggctaatagtcttaatccacctttatgtttgctttatgtttagggaatatttctacagaatagatccaatcaggcttaaaacagtcccttgggtctaaccaaaatggttctccctaactgttactttgtccctcatgtttatagtacaaggcaagagagaggttacatcagccttagattcccttgactatgctcaactacctcattattatcctattctaggagtcataggtgggtagtcgtggcaaagtatcagagatgtgcatcactaggtggatttcataccattcgatatgatatagttgatagcgagtgcaaccttttgtacttaataatacttcttggtatgttcgtatgcgcacgtgtggctaaaagatcaatgcatgtaccatatagtggtcttgagtactctatagtcaaactcacaacaacaacatatatcacacatttaatatgttgtaccttagacttatcaagctaacgatatcaacttgtcactagggctttagatgcgaggccctgaccttagggttgtatcggcctcgctaggtccagacacaaccttatgtcttgagacaagattacacttagtcgcaccatgtcccttgtctctacagagacattaggccctaaagggttgggggtccggccatcctcatgattcaagaccgaggacctcaatgaccttaggggttgt

SEQ ID NO: 4842 - DNA, 1079 bp, Zea mays
  misc_feature (1)..(100): optimal_loci_112289_G1, chr3:126507172..126508250, Cluster 30
agattaatcgccttgtcagacccctaggttgagctggttgctcgactagaaaacatagctatgtcgaccgaggcccagaattaatttaggtcttgcctctaatttcgtgcttttggggtagcctgttagacatatcccaaatgtacatgtataatatgaacccacatcaaagttgttgacaatacctcccaaacaccgcatcgtttcaccaactgtcattagagaaggattaagtggttccttgatcaattgattgtccaacccatattgacgggcattgcgtcaacatcaaccccacattattgttcattgactttaataccatctaaggacctcctatatccattctccactaaaacctcaggcaatgtcacatttgactattgaactaccattttgtagcatggcaaatagccctcattgcgcaagggcatcaacacatagtgtgaccttctcttcccactatcaaacctcctcgtcaatgtgaaatcttgccatcaaatatttacattacccacaaacaaaacccaatgaagctaggtgggatatcaaacattttaagttcatcttctatattgtcaaacacccaatcttctacctacaataactagtcaaactaacaataccaatctaatttaactaacaatataagcaatctaactcaatatactaatgtaatctaactatctgactaatttagctaaatcaataaatcaattgtacctacaaattctaactcactaactatcattaacttaaaaatgatcattgaaataacaattgcaaaaagaaagtaccttgctaaagaagtggtaatctttggggatcatattaacaatacaacgactaagcaaaggaataaggatgtatctgtttagagtctacaaagaggtagtactcggaagggagcaatagagtgaggtgccgcgattgaggcaaagggagggagggagggaaagggaggaggcatatgggcgagcaagggtcccgcgagacaggagtgggcgacaacataggtggatgaaggagagaggaggccatcatgcagctttgtatcccctgtgccacgccaggtagga

SEQ ID NO: 4843 - DNA, 1063 bp, Zea mays
  misc_feature (1)..(100): optimal_loci_112470_G1, chr3:127299319..127300381, Cluster 30
aaaatcaagttcacactaccaagaaaaaataaacccgaaaactacaatgagatgacacatcacttatgttagtggtgtacaggagacagataaaatgcatggcacatgtttctggcagatccacttatcagaaggaaaggtgttcccagttgcaaggggcagaacaggttcgaattcgtatccttgttttcaaataaaagatatatgagatgtgagaaacataaccttttatttttctgaaggatacattatcaaacttgtacagtgtcatatttttccatttttctttgaaaaaaaggaaatacttcatggttcttgcaaaaatgcttctttggcattttgcatatgcagggtactgagcacttgctcttaaccactcaagttgaatattacaaaatcaaactacaggtattaactagcaaatatcagctagattgtgacatgtatcaagaatagacatattaaacagttatactcctcttaaaatttacaaatatcaactattactctgcttttaaatatataatgtttaggacaagctaaatagttcaaaaatgaattgattatcttgttgtataaatgacatatatttaaaaaggagtacaaatgtataaaaaaaataaggcagatgattatgggtgaccctgatcactatatcatatcaacatgatattccattatcaacttgcttaccaatcaaggagttccagtaacatgtcagcaaaaatctaaatcagtttgaagtcaccgggcttcaaataggagggggcttagctataggagtgcagggtagagaatccaaaataacttcaggagtcaggacaaacacaccaggaccgaaactcctgatgacttcgtatgttaaaacgctgggaacaaaaacagatatgtaaagccttcaagttgaaatctaagtagtttcctggagctggtaagagcaaaatacggagattatataagcacagaatttgacactcttaattgttgcaggtgaaaattaatagtgagccatagccaacaacccatgttgtctgttgtcacttgtcagaagcactttagatga

SEQ ID NO: 4844 - DNA, 1325 bp, Zea mays
  misc_feature (1)..(100): optimal_loci_11276_G1, chr1:60873275..60874599, Cluster 30
gaagatgacacatggttctttgttagcctaagaggccctcgatgcctatccaaaggtcttgcatcgtctattcagattctatggcaaaatcgaggatgtcataattatgctcaagtagatccaactatgcacattgaggccatatgggatcataaccgtgaagggaaaggctatcgatatgatggagaagcctgaatttggtgcacatggataagaatgataaccacttgtagtagttgggatattggaactccaagatgatcagttcatgtgtcttgccattgacaagtgcctgttattggtgggggcacctctgtgccattgtcaagctcttaaggtggtcatgtcaaagtccacatagttggtgcccaagatgtcatagtttgtgcccaagatgacattatagtagattaggtagggaggaagcataaggatttagatggctagaaggggtgaatagtctatagaaatttctctacaatttataaatcaccagagcaaagtggttaatgtaaaaggtggtcctaatagacactacatgcacttactatagttcattttaaggaagccccctacacaagtctagtagcaggttgattctatcctaatcacttcaatacacaaagctactagctacacaactacacaagatagcaactagcaactagttacaactaagaacaattaactacagtagtgctactactaacacgagataccattagtcaactacacaagcaacatgcgctacactagtaataatatgaatgaaatacaagactagcaattttatagaactgagcaagagagatggcacaatcatcttttcttccatgatttggctacttgccgacaattaatccccattgcggtgagtcttatagtgaatgattcatgcactcactagcatatcaagttagactcacaacttgggtatcgcaagaatcaagcccacaagccgtccttctagccatgagcaatttactacaatgtccattcacactctgcaagatgggatcaagaacctttcacaatcaacttgatcgaaggaaaaacaatcaccatttcccttacgaatcatcgaagctccaatcatatagatggatgcaaccacctagagtaacaagaatgcccaagcttcaacaatcactagtgccaccaatatgtaatcaaccaatgcaatcatctagtaatgattcaatctctctcaaatgtgtttgtaagtgaacaagagtgggaggcttttctcacctctagagagatgagggagatgaaacaagtggccaagatagttcccaatctagtgcaaacatctagttttggtg

SEQ ID NO: 4845 - DNA, 1051 bp, Zea mays
  misc_feature (1)..(100): optimal_loci_112804_G1, chr3:129291536..129292586, Cluster 30
aacatggcatggatgattgacgccggcgcaatttgtggttttggagacagaggtgtgaggtcattttcggatatttcacgttctattactagtaccagtcacaattatctatactagatttagaattaacaactaaaaaatggtccacccattacgtaagaggcccaaatccggccattcaagcatggaatatccagagaggtgcttgcagcggccatttctttcacacaatcgtaagctccatccaacctgatctgctcacctggtggattaggaaacgttttttttttttgggggttagattagagtaacccactctctgatgtgtgacaggtctcccccagggacgacgtacgtggggcccatgccggcgaaagagctttcatgcctatgctctccccgtatcattcccccgccgatgccagattccagcttcgaagaaatctgtctaattatactgcgtacatagctagtttgacaactttattttaaacttttttttagaaaaatagaaatccctttaaaagataagcttgacaaactaactctaaatacttcttgtgtacgtaatgaagccactaatatacgtagctaatgctaataacttcttgtacgaaatgtaaacgtgtgctcctttgatcctagaaggaatacaattctagcttgcaactcgtagtcaatctattctcatcaatgaatatgtccatttagtataacttttcaggattataattattgatgctgttttttgaagaagaaaaaaaaacagtgaaacttaaaatactgtgactccgacggaatcttgaaatgcattctctctctctctttttggcaatgatgggagtaactatattagttctagcaatgcatgaggggaaaatgtaaaaggtctctaaatactacgctaccttcttccaaaaagggtgtaattttggaccaactttaactaggtgtatatatagaaaatggtttcaatatttaatctccaataggtttattaagaagttgtttttttatttaaatctaattatctattacgtatgatagatat

SEQ ID NO: 4846 - DNA, 1357 bp, Zea mays
  misc_feature (1)..(100): optimal_loci_114856_G1, chr3:141446391..141447747, Cluster 30
ctcttctattcaatgtataaggactacccatttcgagtttggttgagtttgttatccaaagggcaactagaagggaataaaacttatattttctttagaattttgattatgatgcagaaaaatatacttgtagagaatcttgagacacgattgtcctaagagggaggcttgtcacaacccaatcatgattagaacattttcatcaatatcatgagcatcatttgcaaatcaatttcatttttgaaacatgcatatgcacaaatctgcaccttttggacattgtcatgtccctccaaacagtacaatgcatactcgaatagttcctgagaacatggctacagacttagcagtttttcacaaacgcgatgttcctatggatagattggtgtccgtctgaacaatccactagatcataacatgaacaaaagtgagtttcccacatttagacacctctagccaatgagtcaccaacaacacactcccttgctatctcacactcactctcatcgccactctctctaatttatccctctcactctctataaaacacccaagggcatgaagaggaggaagggaggatcaagggtagatgccagcaatatgaccatggggatgaagatttaaggaggcgataagtgttgaggattggagagggaagagccctctctccctggttagaagaaaatagaagggatttcaaggagaggtggatccaacttctttcacttaccaagaaacttagcaacaagttctcgaccctttggtaagttgattttgagcataacttctagatgcatagaatatcaaagctagatgttcatcatctagaaaacggatccactgaacttttttttgcatcagaagcaatgtagctagattcagctagatagatatgctctataaaaccttagacccataacacaatttgcacatgcataaaccctggagttgaattccattattgtaaaacacatcaattatgttctcgcggactatttggagggacaccaaatagttcatgataacactcactctacacaaacacttagcccacaaaacacatgttctcatggattgtctagagaagcaccaaacaccatgacaaaattcaatttttaatcccaaggctacctaatttgcacttacttgcttatgcactctagaagaacaccagatagtccaaaaatcacaaacttagaaattttaaaaatgttcatgtggacaattatagccacatagtccatgatcccatggacttctagctagtgatcactcagatggcactcaagaacatttataacatatgtttagctatgcttcaacacatatgttacatataattgtagcacatatgtta

SEQ ID NO: 4847 - DNA, 1033 bp, Zea mays
  misc_feature (1)..(100): optimal_loci_118636_G1, chr3:164964057..164965089, Cluster 30
gggttcacacaaccaccaaaccgatgtcagattcccacccaagctagacccgacctacttaacatcacaaggggttggctttatttgttccatgggccccaggatatgaggtttaataagtttgaagagcttagcatagaaaggtcccaaagtagttttgcctcaaactctaggggtcttatgggcctagtaactaagagtagggcaatgtaggttttgggccccctataatgccatggaccctgaattgatctttcccttggctcgatgttgttctagggccaagtggtggtatcatagtcataaacaatacccttggcgccataagggtcctaagcacattttgtcaaatcccccctcaagttctatcactattgggatatggggcccttgatagtgcaagaagctcgcataggactcgcatggcccttaggacaccgatagcatcaaggcccctaagagggcaatatgctgcataagtagaagtataggttattcctacatgcaatcttagagaaagcaataaaaattaccttatcatcggccacccttacactatacgtatctataagttttttatgctactcttagaacctctttaaggcccagctgatgacttagaatggtggtgtcacaagagcaagcccatgtgtgatggagcaaaggaagggcagaccgggccgagaagagtgacccaccatagtagagcaaatctatagcatgatttgactattgttggggtactgccttcaggcatatttatcattccatttagcacagggacatgctgctagaaaccaacccatcctagcttgtgcaaagatgcaatgactttgttatacaagagatcaaaagggttgcattttaatctaagagttggacccccaaaaggtatggtaaaacaattaaggaaattgtttcataagtagagagtacttgaaccatgattggctatttatgagtatgccacctcctgcttgttgagctagtgtgctagcaccttgggggccaaagaaggagttacatgaggata

SEQ ID NO: 4848 - DNA, 1035 bp, Zea mays
  misc_feature (1)..(100): optimal_loci_118819_G1, chr3:166096609..166097643, Cluster 30
aactcttgcctattgtccccacctaatgggagcatacctaacatcttggtcctggccatctttaaactaatctatattgaaagaactaatcaactaaccagactcccctaactcatagaacctatcaaggcttgacctcggttcatactcataggcttggccctaaggtcaactaacactaacatatttcacgatagaattgaaagagcatgtaagcaacatatcattggtggtaggtaagaaacaaagcaggtggataaggactgaactaaacgagctttgctatctatgaattgataaaagatttgtcaggagtaaaatagaagagtcacgaggtcgaaagcataaaatgaaggtatatgacagatgagagtgagcaagtgtgattaggagtcaatttgttgaacgtcgattgagcacaaacctcaatgggaggaacaatgggtactctctgagagccaactctgaatgagtcattttggtgaaaggggatatcaaactacaacacaagtactagtatggttctagatggcacaaaaatgatgagtagcaaggagctatgagtttggaaaccctaggaggtgtggaaattttgaagtttagggcttgaagcatagcactaaagggaggaagtagggttatatagtggacgacatggatgtaggtgctggggcttgggcatagggagcgcacatagagcgatgggttatggatggcaaagaacttagctatgaggaagcagatggaagatcacatgcacatgatgtattgaaagcagcctatgtgtgggtgtggtggtgcttgatagtgtgatgaggagcgtgtggcaacatggagcaggggcatggtatgttggtgtgttggcatggttgagcgattatgaggggcgcacaacatggagagaacaaagcgatgaacatgcaatgaaggagctagctcaacgggtgaggtggttgaggagaaagatacacatattgtcgtgaattgaaagaaataagcccatgatccatgtcatagacatgtttattgtgctcc

SEQ ID NO: 4849 - DNA, 1108 bp, Zea mays
  misc_feature (1)..(100): optimal_loci_119177_G1, chr3:168441109..168442216, Cluster 30
gaacacaacatgttgcctgaacaaagagacaaaacaaaaaacaattttacaaaggatctccgctaaacagcaggatcctcagtaccggagatcgttttagttattttcaattgatgagaacgattgcctccagaactcaccacacaattcatttagcagcaacctgtcaaacgtttcttcggctgccatatcctttcttcctcttctaaagccctctcgagtctcgaaatactccctattgacgaagaagtgttctctgaagatgaagtgttgctaatctgaaatactgcagtcgatattcagataagggcggaaggttaccaggttgtgaggtgtaatagtaggagattgtaataatccagctagacgagtgtatgggccagctcattcgggtggctataaatatgtaaactgataatggcagaaagggattttttgctggagagaaacataagcgaaatagaacgagcaatgaacctgtgcttacctattgttcttgttcttgaacgctgcgtcttcgtcaggcgacagacaccgactcacgccacgcggtggctcattgtcggcaaagggacgttgcatccgccttccattggccgccgccaccgcatcctcgcgcgtggcaccaacaccacgagtctgcaatccgccgtcgctaggccgaacacctgtttgatctcagtacctatgtctttacaatatagccagacgttttttttaattagatttttgttacattagttaagatattattttatatataatttttaggattcatgtaactgtagtagtagaatacactcatcaactctataggatgcagagtgaacaacctttgaagacaccgagtcaaactttagattaatcacaacatataccctagctaaatagaaattatacagcttaatggtatactaacaattacaataacagtataacacttgcaatatagacacttttattatatcacaacttaattagccaagagttcaaatatttcattgtaatctacatatgtttaactctacgcgacggaatggtatgtgtgttgtgatgatatatcatggcaagcggtggcatcttttttatatagacacacatgatcaat

SEQ ID NO: 4850 - DNA, 1243 bp, Zea mays
  misc_feature (1)..(100): optimal_loci_120380_G1, chr3:175969663..175970905, Cluster 30
aacataagagtaactatcttgatcggtgggggaaacttctatataatcaagcttctcgtgcaatcatcgtgcaatgaaaccatgaaaagtcataaaaatctttaaaatattatatgtacttcgttaaataccaaaattaaagtcttaattaatcctatattaagatatatgaaaaagagaaaatgtttcgttttaaaccctatgtattggctagaattttttgtttttatatcttttaacacaaaatgaattagatattagaatttaatatattgatagagtaaataatcaactatatttataatggttttaataattttcatattttttagtagtttaattatacatcgactacacgagaagcttatatgttttaatttattggtcgttttggtagttctagatacgtaacttttattttatatatagacatgtcatatatctaggtgtgtaacgagaaagtaacctatctaaaaaataaataaaaaatataattcagaatagacagggacgatactgtctaaagtactatgtcctcgagattaagaacacatactacacaagaagaacaaggcgtaattatatttaaataggggtataaagcttttgcagttatcgatagaagacctcgggaaataaaatggtactaatgggtaaggagaatgctagaaagaatttagttgaccaaggcagatcgggaccaacgctggctgatcatactgcactgcagtacccgtgcgcggaatattttacagagggtcaacgcctcctctcacgacggatagcgtaggagctagagctctgcgtgcatgcgtccggtccgcctcccattgcattttatgcttgccatccactgctgtcccgagctgagattgtaatgatcgatcaaccttgggacctaacctctgaatcgatctcctctacaaaaaccgggctggggggcacgcacatgggtttggattctcgagagagatcagggacgaacaagcctggtggcccatgatccaagaagcgatggctgcaatactcatggcgaccagccgatcaatagcgccagatacctcccactcacagtaatcgatcgatcctgtcctcaccctctgtgaaagaaaaaaaactattttgtactctcaaaacagttttttctcccttaacataactccaataccagaaatagctcccgcatcatctttcaaaactgctcacttagtacatgtttgggaacaaggggaatatacttaac

SEQ ID NO: 4851 - DNA, 1240 bp, Zea mays
  misc_feature (1)..(100): optimal_loci_120772_G1, chr3:178264201..178265440, Cluster 30
tttattgaaaacactttaaaaaatgctaatgctctaatatgtttggaaaaacttttgagttagatcgcttggaaggagatttgaaaaaaaccattagtgcagaatttcagagtgtgtcggatgtgtccggtgagttatagaacacgacactagatatgagagggatatagaggtctcaactctcaagtgttcacgagagatcccttcaattgtgagtgtctctcaacattcactaagggtgctcccaaaggtatggagttgtgggtgttcacgtgagacgatgcatgggagataataaaaactttgcttgcttccaagaacttcacccaaaccttataaacaccagcacttgcaaaaggagatctcaaaacaagaacaccacaaccaattatggtttgaagccttaagtaagttcttgatgtagatatgaatatagcaagatactcggaacgtaatctggataaaagaaagttcggaagagggaaaataaagaacttctctaaatattgtagtagtgtcactctcctcacaggtaatgatgtgacccgacaatatcgctccctggtataatgtcgtggcccaatagtgtcgctcctactacatggcagtgtcgctcgaacttaccttcacatatttagatgaaactttgaggctgcctttataaggatgatttcaaggtgttttaaaagtatgaacatagagagatcaaactgaagaatcagatcaaaaaatttaaacccaaaatgggattttctcaaaatggttcacaagaatggaaaactatgttcctgataaataagcccataccatcttatggcattgattttagaaggctttccacatctctatccatgtcaaatgctctcacaaactcatattcaagaaattgatcaaaaactcaaatcaaaagagttcaagcaaggagtccaaatcaataatgagagcagcctgatttgcaaacgggtgatattagaaaaccaccatggttatggccacacttcttgaattcaaaaacatagatgaaaaatatttcactaaaacatatatggatctccctaacgaaggatgatagaaaaactaagtgcaaaaccttaaaactagagatattattggttgggacagtcctcttatttatagaaaactttttacattctcaaactacacctagatatttagagctaaacctagccgggtcttaatggtctaactccttgtacgatgatttgacgaccacactccc

SEQ ID NO: 4852 - DNA, 1011 bp, Zea mays
  misc_feature (1)..(100): optimal_loci_120843_G1, chr3:178559442..178560452, Cluster 30
ctccaaccagtctgtgtactctagtggataacaattttcaacagtgatgggactggactaaggtggaggatgaaatacttgtaagtatacatatagctttatgagttccacaccttttaaagtggagaatagtttttaagttcataaatttataggtacatatgtggttaatgcacaccgttgagcccattgagggcactgacaaaaaaggattgaccttttagggtcaaatagcagtcacatacaactccatcactgaacttcctcaccaccatattgccaagaaattcaaggaccgatggtccatgagaaactgaaaggtcaacctcttcaatggtatctacaaccgcttgtctgtggcttggccgagttgatcatatgatgttatgctgcttgaagtggttgcaacaatagaatcaaactgtcttgccctattagctacgatagggcaagactgcaatgcaagggtaaggggtgcatcaatgaattagcagagagtcccatgccgagaagaaagcatggcaaataagattcgcaaggccaagaagagataagccaatcaaaattgtacaagcacttcaccaagttgttggatcaatccactatcaaaatggatgatgacatgaatagactccacaagttgaccataaaaattgatcacaccattgaaactagacaagtaagaaaatgagaaagagggagagatgactacgacaatgattagttttattttttacaaactatgtaattttaattttttatgtttgtcacgttttatttactttatctgaattatgatttttttgttaaagtatgcactctatttttcgtagataaagtatcatgtttcgttttaaataagagtttgtaaaagaaaagttgatatgatgctgaggtgattgtaagctagcgataaatgctatatagagtgctatagtagttaagcactaacaacggtcaatagcatggacgatgatagtgatagtcgatcaatagcaaatgtgacagaca

SEQ ID NO: 4853 - DNA, 1007 bp, Zea mays
  misc_feature (1)..(100): optimal_loci_120847_G1, chr3:178567899..178568905, Cluster 30
gaagtgggcatagactttagagaactcattgagagcatatggtgtatatatgtcttagtctacaatcaacccacatccacgttctcaagctcttaggcatagaaacagatatatctcagagggacaactgaggagagtaggaacaaaatgaggctattcatcaggttcaccagtttgagttttagtcatcaggttcaccaatttgagtttgagtagatctttgagcactagtataagacaattacttatgacaaaggactacaagtttccaccacctatacctctagcaccaccacagagaccacatgacctagaggcaagtagttctagtatagcacccccacatttggtacattcttctactgaccagatgaatgtctcacttgaacacatgatagcacaatagcaacagacaacagtcgagtagaagagacttctagctgagtagtagaggatactagcctaggagttatgtagagaggaagagaataggaaggagagacattagtctaaggctcaacagcgtcaaaccaataggatgctcaccctgtttgaccattcgagctcggtaagatcagttttagtagcaactgctagcagatatggaaagaaattgtctattttaagcacattctgtactagataaaattgtttgtcctgtcccatctagcttgtaaggtagctcctttagccctttatacactagtgaccctataaagacagttcgacacatttcagagctagggtctttactagttagtctcactaattcaccctacgacacttgaattctcttcatcaagatagtgtgcgactttggaacatgtgggagtgtcaaagactatcacttccttagcactttcgacattgtcagacatagttgcaactcaactgtaccattcactcaaatggcttatgcttctcttagtatcttcagatagctcatgtgtctcccattctagcagctcctctgatagcaccggtgagatcctatcactctcagtggc

SEQ ID NO: 4854 - DNA, 1127 bp, Zea mays
  misc_feature (1)..(100): optimal_loci_126886_G1, chr3:209803507..209804633, Cluster 30
tctttggcattaggtaagttttctgaaagccaaaaccagcactggccccatgtcaccagggatggcattcatttttaaacatttagcaacacattcccacaacactcttgcaataggacaagtaaaaaaacaagtgattaatcgactcaggtagaggacaaaaatggtaggacatatccccaacccactttcttctaagcatattatccttgtcaacaataccttattttctagtaacaacataaaaactttgattttggagggattttccctttccatatatgtttcatatatgacccatatgtagcagtagtaataccagttacatagatttgacattaaaattcctcttcttgtcccacttccaataaatcatgttaggggtagcttggaaatcaaactctttgagtttctcaaagatgaaatcccattttgttctgtcatcaccatatagccaccttctgaattcaatctacatgcctctttctaacacaactttcactaaaatttctttatcattacaaatctcatacaagtcaggttcagaaacacataaaggttctttaaaaagccaacaatcttcccaaaatctgatttaacctcttgattttgtgacaatctatcttcctttgatattgcacttccttattttcaacaaatcactccaaacccaagaatcagatatcttgggacaaacattgtgaacacatttgccatgaagatatttttatagatgatttcctgccacattccattttcggtttccaattttccaccataacttgcataacagactcatgttcagcaactttaagtctttaataccaagcccacctttcttttttcaatgcaaacccgctcccacctgatcagatggtattttttcctatttccacctcctttccataggaaggattttcttttgatatcaagtcttttaactattgttttgggtaacagatacatagacatatggtgtatgggggttagataaacaagaatttatcaaagttattctctcaatcatagaaagggaactgcccttccacccttccaatcttttagcaaaattttcttcaagtctaacccagtttgcaatataaagtcgactagggctaacatgcacc

SEQ ID NO: 4855 - DNA, 1126 bp, Zea mays
  misc_feature (1)..(100): optimal_loci_127097_G1, chr3:210974803..210975928, Cluster 30
aggagaagagatagataccacatgccgtctcataccatagtttttcctccgtcgtcccatgtcaccccagtctttatttctagattgagaggtgatgcgacatggctacggcttcaattcaactccctgcagcttcatccaacataccacactttaccgatcgagatttctatgcactcgtcgtcttggcctttccgatcccaaggcagaagctccgatccacgtctagctaccatatactatctgctggtgtatgtatagctagttagtaagctttgatcggtccgggtttttcattcatccatttgttatatactgtcaacatacgtacggttgcataaagaggtcatgcgctattctgctagtactccataattacttgaatcgaatcaggccataattaatagcgtcactacatcatgcgtttttcatactagtacgtcgtactgtatacatttacgcggggcgggggggggggggggggggggtcctatgtataccagatcacgcgacgacgactacatatagcaactataccagtatagtggtggtggggtaccagatcgtgtgctacgtacggttggtgttgtcgtcggaaacggccaaaagggcgtaccgatggatggacgtacgtggaccagctgatatgagcgacgacgaaatgaatacgtacgaaacaggccgccgtacgtagcagcttgttgcctgctgctcggatcgatcggccggtctacgggtcgcctgcaggctgcagtgagtacgtactagccgcggttagttcatgttgatatgcatgaagcaactaatcctttgtattgtagtcattattacacactaatctgtattgtcattatatatagcaacatcatatgtgtccacttcatatagtcatagacaacacgtaacacccatcgtgtcattcttatttgtacacgcatcatgcttgttactactactatttctctttactttaaattgcacatactaataataaattccacttgaactgaagagagggaaaaagggtgcgtttttaatatattattaatctttaattctttagtgtagcaaccatcgtacatacatatattctttatgatgataaaaattaatttatctaattata

SEQ ID NO: 4856 - DNA, 1391 bp, Zea mays
  misc_feature (1)..(100): optimal_loci_127455_G1, chr3:212742313..212743703, Cluster 30
ctgaggtacaacttgcaaatgcaccttatgattctagtaattgttttgcatgtcacatgaattctcttgttgatgttgctagttatagcattaagggtttagagcttagggtttatggtttaaagtataacgtcctggtcgcgacacaagatatggatggttagttagttctatcaaaagtaatggataacttagaccaacacatgaacttggttgtggcaggttccacaacgtagacatcttaggcttctagtttcttctttcttttggtatcatatgaatctggaccactaatgatgaccatgatatcctaattatgctatggtaacttgccccaacctcatcatcacagttgtcgttcttatcggtcttgatgttctttggctttggggtctcacaatgaggctcctttagcaccttctaggcaaaatccctaatgtgcaggctatcttgtgttttgtggttgctttggggacggtagatgcatcgcccctccatgatggatttgtacttgttgttgtagtcctcaatggggggcgcattgccctggcattaccgagtcacatgctcaacattgttcactcggtggtcgggcctgtgcttctagcccttgtcctagtctaactttcccttgtcctttgtcgaaggagtcatgcgatgcatcacctcctcgcttagggagtatttgtcaatcacttggaaatggacaaacatggttgtcggggacttctggatcaactcttgggatagttctgtgttctggagacccttgcggaatatgcaaactacagtttcctctggcatgttggatacatcaggcttgacatcttgccattgcttgatataactctgaagagtcacatcctccttttgggtaacctacttaagatcatactatgttttttggttcactagtcatgctgaaattagcgatgaagaggtgttttaattcatcccaagagtagatggtgttgtccaggaggctaaatatccacttttgaatgttggatttgaggcccatgggcaagtaatttgctatgatcgtggaatcccctctagctactatgacaaagaattggtatgcactgagctagtctggtgggttggtacgtccttcatgcacctcgaccagtggtggcttgaaattcttaggccaactgacccaactcagcggcttcgcaaaagctttgaccattgatccacaaggatactgtgtacctgatctgactggacctagggtgaaacatgttagcatgagtcatagtatccgaccttgtagctattatattcgtgtcatgggtgctgtggatgtctttaatgggaaccaatcttatctcgtggaggagtccgatctcggtgaaaggtcagagacggtggtcaagtcctatctt

SEQ ID NO: 4857 - DNA, 1330 bp, Zea mays
  misc_feature (1)..(100): optimal_loci_128678_G1, chr3:218487650..218488979, Cluster 30
cgttaatcccaaacaattaaatagcctcaacattttgagggccgtgtcatacactgttgagcatttttttagcggaataaaaaactagttacgtaatgatgtatacatcctaatgtactattgccatcaagacagttctcaaattgcctcgcgttgctacctcgaatcgacgaatcctcaatagcagcaaataaaattgacattaggatgggcccatgtcacgaccacaagaggatgaattcgataatgaggaaattaaaaacgtgctcagaattattgaacacgcaacgcagcaaaacaattataaatatttatattagtactaaaaaacacttaatgcgcggtggtcttgggtatgacagcgtatcttttttattttaatctttttagaacaattcctaaaaataatactacagtgatttttatttttaaaagccacgcaaatttttatggtgtggctaaacaacactaacacgctaaccagtcaaacgtgacatgtctgctagtatggaagtgattgacgatatgataaatgttgttgtgcattctatctgacgcgatatgtctatcagcatggcaggtcagccaaacgctggtcgataaacgttgttgtgccaccttgtctgacgtggtatggaagattatagagcccctgctcggttctcgccctctctatcttttttctttcttcctctttttcttcttcctccccaaccaacgacattggtctttcctgccacatcgaccaccagctcaagttgttggttccccatgctcctctcgcctaagaggaaagtaatattcttcttatttcttgtttctatggtggatttaaagattagccttgattgctagcgttcgaaggaaaagtatatttggctagagatgtaaagtattttaggtagatcgaatgcattatgaaacttcgattgaatgcgtccgaatgtagttgcatgtgctatatgtttaagtcaattagctataaatttgagttggtgtgtttaagtttaggttacatttggtcaacatatttatattttagtttgatagttataatgcttaggcttaattttagtgtatttagtttgtgagtataggttatatgtctacatgtacattaatttaaaatacttagattgttgtataaagacaaagaaacttgttttttataatcttatatttagatagatggaggacatgtggtgggagaagtggcgaaaacagggccatctgatttatacctgaatgaatcttgcgaggatgaacctataccttttgagctattggtgcctaactatgactgtgatgagccagaccacaatcaaggcat

SEQ ID NO: 4858 - DNA, 1046 bp, Zea mays
  misc_feature (1)..(100): optimal_loci_128772_G1, chr3:219177759..219178804, Cluster 30
ctgtttctgagtacctgtcaaccaacaataaaagataaacaaaaatatgccctcaaataaaaaactaaattagtaacaactgttaatataaaaaatcctaaatatccataaaatatgcacacacacgcacacgtatataccacgtataaatgttactaaactatgcacttctaataacatcaatgcatgaacaactaacttaaagtaaccacgtacaccgcatgtacgttttatctaaaatataatgagatacctacattgatagtatattcctgtactatatgcatggtgtgtgtactatattttttgtagataataataataccacacattattctttgataaaaataatcaacgtctctagaaatgacggaggttagtgagaactgaaaatcaaagatgactataacctcctagtgttggagatttgtttggaataaacaatgattattaagtttaaatattatttcttcaagttagcaccattagcccctcttggatcccacttttaagtctaccaccaatcttgagcaccataccatcgtggtaataaagtacaatgtacaactaagattcttgttttttgacaaagatacaaaagaagggtcttgaattgaagttacattaaccacaagaggcaagaaataataagattagtaaaaaatagagttatgacatcataaagcatgtgctataataagcctaaaaagagccaccatagtttaagttaggtcttcaaccagatgtatactgaagataccatgcagaaggctggaaaacctatgacatcaatggaaaataaacatgcatagcgacatagtataaagttagtaattaataaacttacccttacttattagagattataaagtatgtatatttatatcgtattttgaaactaatataaaatagagtacatggataaatgatctcattaattagttgcaagcaacaaaaatgaacttgtaatggttatgccttttagattacagtccgtgtagtgcagcatcacacgttgattgattagtagctacaagaacaaattg

SEQ ID NO: 4859 - DNA, 1133 bp, Zea mays
  misc_feature (1)..(100): optimal_loci_132051_G1, chr4:3469313..3470445, Cluster 30
ttaagcagagggaacctatctaacctgaactagttagtttattttaacttgtgtgtttggcacatcacatcatataatcgagaaagaaaaaaaaaaacagtagcctgtccaccaacgatgctcgctgcgaggactgaagaggacgtggaaggacaaacactgtcgttggtgctgctggctgctgaggtattaatcatagcacgtacgtacgccacactgacagtcgtagttggtcactcatatcctgtcgcggatcggaggaccatgcacactcacccacgcatcgtcattttctgaggtatcgatccattggacggttaggaggcttcttgtgtaattttcccccccccccccggaaacctagcaataacagtcttgagcgagacactgtaaaacgtgttgtaccatatatgacaagattttggttcctatagcctctaacagtattctctgcgttctctaaatataaaatacattgttcattctctatagacatagactctctaccatctcttttatctattttatattcaggaccgtatcagcaaattctgaagccatatacatattctaaaatggggcctctctcttactagtcaaggtcatcggacatcggtgaacgaaatatcaaaaaactacataatagggcctctcttactagtcaaggtcatcggatgtctgtgaacaaaatatcgcaaaactacatgcagctaggaatgacaatgaaaaattctccatggggaaatggctcctatccttgtctccatcccatatatctattttagattggagagagcataagccgagcctgtttggttgtagtcgtcccatatatatagcactcaccactcagcctagacagcaaccttagcctcatgcctctaatattcatgttttgcctgagcttaaaaccaaacatgcctttacatatcccaagcttctgcgtatagactgcctggatgcgtggactgttaacaagccagaactcacaaaaagcaaagaatatccaaagctacgtataggatgtgtatatatgttttctaaagctataaaattgtagaagtttttttttaattctggctcagaaaagtaaaagaatgtagatttgtttgaccggattgatggagggatta

SEQ ID NO: 4860 - DNA, 1022 bp, Zea mays
  misc_feature (1)..(100): optimal_loci_132651_G1, chr4:5878155..5879176, Cluster 30
aggatggtgagactgtctgctttatgcaacaatgttgtgaagggctctttgaagcagttttgtatgatgtgcgtggttgcatccatgtagcaaagcatgcagcatagaatagagtgaaggtatggttgtattttaggtaagaatattttgtaagttcctagtccatttggttagaggatgattgttttctttttttgttgcgacttctgacttaaagtgtgggtactccctctgaagttgagacattagcattgcaagcagctacattgggcactatcttagctggtggtacttgagtgcataagttggtcgagggctagggttcactaagtggaaatgggtttggggtaggtttgatggtgtaggcaaggattgtgatgccttttggattatagatcttgatgaggtcattgttggtttcaaatttgtaagtagtgtagttggttttgactagtgcccttgttgtgcaagttcccacaacaaagcctctacacgaggtgttggctgtgatgcctttcataatgaattggtcgaatgtttttatttcctaaccttcatgggcacacatgaagtcacatcaccatgttcgtactttactaccttttggtggtgtaaggttcgctcatattataataagaatgatgaatcacaatagttttggagtatattgtagtatttcttggaatattaatgacatgctatttgagatatttttaggtgtggatgtgaggatgttgaagtcagagatgtgagcatcgaggaatctcttaggttctttggatagagagaagctagcaatgaggatgagttgagggtgctaaaactggatcccgttgaatgcaacaatgaggaccaaaggtatatttatcaccgacgagtattggagggggatttgtccattatgtcgcatgagcctagactttgggggcaattgatagttattgatggactcgaggctaatgatttgggaaaagatcttggcaaggcttgcatgattcatgcaagggtttgggatgataaaa

SEQ ID NO: 4861 - DNA, 1357 bp, Zea mays
  misc_feature (1)..(100): optimal_loci_132688_G1, chr4:5992740..5994096, Cluster 30
caatacaacaacaaaaatcctctaattggccatgtttgaatgaaatctttcatttatgccacaaccaaaaaaatgacatgaaaaactatgaattttaagccatgggagaagacaatacctattgttggggatgttgttgctacacgaaccactaccatagcataagttgccaccatagcaccaactcgtcattagagcaagtagccgatgaaagcaatcactgtaggccactggaggaaacctccacaaaaccaacttgaaaccacactacatgaactcccattggaactaggtggttgcatgctagcatggtgaaagggtcatatgaataatcaaagatccaataaaaagataagttcccaattctatgcatacaaaatcttgtagcccaatggtaagccaacttggttctaaactaggtagatgtcgggtttgattcctgtacatggtacacctttagcttttatgacaaagattattatgtgataggtggggcctgaatagtaaaattgtatagttgaccaaattttgaatcatcattctcaaatcatcatgaataaatggatttctagtagtgatagtgaagctccaacataaagcacaccttcataattaggagagacggttggcaactagtgagcattattggtttttgcagcacttatcatagttaatgaaagcctttgtggccagtccaactccatcactagtgaactcttagcgatcgagggagcatatcctttgtggatctcctaaatggatcaagggttgcactttctcaaacgacttaacaagatatagtgtcatttcatgggaatttgtccttccttgcttaagctttacttacctcatttatgcttatgttttcccattacgttttcaagaatagcttaattagtatagtctattggattggtacattttagtggcaattttgtgggggtatgtagagacactagataaactgtttgttactcatggagttagatttttattttatttatgtagtgtgaaatttacttagatctctataggttaaaagccttttaatgatgcaatccatctactccacccttgatgggttaaaataccctcaatatctagatcatttcatgaggctttgttgggagggtcttccttcaattaaggggtcctttggtatggctctagcagcgactcctgctatggctcctttagaagctatacttaacgatagtgtagaaaaaataactttatagtgaagtttttgaggagttggggccattttacactatggaaggtagagtaataatttgtagctttttcagaggagcaggagctagagccctaccaaatagggcttcaatagtagtagaat

SEQ ID NO: 4862 - DNA, 1294 bp, Zea mays
  misc_feature (1)..(100): optimal_loci_13288_G1, chr1:72797659..72798952, Cluster 30
aagaagatttgagtttctaagctagacaaatgaaaaatacactagcaaactatgtcgtggagaaaataaataaattcacaaattaaatagaacattttctctaatcaccaaagcagtgtggaagcacgcccaataatgtaaacatgcatggtacgtacgtagtcaaaaagcgtgtgcgatctctattattatattgttccacacacgcattatttggatcccatgcggaaaaggtagaaccgatctcgacagtttttctcgccacctctgttacgggcgtgcatgctgcatatttttgctgtctccaacagcgatcctctgctatgcatgcagctcatcaaaccatgatgcgagtgacgtgtttgttggcagctgtgtaatcgaccgttgagatgcgcttgtcgacagcagcccttgaacactgtgccggcactgccaccccccacgcctgattgcgatcgttgcttgcaagttgcaactggtgcttcacgacagcagaggagccgatggcgatgaagaagctaaggctacacgaaacttgtggcttctgactagctcattggaagctagcttcttgttcttctatccaatcttttttactctactatatcatctatacgcatgtgtccttttttgtgtgtgtgtgtgtgtagagagagagagtgaaagtgagaacatacttccatatgtataacgggcggccagcatttctgattgctgccatatacagtactctctttatcctgaaacatacttctctaaggcaagccctacgtttttctacaaagtacttataagatatagtcaattaatatactttttaccgaattatattccgagatgaatctacttaattacatcacttttattaggttgagacttgagaatgcttatggtgatggccagggtatatataatcccttgttgactaccccttcccttgtgatcataatgacgactcctagagagcccttttttttccagaccgtaatcgatctggcaaggcatgcacgtcaggactgcactgccctggttattaaggacgatgccaggttgatcaatgaaacatgatagggttatgggagttcatcatcaatggcccccgttgaatggcgcccgggcctggagacagacagcagcaacgcatgatgctggtaccggttcatggcatgccacggcatggcaacagacatggagacacatcctagccgttcccaggtacggagatgcaatccgtgtcgctgaaggctgaagcacatgagacgtctcgtcgttcacacgttaatgtagacgc

SEQ ID NO: 4863 - DNA, 1040 bp, Zea mays
  misc_feature (1)..(100): optimal_loci_133665_G1, chr4:10654326..10655365, Cluster 30
aaatgaaggtgcaatataggatggggaaatagttatggtactcttgtttaatgaacaagattccaatcttaggacccaccatccttaatggatgtgcataatatgcaccatggtattctctctcatagtttttttccataacttgctacttatttacttgcccttgagaggcgagcgtgagcttcttcctgctcatgatgttcactcaagagttgaatatatgtgtcatgagaaggcatccttccttgtgaaccatcatcaaagtgattagaggacctagatgagatccctcatgtagcattttcaccttctttaccaccttcttgaacaagttctcatccagcaaaagagacaaaacaagaataaagcttgcaccacaaaagtagagttagtagttagtacaaagacaatcactcttgtcggtcgtggtcgcctccccaaaccatttttgtgagtagtggcatagagacaattctcctgccactggaattttgccctatttaccatcgtaaatatcctattcacttctattccactcggacggaatttcttacctttcatgctatcaccagtggtgtagaagggtaagaaaactgcacatcctaaactctttgatgccactatcaaagacatgtaagcgcaataaattgcatccaagtggcattaaagggattatgacatttgcgatggcaaataaggtattaggtaaaattgcaatggcactaagagaattgcccctcaattttatttgcttaccaattgtgttcaagttttagaccctatttgatatggcgtagtctctggcttcttgagccatatcaaacgggccatataaaagattgctccttgcaacgagtcttaaggagccgaagcattttttttatataaaaactagttaaaatgtgtttttctcacctccatcataaatttaatacaaaactgtgacttcaacctttttctaaaggtttctttaatctgcttcagctctatcagaatgttgctccacatctttttaggatgagacaaaggcttagcaaatg

SEQ ID NO: 4864 - DNA, 1122 bp, Zea mays
  misc_feature (1)..(100): optimal_loci_138642_G1, chr4:36914148..36915269, Cluster 30
ctgtcgtcgtttgcgatgaagaaaagggtggtgcaccttcctctgtctatgtgaaagaatattggtctcctctgtctatgtgaaaacccacgaagcacactgcatctacaaaagacagccaagtcaaaaatcaggggttgttttgttcctggtgttagttcatctgtagtaatcaagcaaaaaactatgggcaacaatacaaaagctggcacgggcgtgtgcctggtgacgttgccgtctcaagatggctccgaaagaggtgagcgtggctacagatctgagctgcagcttggtaggctgggcgctttcgcctggttggaggcttggagccttggaaggttctcgcgttggacaggtaggctgctggctgggcacacctttgctttgccataccatctctgagaatcctcgtccattattatgcaccccccccccccccccccccctcgcgttgcagccctttctgttcccgaccagaagttattttttttaaaccatgagtcatagacctcgtgatagtcccggagagaaaaccatgctgagtctagcatgacaaatcaagtgtttgaggtgctgagtctagcatgacagaaggggaactactgttgttgttgatgttcttatattactttacgggcttgtttggaagaaggttcaggtcattttcggtagatcctataaaataggggacatagaactgtagataagatattttatactgtttgtaaaagtgaaatttgatggcctaatgaaggggatcgagagaccaaaaattcctttactatttagaccccttccttcattagtcttgcttccaaacatgtgttccggattagctccaaaatgttggatcttgtcacatgcccactagtttcgctttggtgtccaacaaggccacgttcgatgcggccatcgaagaggaagacaatgaaagaatctcaatcaatcactttgtctttttttgtacacgtaattccgaaaaggcactgtaacgagttttgctatataattccccttcgttgcaaaaaaaagaagaaaatgcaacattgcgcaagtagctttcaaggtgaatccacatacatatacttgttttacataaaataattatgattactttggaag

SEQ ID NO: 4865 - DNA, 1118 bp, Zea mays
  misc_feature (1)..(100): optimal_loci_14644_G1, chr1:80769231..80770348, Cluster 30
ggcaacaaaaggctgagtccatgaggcttggtcatctactagaaagttgagtcattaaggttaggccataaactaaacatcctttcaaaagtgccagtgtaccaagtctatgaattgcttcatgataagtacactcaactctaagctaataccagtctcaggtgcaatgaggacaatcatgcagaaaagctaaaaataatcatattacaatatcatacaaggcattcaatgtttaatagtgtttgacacaattacatatcaaaatttttacatgtggtcgtcaacttggtatgatatttcgactgtcgttggttagacttctttcaaaagttcttcaatcttgttgtaatcatagtcggtggcaaacctttcttggaccttagtaagctccatgcctggataacgtgacatggtaatccctaggctaagctacttgcttcttctatgtgagcttggtcaatctcacatattcattctaggaggctctctagtttctgaatgctaaataagtcttacccatactttgtacctacaaccgagtcatcataatctccagtcaggctttatgagttgttaacacttcttgatattccacaaaacaagatagtagttcaatacattggactctacaagagagaaataacaaaagacttactctttttctctgttaggaccgcgtccttagctttattggcccagtcaagcttcttagctaggtcttccatgaacctctttcttgatcgatcttttattttcttgaaggtgaatagagtcttcttgatatcaagaatttgctctttcattttggtcttcttggcttgcacaccctagactacctcaggtgtcatacaactagccttgaagactatagataggacttaaccgtcaataacataagagattgggatttcatatgaaggcttagtcccatactttcaagctagttgtgcaagtcctgaacaatgcaaccataagatattatacttcttctcctgctccaactttagtcgagtggccatcgttcgaatcatcgattcgaaccacttttctcttcctcaactaaggaggacttgaatttctggtggcatgtggagctttaggggcttgctctacaagtt

SEQ ID NO: 4866 - DNA, 1254 bp, Zea mays
  misc_feature (1)..(100): optimal_loci_15153_G1, chr1:83641282..83642535, Cluster 30
cacacgtcatagagggtcactgtaatttttcacgagtgtcaatcatctcatatataggcggatactgtcccaccctgcacacagacgccacaatcattcgtctaatctattacacaaatgaatttaggaagaacagttgtgctctactaatatcaagttgctatgagcactacttttataataagtcaaattcttaaacattaaccaaatttacaggaaattgtacgaaaaactataacagcaagttgcttttattaaattctacatgaaatgactttcataatgcatttgtttgaactttgatatcttatattaaaaaaacaaatagtcaaaatcatagaagcctgacttagataaaactgaaattaataacatatagtttgaagcaaaagaagtgcatagtatggtcctctttatagatctatacatatagaacggtccatactccatatatatattaatattaagataatgacagtctagctagcaaatatatgtcacactactgtccttcttatggtagttaggataaagtaaattaagcttcagtataatcgcctgtctccgttggaagttgcgatttgttggtcaccatacgagcatatatagttaagttcccactttgtaaataagtacacgatcctattatatgtatccattccaaccctaacaaaaaggcagtcgagcggtacccatattgggggaccagtaaacgcaaacctttaatacaatgcattggctccaatcatgaaagatggtagtaattaatatagagaatgcactacatgtatacatcaaatataatcgacagcagagggttccgtgtagctcgaaaaccactcaaaaaacgcgtttccgatagtgacggcatctctagtgttaattactttggtcttctgcgtttagttcttggttcggaaatgcatgccttagactgtagagctctggaggcctggtcttcctaatgtttgccgaattaatatttaccttttttcagttttactaagaccgatgaacatattcacagcaatggtttattaacaatataaggtgagcatatgcatgaataaactgtaaaccaaccatttagctcaagcatttctcctataccattttcttttgcagaacttcctttgttttatactaggattgtaggaaggggagaagctacgtttgtagctgtgggtgcagatgcaaccccagaatacaacatcagtctgttcggttatcctggacaggccctgataaagtttc

SEQ ID NO: 4867 - DNA, 1251 bp, Zea mays
  misc_feature (1)..(100): optimal_loci_1531_G1, chr1:7956846..7958096, Cluster 30
tataactatatatattatacgaaagcaactgtttctagaaaaacaaatagtttgtttttagttttaccggtttgattggttttgtgctttttttagcagaaacattttccagaatttaaaccaaacgtagccataagcatgtactccactcttcatcaaatggaactgcatctaaactatttaagcaggtactcttcaataagatctagagtgggagtatgtcattattaaacccaacttcatcaattggacctgctcttcccctgccttttctaagttatatgctcgccagacagaattcaaacataagatcatttagccactctttatttttttttctgtatacaaagtacacaaagaataaaataaattcaagtggtcacgagacatacacacacacaccagtagtccatcttccatgttgctgaagagagactgagtacgagtatctctgcgtgtattaattacggccagtactgcggtgcagcttccaagctctacaaattgtgtataaatgctccagcttctctccccctctgcctcgttctcaatcatgtcttcctgctacacactgtacgctccattcaattccaaatcgaagttatcagtggatcagcacgaggtccagcgtgctccaacttctttatgctcagaacatgaatgaatacgggctgaatagtatatacatgtacattacattgtcttagctcctgaacctattacacttttgaatattacacaacacaaggtgactgttatcttactgacactgaacttgaaggatatcagaataattttttttatcagcccaatattatatatatccgttgtcattgcccagcaacatcaggctaaaaagagcaaagaaagatgaatcgtgacacaggtcggtgatcgtgctgaatatgggtgagtgagagcaagcatgtagacagtttgagaggtttggaccgcgcagtgtgcgcaatacactgcattttctttctacctatcgattgatcaacacaaaattaaaaatacaagttcaaacaaacacttgtgagcatcaaaacttcatagctccccctcacattatgattgatggtcgtaatccacctttacgtctaccctatgtgaatagtttttttgttgcggagtgtttaatcaggaatgagacagagactaacttgttctccaccctagtttaaaacgttactctagtactctactcatcccttttactccttttacggtgcaagggaggagagatgc

SEQ ID NO: 4868 - DNA, 1155 bp, Zea mays
  misc_feature (1)..(100): optimal_loci_155922_G1, chr4:152072737..152073891, Cluster 30
aaatagtgatacaaatggtgatacaaatctcatataagggtgtcacacataagtacgagaactcttcgaagcctatgtagttgagggctctaggtcgcctttggcaaccccttcgggcagtgttagaagcctaggtcgatcattaaggaagccatgagaaggcatgcctagggaaggcatgatagcagcaaatagcacttgatagtcaacatcaagctatagaagtggcatcaaaggggggttgcaaccttgttgactccaactacaaggcaaacgatgatcggcatcaccatgaggagaaagaccgaagcttagatcgagaaaccctaggagaaaccatttgattgatttgtacaatcattgtccccacttatataagggagggcatgggctcccatagggggcaaggtcaaacaatcaaactagtagacaatcaatcaactcttgaagaagggagattgaacccaatcaaaaccctagagtagcatagtgcttcctcctacatccatttgtctcaatttcaccattgtaaaattcttgagcaatcataacatgaagaacactactattggactaagcgcttaattaaacatctgaaccaatataaaccccttgtgttttgagtgcctaaaccaccagaggtacacatgtcgacccatgtcgaacaacctaattactaccatgattaagaacccacaacacctatcaacatataaatagtgtatgtagggataatacttatgtgctagtagcggaataggaatagtgatgaaccctatttgtgttgtcagtctactaccagttataaagtgctaatgaggttccacacttaggagccgcaaggatacaataagggcacctccaacaattagaattacataccagctctatgtctatggttcatatccatttcaacaacaactaacttaggcctcctttggttctaagcatcgccattactagccttgccatgacctactagcatgagcaatgagaagctcgcctaggcaagtgaccattttggctctcccacacaagctagccaaagcttattggcataaactgcaatacaagaaactaaatacagtcttgcttagaattctcacttggtaaaacaacacgttatcaagagaataaaccaaacaaacccttaca

SEQ ID NO: 4869 - DNA, 1196 bp, Zea mays
  misc_feature (1)..(100): optimal_loci_15703_G1, chr1:87159222..87160417, Cluster 30
gtaagaggcccctgccttatcagccatagttcttgttgtgcttacatggatattaaagggctctatgcgataatagtttattactatgaaactgtgataataagcaacatatctgtggttcatgtttatcaaagttccgctcacttaatatgcgtgccatatttttgaattaaccagcagtgtcttatcttcgacgcatggttaaaggattataatgaagcatacagacttgtctatgacttgcagagttggcaccatcataaaaaacatgtatcataaaaattgactatataagtattttgatcacataatataaatgcagatttatggtgatcaattcataatgtgcacaactgataatggtggcagaaagcaggccctggtgaaaaaaactgtggttctgaaactagccaattatatgcagttagttaagccctatacatgcatacgttattacttaaaacagtgagtagaaagtatggtagccctatcctgcatgacctgtgatgctgtaataaactacacacaaaatatatatggaactatatttaaattactgcaccacatcttatctgtttgcattgtgaattttgatactctgttatcattggatgctattttcccacattcaggaaagtgcagtaatgtcaaagtattaaaatgttacatgggaagtacaagtatgggtctcagctaattacaccctgaccactatttttttagaaagatccagctggttgaaaagtgagtgatggcataaaaaatctagtccagcaatatttagaaattctgatacttgaaaatttcatgggctataggatactatgaaggctagccatcagtgaccaagcccaaggtctgctctgatgtccaaacctagtcctcaagcccccaatatttggcgtagccagcacactgtgcttgcatccctctgctctccaccccactggatcctcgaccgttcgctattctgtccattgttgtaacttcaacactattcatgtatcgttcttgtgttcttgtgcagttgagtggtgatcaaatctgaagattcctttatccctttatggattggtttattccttttctgattttctgtccagtattcgtatattgcttggatttattatcctaggaattcgttctgttcttagggctcctctcattgttgtgaaatcaaaaccgaagatttcttc

SEQ ID NO: 4870 - DNA, 1188 bp, Zea mays
  misc_feature (1)..(100): optimal_loci_15794_G1, chr1:87770334..87771521, Cluster 30
acgagtcaccccgcgagcgcgctaaccatcacaccctgatcagtccacacaccgtaaccaccccaccccacaatgtgttattcctaacacattctgcggaatgactgaaaccataatggaatgactaaagttataatagaatgattaaaactataacggaatgactgaaactatatcagaaattcagaatgaccgaatgggtgaatgcataagactctaatggaatgactgaaaaatgtaatagtaaagaatggcggaaggcgtgacgaaagccgtaatgaaatgagctacaactataggagaattattgaaattataacggaatagctgaatgagtgaatggttgagactgtaatgtgaccacttaaattataaccggtaatggattgtaacagaataactaaaacggtaacaaaatcagtggaatgattgtactaaataacataaaagggacccacctaataaataatggacgtaaaaaatcgtcgccccagtagaaccaaagcgggttaatcggatctgttctttggtctagagtgttgattccatcgactggttgattggctacctgattaattagtttggttagaccgcatgtccaacaaattaaatagagtgtgtgttcgtcactttgtgtgaagcttaacgatattcggtcattccctttaagtaattactagcttcacctaaggtgacgaataacaccgcctcatatatattatgatgatttgagcatcatcaattctactacagacttactagaggtaatgaatatatgcatgacatatacaagtaatcattcttaggttgtcaattttacgccgaatcaaaagttggttcatcatggcatcgcggccggccggccgtttttcccttgcggtactactttggatgaaagaagaaaccagtccctaggtattttgaacttgggaaagaagagaaaggacaactacaccgtagtccgtgtcgaaatagggtacctgcggaaagagggtttgcgggactgtgcacatgttgttccttgcatctcttacacagcttcggatgctgatctgacgtacacatatgttagccggtggctgcggcgaacgatattgacggaggagggtcgggccctgtagcatctctaaccacctgattggatggctgtgcctccatgcgcgcagactggggtcgtcctgtccaacc

SEQ ID NO: 4871 - DNA, 1177 bp, Zea mays
  misc_feature (1)..(100): optimal_loci_158526_G1, chr4:165978050..165979226, Cluster 30
aaaggtacgtagtatacaagaatggtgagcattgccgcgttgttggtcaagctcctacacggatttgaagcagctagcacccacacacacacaaacacaatgacacactacgcaatcaaaacaaaaatatatcttcggtttcagtttgtcagagcccgcgcgtgagattttctgtcgtcctccgagtgcgcagacgaagaccagaggttttcaaccccgccgacggtccagattttaaattagccgggcagcgttgacctagctacaagtaatatcaacagggaaaggtaggagatagcatcatccgatagcaacagagcaaggacaaaacttctccgtgtgtactctttctctctttgttttcccccctaccgttgtgcaagtacaggtccttttcagggtcaaaccgctgtgtggatatagacgacgcccggcgcgcgtcatcgatcacccgctccgatccgctcgtagctatagctttcgtccaaactgcaagtacaggtccgtccgtgcatatctctttcctttcgtccacatttcgtgtcgtccgtcggcaagctatcaaagcgagtgtaaagtggacttattttttcaacgaaaggaaacacctttcctccgccatatataattaagatatttctgcagggggagaattaattacgtgaggcgactataatccatgtgtttttgttacgttctttactcactgaaaactgtacgtacgtgcacaatcgcatagttatcgaattaattaattgttgaatgttcatcgtagccgtgacatagatttcatgcatgcttgttcagcgctcgatctgtgattgattcggaggtatatatgttctccataaccatgtacgtgtgcatgtaccgagaatatttgtttttttatgaaactttcttagttacatttttatacacaaacaattaaagagttttttttatcttttctttacaacatctaaataaaattacttacgttgtatcctggcatatagatttttttttttagtttacggaggtgggtgctgatattttttttttggcctgctatttaaatccatgcgtattattagttaaaaaaaaataaagcacttgcataacggtacggtgttcgacactgacataaagagacaatagcgttcaggttgccttgtgtcacagacatatacgtatc

SEQ ID NO: 4872 - DNA, 1122 bp, Zea mays
  misc_feature (1)..(100): optimal_loci_159200_G1, chr4:170810930..170812051, Cluster 30
tagctacgtaggtcggccactgtggttagtcccaatggctgatttcttggtacgtacgtacacgcgtggattgaccaacttactcctactgtgtgtgtgtgtagcggtgttgatcagcagtagatttcctgcagccacgagttgtactacaaaacaagctcgtggtattgcagttgtactaaaaaaccctatgagcatgggatgggagggtttgactatccaatgctaatcacattgcagtaattaagatagacatgccgccaaatactgcagcgtttcttaatttatttcagacatcggataaggacaatgtcacagtaggttaatctgtaggccgggttagtatcttgggactccaaaattttcattcggacatgcgtgttgttactgaatccattacaaaaaaaaaggaaggctaatgtgctactgatatctagctagtaaatcaactcgtgacaaaactcagctggctgcactagcagctaaggctcttgatcgacgccgaagaacaggacagctacctgttcagatgttcttctaaagctagctcctgcctgcagattaagcaagcaagctacagacaacagactaatcttgatgaatgctagtaattaatctccgcttgaagacggaatgctatagctgatttaacaactgagggtaggtcagcgacttttgtgagcgatcgacgatccaccccgctagctaactttatcgatccatgcaaagccgtagattgaacgcgtgattaatgtggcttagaataacacgatctacacacatgcatgatggttaggtagcctaggatgctaatagcccgttattaggcggccggccctaatatatatatagcttgttcttatcactactgtcgtcgcaagaaccacatactcgctagctagctagaaggtcaattgcatactatgcatggtgcacaaacgatatggaagatgacaagcggtcgaattccttgaatttgtgtgctacactacactacactacacgtatttgctagctgtcctgtcctcggatcgaaagattgcagtctcatgctgctcgatcagaatgcgtgccatatgagtaagaaactaaaacagcccctcaagttcagatgtctgtctc

SEQ ID NO: 4873 - DNA, 1325 bp, Zea mays
  misc_feature (1)..(100): optimal_loci_159235_G1, chr4:171128300..171129624, Cluster 30
aacctttactcccggttcattggctcatggcgaggtgctaaggacattcccaatggatagttgcactgttttcaatgctgccatgtcaacatttgtttacgaaacagtgcatgcggaatttcatcccataaaactctctcatctcccatgaaaatctctcatatctctctctttgtcaagttgcatatcatctcctaatatgtgctaatggttcatttgcacatccaaccaactatcaaccatgtattaattcaccgcagctcttgactgaatccaaacatcccagctaattaataattatctagctgtctattagcaaatagagttgttgttatattatacatataatcagtctactagggaaagacaactccgagcattatacttaagatggaaagacttcatgcagaccgagaaaacagttgaacctctagctctgtcttacacggtagcatcgtcacccatgtgagtgggacggtccttagacatgtgctttcaaagtgggacaagcgaaatcattttgcatccgcccaacaagccccctcatgggggtaccaaacctaggtcaccatggtgctactagaatgtcttgaccaaacagcctagatgtcattcatagttttttttaatagttatagattactcacaccaaagtaaagtattgatttttaatttgatgtgagtgatctatacctattattaaagagaaagagggttctatcaaccctctatttttatttcccacaacattactatcattaaaatttatgagatgaacatatcggatttttagaggcaagcaatgtcccaacctcaagaacatgacctctattaattgatcattccaaattaaaggcgagtggattgactatcttgggtgccttaggatgcccatattttgaaatatatttttttaaataaataaatgagccaagcttgttgcaatcaccgctggtgccattgctcctcaagctccaacacaatgtcataagtacacttcaagggcttgacaaccaacatcccattcatgccagtcctaaggagatagttcatgagccaaactttgtcgacctcatctaagagtatctctagatgactagaggagggtaaatagtctaattaatattttctatagaacacgatacttaggaaaatagataagatgatggtcctattaagcactatgcatgcctaactagcaaacaaggcaaagcaagagcaattccgacacaattctaatagtaaagctaacaacaagcaaaggctaaactcaagcactcctacacaagtctagtgagcaaaggtcaagaacaatctaacactag

SEQ ID NO: 4874 - DNA, 1259 bp, Zea mays
  misc_feature (1)..(100): optimal_loci_159501_G1, chr4:172449374..172450632, Cluster 30
ggtagaacaaacacaaaacaaaaccaaagtggaaaccaccctagaaaacttgttaagtcagtttgaaaactgatttagctgatttttctgcacaaaccggctcaaacatgtttatgaaccgacttagttggtttcagtaaccgatttatctgattttttctacacgttagcccgagacctcataaaacggtagtttaaatccaaacaaagtccaataaaccctaattataggggtgttgtaaatcttttttcaaagattagcacctagaaataacaaaaccggagcggatagaaattccatctttggaaatcagtttttctccaaattggtagaaatatcaaatcttcgtgctcatgaaatctaccaaatatgctggctagagaccttgttcagatgtcatagaatgtggagaacaaatctaaaaaagtggaagatcttagatcgagagattcacacaaaaactccaaaagaacaagagaagggaaggggaacaagagaaccaaccaagaactcaaattttagagaacaaattctatatattgccaacaagaccattttctttacaaggtccaacatccttcctcttacaactgggacaattagatagatgtgtttactttcccaactgtagatctcttcttagctatgaagcacactggatagtcccaagcagatgaaaacctatagaactacgaaccacaacagatagttggtctgggtatctcctcctattatttatatatctattgcacatttttttgtctagttttatatattttcttaaatcacataaccctaggggtataatggtctaggtggagttccttgcatccgactatcacaaatcctttacgagaaagttgactcaacataagctctctaacgatatcatgtaccacctcgataaccatccttgggttttgacgtccaaacctgataaacctactgcttacgattttaaggttgaaaccattaaacccaactagattcacatatatggtatgctttctccatgatcccaatgcgtatgaccgcttatccttgatcttctgatcaccaaatcctcacccactcattttaattggtcaaccaccatcttgtcttgttcaacatcgtcttcacatgcacacttgcttgtcataccatcaggtgttgactgtccactacctacccatccactagcctcggcccaagcatcctcattcgtgctccaccgcttccactccattggcatgatctcgcttgaccttatccattg

SEQ ID NO: 4875 - DNA, 1024 bp, Zea mays
  misc_feature (1)..(100): optimal_loci_160936_G1, chr4:180891487..180892510, Cluster 30
tacgacatccaaggtataaatttgtatatgcctaaacgcacgattatgggtgcctttgatatggctctttagacggctctaactcaagcttatcgtaaagttgtatcaaacgattatgaaaaacgacggctcgccgataaaccctaaaaaaaatagagtctttttttgttgagagctagagcactaaaaacctggtttttatcggctccacctatatttttcccatacataattagaaagaaacgcggagagaatctattttatcaaacaagtagcaaaatggctccgatcccttaaaaaatctagagtccgaactgtttttgaggaactagagctcggcccaacggaggcctacatgtcaaggaccctgcttctgactcacatgttaggaaccgtctgttctgattcttcttgctgtcaagtgttgtctaataactatattgtactaatctactagtacagaggaaacagcttaaaaaggaagaagggtcaactaacatataattctctgacacctaagttggccactcagcagctttcattgggcaatatctgttctagcttttacgctgttaattactaatctgtctggtactcctcaccaaaagatgtactaatcatgtaactaaaataataaataatgtgcgtacttgcagcaacacacagcatactgacattggtaatcctgttcatgggtcggaaagatggggataggataggtaggtcaggcccgtccaaaaggatgcttagaggtatcattaaactgaacccttgctcaactcgcagacactgctgcgttgcgtgccatgcgtatctgagatggaaagacccaaagaaattttatctgctcacggactcggcaccgagaacctgagatctccagacccccgtcgcaatcggctcgagctcgcaaacgcgcggtgggaaaaaaggaggtgggaaaaaaagcgaagggatggcaaaaccatcgccgtgtaaaagaacgcggccgctttccacgtcgcccgcccaagtacccatcgtt

SEQ ID NO: 4876 - DNA, 1243 bp, Zea mays
  misc_feature (1)..(100): optimal_loci_161049_G1, chr4:181779582..181780824, Cluster 30
ctgacaaggtgcacacaatcaaatctttgttagaaattcagtaaagcacttagaccaattaaaatatgcatagcttctgataagacaattatcacaatgttggatgcattgatagaactagaactcaaatatcttgagaatgaagctaaagcaacaagctgtctaagaaatagtggtttcacttgcagaatctccacattttggtttatatgtaacatatgtatctttaattgcacgatctcattttgtaatatacgaaagagtttatctaagaaccacagatcaatttaattgaagagtctctgcctttggttttatctgattcacttgaaagctaaaacttatttctgcaaccatatgaaatttgcatgcctcaaatcacattacacattgaaaagcaaccatcataaaattagacttgaatacaattaggtgaataaatgtgaagtcatgtatgacaaattggtaccggtaccaatgtgaaccgagcagtagcttggatggttagtgccaccagttaagaggatagccacccaggcccgaacctagggctcaccaatttgcgggtacttctcaaggaaagtggttccagggtactcctctatcttataattgaaaatgcctagaggaattctctcccagtggtcaagaaaaaacaatagaaacaatctactgctaaaaaggctccatgattaagttttgacagatgaagaagaagaacggtccaatggagcaatataaactagctaaaggctatgaggacataatgcacgcatccacatcaaaaaaactagaccagcctaggaggaactaggtggaaagtggcattttattatcattaataagaagaaagcacacaaatttgcctcgacgacgactaacacttgaacatgggtggtctgggtgtacatccacctcaagctagctcatctcccttccacattatacgtttcatacagttttgtatctattgttaatttcttattatgtcttacactatcaaaacaatgattaggcgcaagaaacaaatgttggtgactatgtcctgccaattagaggattttggcattcttgtgtcatcttgccttcttgatatttatttatttcttgatatttcattcttgtacctgtaggtttgggggaaaattgtgtttgtgagacatgcacggtgttcagcctcctacaccctaagtcgcatcgagggaaacaaccatgtcagacagtcaccacgatcgacgctgac

SEQ ID NO: 4877 - DNA, 1078 bp, Zea mays
  misc_feature (1)..(100): optimal_loci_162129_G1, chr4:188388281..188389358, Cluster 30
agtttggtgacaaatttgtgctcctggccattgccatgatatttgcttgacacctagcagggtagtgatggaatctcagtagctgttccaacaaatggtagtaatattagcttaaggctttctcatccctgaaacagatggtttgcattcattttactagtaactgattttaccaataatgttttttttttggtccagtgagtactaagaggctaggctaccaataatgaatatttggccacattggtcagtgtgttgtctggtgcctgctggcttgtgagcaaagataaccaatgtttgtgtttctccagtgaataacttttgactagtaacctgtacaaatgtaccatgaatgggtaagaaatttgtcttacataaacacaaagcaaaggtcgcttatcagttacttaagtgcagatggcgatgtttattggttgttgtcataagcgaaatacttggcattttaccactgagtttgttgcctctattatggcatccgtgcctatggtttatgggtctatccgtatccatgatttatgggaccgatggtaaatttttcaaagcccacttataataattataaaatagcaaatcgtccattataagctgctatttgacaactcgtttaagtttgagcatactgacggcaggaccactctggcaaccaaccaaccaaccaacctgcgtccgtgtccgtactgacgggaagatcagtgtgggccagtgcagggaggcaatttagatattcatatcattggcagcaagactttggaaggaagaggcagtgcccccaaagaatctccatggatcaatgtgtcccccctcctcctggttgcgtacaagtcatcagtatccaagcaaacaagatagtatagttcgtcctctgctttgtggaggttgacagggatttggttcatggattgggcagtcaacagtgcaatgcttcgatatatcatcagatgtcaaatgttaaccccatctgacggcaagccacagggtttcagcagagagcaagtgtctgttcattcatatgttcaagcaatctttgcgtgctaattgttaaattgcatgcagtctt

SEQ ID NO: 4878 - DNA, 1087 bp, Zea mays
  misc_feature (1)..(100): optimal_loci_162534_G1, chr4:189908021..189909107, Cluster 30
cacggtaggaaacgaggagcaagtactccaactctaacccaaaatgtttgagatcaagctcgaaacatttctggagatacaacaaccaaagaacaagtgcgtgaaacggactcattttcagcacagaacagcacgggaaggacgacggccattaacctagctccctcgtcttggcaaggtcgttatccctggtaagcaatccatggttagacagtaaccatatgaaaagaagtgaactcttggtggtatttttaggtttccagacctaacctaactgccataaacagggaaaactaaactcccccacagttatttattgcatacaaggactctgcatagcacatacaccatcagaaaagaaaaggtccacataatctgatcatactcattattaagataccttcaatcaagctatctagcccctagctcatatctatgtaattctctgaaacgtgtcttctaaaagacaacataagagtgtgaccgtcccaaaccctcactaattgttctacctccttgctcattaatcacatacaaaggtaataatagccaggcttgtattacatagccctgaagagggaaaagcatcaatgaactcagtttgtattgatcactggaatcaaatacatattaggaatttaggatccttagttttgtacttaaagtcgacacaaacagtgcagttgacatctaaatccctcatgcacttaaaagtgctaagttcaacttgatttgaatctgcacaaccgactccaataaataatatccatgccgatgatctgccaacttatttccctacttttttttttctgatatagattttttagaagccgcctccgtaaggataaggccagtcttagacaaactccagcctccgttcaatatttataaagacatgtgtccttcgtttccatcaattaattatatatagaggcggttgtctgaagacacatgactattgattaattaaaaaggcataattgtcgagatgttcttctctaaagttgactattaattaggtgggcaatggaaggattcatttctagggcacattagtaagaggccaattaaagaagtagttgtgtaa

SEQ ID NO: 4879 - DNA, 1047 bp, Zea mays
  misc_feature (1)..(100): optimal_loci_162630_G1, chr4:190382541..190383587, Cluster 30
agagcagggaaggagggtaatccatggtgcatatgtgtgggactgtggggttcattatttctcaccctgcaggctgcagccaagctcttgactttgaccgtccttgcggtaactctggcggtacatcgtttacaacaaggtagaaaacgaaggcagaccaagcaagtgcaacaactcaatatgcaaataaaaaaagtgtataggggtgccagtttatatatccacgtgtccgcgtcaagtgcatgttcatctgttgctgctagctagttagcttatctctacgtgtgcgaacgtaaagccgacggatcatgtgattgggcgtcgtacgaggtctgcgatgcatgcgagtttatgtgcggacgtggacgattaattattcaacttctcagtaagtactgtacgttacgtttgccatgtttataagcaaagctaggaggtagcagacctacgtacgtcgtccgacgatcccttaactatagaccctggatctaataatttactgcaaaaccattcagttcgttcgtcaaaaacaaattgcaaggcaagctaaatgttaggtaataaggtatgctgtttggctgttcagtatatatacgatggaccttttttgttttttgtttttgcttcagctcagccatttcttttggttgtgtgtgattgctacgtgtgcgatggagtctaccctctagctagctagcaataatgttcataacaatcaatggtcacattcatcctttgatatatgaagagacagcaggaggggcctccttatttcattgtcttttgatgaaggctcttgatgaaatacacttccctttatccatcagggaaacaaaaaagaacaccgcaaaaacaattactcactaatgactgtaatattaatgattgcatctattactataaaattagtaagtgtatgtgcatgcacaaaaaaaagctgcatgcatgccaaaaagacaaaagtctagccatgcatgtgagtgggcttctaataacagaagaaagcactggtctaacaatatgtttcggtttagccgaaccacgtca

SEQ ID NO: 4880 - DNA, 1058 bp, Zea mays
  misc_feature (1)..(100): optimal_loci_164764_G1, chr4:200741378..200742435, Cluster 30
atagcatcaaatcattgatcgttagtataatggttggcttgtaggcaacatcggactaatgggctctactattcaccagggaggcccattatcaagtgcatgggaacatttaaatgtaggaattagatggtcctatgtgtgtcatcagattaatccaatggtttagggagctctctggaaactttctcgacaacatcatattacatagggcattagtgtgatgaccccatcagactataaactccactaaccattggctaatccaacatctagtatctaacaacatgagctctatgaataataacatcagactaatggctacagaggatgtaaaacataatatatatagtctggtgtatggagttataggtcattggtttaatattatgaccccataatcttcctagtgaaaggctcccaatggctagctcatttggggttataatatatatagccttgttcttcatccaaattaagtttgagagatatctagtacatttatattgagttgttgcacctagtagtactagtggttgagttgagacgtggttttcttgttattcatagtggtcatcaccatgtaaatagcttgaagcagtttggtagtcgttgaagaggagtgatgattgtttttgtctctagtcggttcatattattagaggtattgaccccatcttgatgagcgcaaagggacactctagtggaattggggctaatttgagggcaccattttgaatagttcttgtagtattcttgatgggtctagcttgtcacactagttagctcatgaaccatgaagtggaggctcaacataatgaggacgtagtggtacggaaccgaacctcatggatatatcattcgttttctcgtggtttgatgtttgatcattactctcgtgctcactttcatactttgattgtgagtagtagtagtcatttgcgctgagctagagtgatagttgtagtgattagtttagttgctctcttttttatagctctctagtgtagctcttgttgatgtaccttgtgtgttgttatgaattagactagaaatcaagc

SEQ ID NO: 4881 - DNA, 1000 bp, Zea mays
  misc_feature (1)..(100): optimal_loci_164837_G1, chr4:201483459..201484458, Cluster 30
ttcttcagtgagcacgtcaagaggaaagaaatcaatttagacttaccgggtgtacctatgaacacacatagcaacagcggatcatccctgtgaaccatttatgattcatcactgcaacttttttcccaaaataaattgatgttatgcggtgtcacctgcacaattgcacatgaaagattgcatgattatacccatccatgtgcatgcatcaagaaacaggcaagtattgaatcatgcaataatcatgtgtgcttctttttgtgcccactggccactaccgactttgacaaattgaaccgtaaattatgcatccacccgttccaccgtaaggctatagatattacagctatacaattttcatagcagtgtatcatgttattgctgttgttgtttcagtaagaaaatgtgagattcatagagagtatgacaggtatgaccagagaaagtaaaattcataatgatcataaatttattgtccagccaatgcaccgtcggaagtgtacataatggtacttatgttggaaaaacatttctacaagtcataatggctggataaggatggtactcatgttgcaaacaagggcagagccacagttcaaacaatgttctgagtttgggcaaattacttcgtaaaacaatgcctgtggaagcgatgatcctatgatttcagcaagattattatactatgacatcaatgccagattttcaggatccattgcagctaaacaaaaactatgcaaggcataaagtctgaataagaatactcattgttacttccaagcttctaaaagcacacagcaagatccactcggtcacgcaactcagtgattgtaaagcttgatcagcctgactatggagttatagataagctagaaatagatagcaaactcgtttatgtgaccaaaatacaggattatcatgcaacgagcagatgaccctagaaaccaaatcagaacatgttcaggcaagcaaaacatcacacacttacacttacagccag

SEQ ID NO: 4882 - DNA, 1071 bp, Zea mays
  misc_feature (1)..(100): optimal_loci_168586_G1, chr4:221756139..221757209, Cluster 30
aagcattcaagggtttttaatgatcctagaagatcttacttgaggtgctgaccattaatgtttgtgttgcctaagtcctagccatcatcgtttgtgttgcctaagtctaagccatcattggatgtttttatacatacatatggcccatgcttggttccatttttctcatagggctcatatagtcagttgcgtgagccatacaaggtttgtcaaccctttttaggaggtgatatgtgttaattgagtgccaacatgatgtgctcccaagtgtaagtgtgaaacatattagcacaattggccaagagagcatggtcgcaagaccccaaggggtcacctgctccccaaatgcatcccctcgatcccaacttttggtggaagcaaataatattataatttgatcatcttggacatcaattcttggtcaacagaaatctaaacagtaagaaaatggaccatatggctcattatgtttgttttaatgtttgatggacaacatgacatttagactattgttttttagtatataagatataggtcaaattgatgtaatgtgaacttagacttaattgaaatggtaatctggattataaacatcgcatgcatgacattataagaatatttgaagatctacaaggcatgctagaagtcaaagacacaaagtggaagtgacatagatgcaaataccatgtaggaacaagtcaaatggcattgtatgggcatcactagattattttggtgtctacaaggaggcaacatcagaccatgtagtcaatagaggctgagatatggtttcgacgcttcacccaattattttcacaatggagcaaaataaccactagattatgtcagtgtcaatagtgtacaccatattagcataaggtcaccaccaaataaattctagagagaaaaacaaatagtggaataatatggtgatagctctagaccaatggcattagtgttgtgaatacaaggagagtagagataagaagtactcactagattgctctgtggtactaggagtttgtgcactcaagaatccactagtccaacaatcaaaaaatgctagttcca

SEQ ID NO: 4883 - DNA, 1026 bp, Zea mays
  misc_feature (1)..(100): optimal_loci_169839_G1, chr4:227657142..227658167, Cluster 30
aaggcgtctggtcatcctagggaccccggtgaaaagaaagtttgaaaattttataataaggtccctagcagtctgtgatataatgagatcagatacgctcatatattatcgttccatatttgttttcattttttttcttcagaatcggattgtatacagtattattgagttatatcggataagatttaaataaatatcgatatcttaaatatccaaatttggatatacggatacagatatagatcggatcttgtatacctggatctggatactgatcggatcttagccttcttagacagatcaaatttaaatacggatgcacacactataaattttgagtttttgagatataattttgaaattaatatttctaaaaagaaaagatatgtgcatttcaaacatggttggcctttgcactgatcgacggttcctatccggctatccgtcactcgtcttctcatgggtccaagtccattctgtgccctctttttaaatttgtgtggagattgaaaataatgtttttgagaaaaatatgtatcactcgcctttagtgttcagtggaacttttgaataggataaaatagagagaagctaattaaaagcaacacataaatataaaccagattatctcagaggtgaaggacagaacccacggttttaaaggtgagggagacttattagtaatttcttaaacaagttattgatttgcagcttacatatttattttcgaagtgctttaacgagataaataccaaatcgcttactgttgcaatctgagttttttttggggtgggggagggggttcaaattttagttttataaagtttgttaagtcatacttactgatttcaagaactaaaaggatcttaatcataagaataacgttgacatgatagtgtctgagattatatgatgttgctcatagtattatattattattaactaatattatttatagttgcaactatcacaatctactccctccgacccttattttaagatcatgaagctataattatttttaga

SEQ ID NO: 4884 - DNA, 1121 bp, Zea mays
  misc_feature (1)..(100): optimal_loci_172794_G1, chr5:2340977..2342097, Cluster 30
tacaagcaacaagctgctaagctagtgctttgcactggctgctcgatccttgccaagttccgacgacggctggcgctctggcgtattgagtaacgaaaggcccacggccacaccgcggtgagagcatgcagatagatgtaggatcgtcgagtttccctgaagaaatgtcagtattattattgcacatgcgatgttgcacgccctcgcgacggcggaggaggaaagctattcgttccatacacattcatcagtccaatttcgcaagacgggtcaacgggaaagcgatgatacaacaagcatgcaatcctgtctcgagtggacactgacaacgtaattactcgctgaaaaggcaagtaatcttcaaatttcaaagaatcgatttttttttattaagaccacatttcaccccttcagatcacagtacaacacaacactaccaccatcaaaatcgaatttggtatctctagctagctctcaaacatgagttacttacgctgtgacgatttgatgaaatccatgctggaaatagatactagcagaacagattgggtcagaccggggcctagtgcctttattccctctccaacggggggagactgcattggactgcgggaaagcagacgagagaacttagattccctccgacagcgacgggtaaacaaacgagctagggaagagatgacgtccatgcatgcatgaaatatccagagccggtgaagacaaaaaagaaattagcttcaccaaaatcctagttctcacattaattgtgcgatattggaccgatgacggccttgttgcttgttcatttccaaatgacgatatgcgcaaagggactacgtacatttttgttttggaatttcctaaaaccgttttgttgaccaaagtatgacttttgtatttttttcaaattttaaaccaaaatacaccaaaaaaaaaggccaaaaaaacgcatcgtcccggttggaccgacaaaaaaattatacttagaaacaggactcttcgaccgaaaagtttaacctagggtgcaacttagaatgcacaccatggtagatagatagtactatattaccacgcatgcaatgcaacaatgactttcttgatgtagagagtaattaaagctc

SEQ ID NO: 4885 - DNA, 1092 bp, Zea mays
  misc_feature (1)..(100): optimal_loci_175269_G1, chr5:16845915..16847006, Cluster 30
gtagttgcagtgataaaaacagttttttttatcaaaccgttgtgactagttcaaactcaagatagtttgacttaagacgattctggtagtttttttaagacaaagagagtactcatgtcgagagtacatctagatccctaagtgaatttttaagtaaagatggcgatgtaattaagggattgacatgttgtaagcgatggaatgaaataaggcaacacaatgacgaccacaattcaaattctagcggcgtatggatgaattaaggatttaattcttacttctgattttgaatatgagtataaggacagttagggccaggggacacaaatggcaagcttaaagaacacttgaaaaggtgggaggggtatttataccacacgtccttcttccccaacaatggtctactcatgtgatcatatggccaacaagagggttctgcgtggcccaccagccaggaccttggattgtcctcttgattgacgcagttccgcggagttgcatccaacaacctcctctagctttgagttgcttgcaagatcaatcatagagctacattccatgaaccaatcatcaagactcacatagcttattacccatcatatattcaatttagtcaaagatcattacatcacatctaaaagaaaagtagtgttacaagttataagatacaaagtggaacaatttggactgttttttttaaactcagtcacacatccatcaaagtattagtagctttgggggacgaccatcttatcacctgctaaagccttcgagcgcacccaggcttattttaattggattgatcatcctttatccatcttcaagtcgagctcatcaatcatcatcatggtgtggaagtaaccatcttaagcatcttcttagtgaaaggttaatccactcgttatctcagttaacaaaattaaatataggactttcacttccccacgttcaaattttagtgacaccaattatatttaaaaattatatcaaaataaccagcgcaactgtagtacaagtcagatgtaaagtaattaaaattgagatgtgagagataatatttttatccaaattatccatgcaaaccctgtcagg

SEQ ID NO: 4886 - DNA, 1145 bp, Zea mays
  misc_feature (1)..(100): optimal_loci_175514_G1, chr5:18372583..18373727, Cluster 30
taaaggttacatttggggtatttgtacacattatatttatgcatacatatgcatatgtactaaacagcaaggacagggatggcgatggcagcatatgctacaactttgtttctgttcccatgcatgcaaagggaagccctaccacgacgtggctacccatgccactcattggtgcaccactgtttgctagtacaacaacgtacaaacacacaaacgctagatgcatggaccggcttctgaatccagctagctggattgtttctaactagctagttaataatgtaggtcaatatatagctacgcatggggacgggatcaggagcttagttaattaattatgtggtctcgctctaatagatagtaaccttgctttgcactacaggctactgtacacactttatacacatacatacaacttcagctagcgcaacacatgcgatgagaaatgctccctgctgtgtgtcgtcaatgggttataattcgtagagagatgtcttaagtcaaaagttcgaaactttggtcaaatatctagaaaatccacaaagatttatgacatcaaattaattagcatcgttagatacaacatagaatgtattttcataaaatattcatgttaattatgtcatactctttcctataaagttagtcaggactaagaatttaacatggtttgacttgcacggtttctaaaaattaaatttatttacttcatggaataagaaatgtgtgcatgcatgggtgcatggagtagatttttgttggctagatagctccctttcatttctagctacggaatctcggttaaacaatgatacagtaggctgcaagccatggaataatatgatcattggggtttggggagggatgggaagtcagccctagatgtctgtgagatccattgatttcagtgcaatccatagaaccgttgctaatgactagtactagagtactctatatactagctagctagctcccttatacgtactttgaactccggtggggattcatgcttcaaggtttagctcaacaacgtaatttatttacttcaggccaatttttttcctgaaagatatgttaactttgctgcggctctgctaattcttctagagaagatttttttttcatttattaaaagaaattaaaaa

SEQ ID NO: 4887 - DNA, 1129 bp, Zea mays
  misc_feature (1)..(100): optimal_loci_175995_G1, chr5:20809267..20810395, Cluster 30
gataaccaatggtatgtgaaacattttgaatattgataatggtttcttaattccacggaatcaatccacttatttttattatctcaatgtcatatgataaccaatggcacatgtttgtcgagttttaattttagccatttcatccccctttttcaaatgaatccatagaaagtggattgctgatcatgtaggagtgatggagtatacctcacgttgaagtggggccatgcccataactaaatatggactagatcgaggtaaatgtgcagcatagtaatcttgtgttatataggctggtctaactggtttgggacaaaagttagatcagacaacttcaaataataatcgagagaattcatttcttagccctaaaacaaaccttggttcttggcccaaaaaattaaaaattttcttacatgacatcaattttattttttatgtccgtcctgacactttctttagtttaaagggctacgaaagatcaaatcaggctaccaaagaaaagtgaatgcatgcaagtttggcttgcttcccaatgttataccctaatatctaaaattcaaataacaaacaataaatgtgaaaactttttaggacatacatgagtacaatgtaacaaatggatcgcaaaacgagcatcgaaaagtctgaaacgactcaaaactctggttattttcagcatcttgaattttaattatagaatgcaaaatcgatacaagcgaactctgattgagttgacattttgtacacaccttcataagggagtttataaggtgtccacaattttttagctcaaatgagtttaaacttcaaagtcaaatcagaaaactcgaacttgacttggattttagctggggaagagcaaatctattagaaaacttgttcactaattggatcagctcatactataggttgcagtgaatacaggacaatttctagaccaaagattaaccccaaaacacttcccaagcaagtgaaggcaagaatcaaatcaaaactcaaaagggtggagaggagaagaaataaatcaaaagcaaattccattagatttaagccaagagggcaacgtgtggttccagccacaccttcctcagaattccataaacttagatgacgaggttcaacttgc

SEQ ID NO: 4888 - DNA, 1133 bp, Zea mays
  misc_feature (1)..(100): optimal_loci_17645_G1, chr1:98315398..98316530, Cluster 30
tattagttacattaatgtttagtacttcgccaaggtaatacatcaatcatttcatttattctagctaagcctaggggctttggcatctcaggtataattatattcaaggacacacgagtaggttttagaattaagccccactagtgggccagaaaatctcgcttaggggcaaccatcgttgcaacggatatgataaagttttcacccgtgttcgtgtgtaattcaaaggtgccaaaccactcatatacaagtgatctctcatttttgtcttggacaattactctttatgacccccctgaggatgtctaataccctaagagttgttttcgtatatcaattacttggttttaggctcaaggggtgcgagacatatgtccttggtggatgcattcaattttttgaataaggatctattaaagtcaaaagattacatgaaaggccctcaaactctttatgttaaacaacacgaggcttggggctacacctaatggatgtgctttataagaaagggcacaccatttgaaaaaagtttgaaaagcactttatgacttctatcaaaacaatactcagatgttgcttgcaagaagattttaaagttcaaccataaagatatcagaggcttggaaaactaagatcatggttttccatagggccgactagcctgcaagaagatgagtcaaccatggactactagaaaggcatgggacaagccgacgtggcttccagtgagaaaatcgacctagtcgactaaaggaaggacaatctttataatagtattagaactcttctgtcttagttgactaggactataaccgtgtgtctaccctaggtagaggtacacctatttaatataacataaacaataattcaacgaaagactatccaacacacaagacatatgatattacactatttagtggtctaaatctgtctaaattgtcgtttcatgttaaccattgaattttgtttttcgtcgacacccaccaaatcttaccttgagtgacctcatagtaagattgttgctcatcagacatcgacaatagctagccattacaatcagatcatggcgcgacgtccattgtactctagatacaccagtgccttatggtagtttgttctctatagcatgagct

SEQ ID NO: 4889 - DNA, 1218 bp, Zea mays
  misc_feature (1)..(100): optimal_loci_176592_G1, chr5:23569646..23570863, Cluster 30
tttgaaaactaactcccaactacactagagctaaaataaatgaagagagggttcttatgttatggcttgcttgctttcaagtgaggagtggagcatctatttctaggggagtagagttgaaagtaggaccatgaattcatgtgacaccacctctctacccttggatcaaactatatcatgaagcatgatcaggattgaagggaattgtgtttctttgcatgcacaagaagttgaggtggcggagtgtcctaggggggtcgggcgaccctccttggggcaactgatctatgtcaatgataggtggggcctccatcttctacaaggtggccctccgagtgaagtcctcattaagtatctttgcctcatgtttaattgtgcactgatgctctggatgttggtccatggttatgcatgtgtggctacatggtgaggtctctctagattaaaaagtatgctattttgttatcccaatttgtggtttttaaacaacaactcatagaggatgtcaaaatacaagtggatctacaaatgatattttaaaggtgactcatattcccaaccgcctttggaaatcaaatctgtataggcgattgggtgagccaccttttagaggcttcccaactgcctctgcaaatcccctagtggtagtgcttgttggacttttaattatgttggctttcaaccaccaagaggaacccacttgaggacacagatgcactttcttggaggggggtgtacaaaactacatatgtgtgtgtcggcctaggaaaaactggtttgcatcaattttggctgcttgaacaacaaaacttgaagaaaccagttgatgctagttttgcagggcctatgcacctttctatgatttagttttatttttgtagggattttaataagagtttattcacttctctctatgcattgactcactcctttcacatatcggacatagagggactaaattaagagcattaccggaagtaaagatctgcatatgaatgaattgcatcactttttatattgcatctctttattatattaggtatataaggatatggttatagaggtacggtgagtcagacttcaccataaacatacctgcaaaaaattttgggttgcgaagtcgttagagcgtcttcaagaatatttctttaccgactccctaaatcattatttattaagcacttgaaaaaatcattctgtatgtatctttccaccctc

SEQ ID NO: 4890 - DNA, 1053 bp, Zea mays
  misc_feature (1)..(100): optimal_loci_178298_G1, chr5:32249494..32250546, Cluster 30
ggataccaggggccttggtcgtaacaatttctcgagcctggtagactttgtgtctcttagtgtctctttataaaatttagtggtgttgttacctattttgatgttctatatcgaattatggaatgtcaagctccttgggcttagatctaggaaagtccccaagggatgggcccgaaggggatggtggtcccaatagatgggtctagctatcgggacctttggtggtagtcaaagggatatgtgttttggtggtagccaggggtatgatcttctccggaagatgagagccgttaaaaaaaaaactagttaattttcgtggtttaattttaaagacctagataccgatgaaaaatacctaatttttacgtgcaatgactacttttcgtagatctccgaccgatttaaattgatcagagtaccgtcgtgatggatcaaactcataagaatactactacttacataaccttgcgctagaattataagtatttttctagtatatcacccagctgcgtgcgcggtgcgccaacacaggaaatctctaaagatatctccgatcatttgtcctcgttatcattacaatcgttagtcatcatcagagatttgaaaagcactaaagttcttttttttttctttacgattgtcaacgtcctcgtcatggcgtaggtacgtacgatgcaagctcatcagcacgggtacatctacattcatgtgcctgcttctctgccgccccttttcaacgcataaagctactacagtacgtgtgctgcagctccaagagaaaggaggtgaagtgtgatctcgtccaaaagcctggatttttttttttggcaggcaccttgaaagggaaatgaagttgtttgcagaaataaaaccaacacgcgcgtgcagtattatttgtgtaaaaaaaagaacggtagttttcctaacaattgagagtaatcttcttcttctttgtttcctcttaaattacagagtggtgcatgaccacacgagctgacgtgtccgggcaacctacggctacgtacgtgagtaacacaaaataaatcacgtgct

SEQ ID NO: 4891 - DNA, 1192 bp, Zea mays
  misc_feature (1)..(100): optimal_loci_180080_G1, chr5:42230076..42231267, Cluster 30
atcgtccgtcgtccacacagctacctagagggtatagctaccagctgtaggcgccattcatttcgatcggcggtcaccctctgttcccttccatgaagctagctagctaccagtgtgaaagaaagaaagaaataaacgatacactagtcctacgagcagtggccatatgatccgaagctaaaagaaaaccaaaaggaaaagaagaagaaaaaaaaaggaaaactgtgggtgatatatattggcttcacccccaaggaagaaatctagagatatgaagcaggcttaaagataagcaagaatcgagaagcaagcacaaggaggctgagggccttttccctgtgatggagttgacagccatcactaccaccactatggctctactatactagtgaccggaaagagagaacccccagctgtgtggcgaaaactagcaccatcatctcgttcctttcttttctctctctctctctctttctttatttctcccaagaggagcagtacgtatgtgggcccggtgaacgaatttctctggttttttctctgaaccacatgataccctgatgaatagaaaacctgcaaaaaaatctaccccctccgagggctccatttttcttttcatctccggctcaaagggagagggggagaaaaaaggtagatacagaagggaaagcagcaggcttgcattgcacaggatatatagtgattaaatagaaaaaaatggcgaaaatttgaaaaacacaaagatatactagtagctgatgtgcttgggaacaagggactgagaaaaataattgaagaacacgctctccgctttggtacttggtatccttttttgttttgttttgttttttgggggttcctagggcgtagtacacatatatatgtatgctaacaacaatgcctttgtttttgtgctaaataaacactgatgaactgtacagtactacatgacgatctatcaaacttgggagacagaggcagccccacagcagctttggggggtcctccacagcacatgctagctgtggtttagaataatgctaaaagcagctttagggcaagcaaactgctgctgctccaatccattgcagtcccttcccttttctcttctcttcttcccatggatggataggttgtcttgagaattattcaggtactaccaggccaccggtgtgtggatggggttaagggt

SEQ ID NO: 4892 - DNA, 1270 bp, Zea mays
  misc_feature (1)..(100): optimal_loci_182885_G1, chr5:60246368..60247637, Cluster 30
agacgttgccaaacaaaccctagagatgtgaaataataaggcttgtttagcttagcaaatctcttaacatgtggctagttaatttgtcggacatatgtgtgcatctttccctacctgcccaatgtcaagcttagcaagtctctagatccgaaatttttactcaccgtcactggccgtcgtggttagctagctatctcacggggggaaaatttttttctttagcaacgtggttacacacgctgacacgcatggcgaaagcagaagggacaaacatagaaaccgatagcaagcagatagcttcagagatcactactgttggaaatatgaagagggggaggaaaagacaacacctttcccaccgactggccggtgggccggccgggctgcgattcacattcacatcttgacttgtgtggctccgcgaaagaggagtacttactttttcttttttgatttgatttgatttgatttgaacataacgtgagcctgaattcctgatgctgcgagagatgcatgtgatgatgaggtttgaatgaaatacgtacgccagcacagcctcgctccttccttcaattccgtggttacgcgtttagccaaagacacgaccaaaaagaaacaacaggacatggctgtctctctttctttttccttttttcaagagaggcccgaaggaagagagaagacctttattacctgtatttatgatgagatgcagcagtactatatatgatgtgtgtcggagtgtcaaattactactactttctgctggtgactgatgggaatttggaattagaagggggtcacgtgatggcctcccgctttaatttcactattgttgttgttgttacaacattttatttgggattctatatacatgtttcattccagatgaaaaagaccagcagctgcatttatttatttatttattactcgccgcctgctgcagatctcatctcaatgccatttttttgtggacaaactagcaaactatttattattgttgttgttattaaagttattattattattatatcctgcccggcccatctggctttgttggtgtctcttttgcagaaaatccggcgtctctgttacctttgagcccaaagcccagcccgtctcgttcctcggtccgagcagcctctttattgttttttttttcggacaaccggcgcgcatgatgagccaatcgattagattcctcggacggacgcacatgtctagcactcggctatttcattttcaaccaaatatttatttggaaggtgtt

SEQ ID NO: 4893 - DNA, 1168 bp, Zea mays
  misc_feature (1)..(100): optimal_loci_19093_G1, chr1:107289432..107290599, Cluster 30
tacaagtatgtaggctgaaaaaaatgtatctggatctcttgctcgagcttgcctcacccctccaggcaaaaactggaacatacaatgtttttggtttatttgcttgcttgcttgtgtcgtttccttgctggcttgagagagccaatttggtttgcccatgctggcaaggctaaccttgctagtagaggtgaggcgaggaaattcagcaaggcaaccgaatagccccaaaatgtcccatgcaaaatgcccctttgttccttgaatgaaaagtgccgcataagccaattagagaagttgagggggttgtcatttaggacatcaaatacagatattttaggtgtctgttattctcttggggaacatagaggcactctgttcagtttgtccaccgatgtaatgttctaaactctttcttctaggcacaaccaaggagatcacggagtccatctgttcagcctgcttcatatttgctggcatttcgatctgaaacaactatgctcctcttaaggaaagcacataaagacaaaacccttggagttgtttgtgttcgagtatgttctttgacacttacatttttctttttttcttatatgctctttccttatggaggattgacatccaattgtttattttaacttaggcatcgaaggtattgcaaaaactgttggagcctgagccatttttagacaaatcgatgtatactgatgtcatgctaccaaaccaagtctctgatgaaattcctaaaagcgatgctctcagcctagtacattctacagactactccagtatgtttggagaggaatttagcctgtcagagaatcagtttgatggttcattactgaatattttggatattgctgctgtggaagaaggcattcttcatgtactatatgcggctgcatcacaggttatctatcttatcgttccatcttcatatcgtccaccatatacgtaccattctgtttgaagatactaatgttttcttggtttataactatagcctatgctatgtcgcaagcttgctgaaactacttcagacatttggtctgtcttaccacttgtccaagctctacttccaggtaatgactgtgctgtatacatgttttctttactactcgtcattgaaatatacaataatttgaatgattagaatgttcactatgggtag

SEQ ID NO: 4894 - DNA, 1074 bp, Zea mays
  misc_feature (1)..(100): optimal_loci_194905_G1, chr5:145220061..145221134, Cluster 30
catgcgtaccgtatcgaaaggcaagagatctgtgaaaaattaactcaaacttgacaagtattatatttggttatggacatacttcctactttttagtggggtgaggtggtacagtatgtgttttgttcatatgtacaggtaccaaactcatgagtttagttctactcatttggcccattttaacaatccaccatggttgtcttgctaaaaagcaagttcataaggttattaaaattgttttcactaacaatcatagcttgtttcccatactctaacttctcggtataaaaaatttaaatcaaagcaagccactactacatgaatcttaacacaatcatttttttgtttatcaaggtaggcaaagcatccaccttcatccaaaggcatgtgttaacgcagttttaaaggtccccgttaatgtcgttaacataggtgatctccttataacaaccacctatgttagcaaccattaacgtaggtaggcgtatttagaagtccgcctttgatgatatattaatggaggtcacccatcttatgtctttctcaattaattattttagtctaaaaagaatagtttcatgctatttgattcaaattcaatttctatattcatgatttcaacacagacaattcgttattattatcatgaacaacacaaattacatgtcatatacatatgaattgttttgttttatggtcttctaataaaaaaatcttcaccatcttataatcttctagctatagcttgtcctagttttttatcttgtcgtacttctcatccaatgctagttttctctcgtgattgaagaacttttgtcatacccaatttgaaatttgatagcctaccctaaactattataacagttgtgctaatagttatcagcagcctatgcgtactctcggcctagtctgaatgggcatctcgctaaacaatgtgtatccctatgcattctctttgcctagttgataggtcgagagtatgcatactctgggacgagagtttgcataggggtacaccaatccaaaaagccccctatatatattttgaaagttgacagactactcagacgttga

SEQ ID NO: 4895 - DNA, 1188 bp, Zea mays
  misc_feature (1)..(100): optimal_loci_197700_G1, chr5:160826767..160827954, Cluster 30
aaattacatagttcataaaaataaccaatacaatattattttttatcggtatctttctcttccatcactttcgcgtcttcttcatcatctaattttaattacttgatcaaccttttatggccaacttatgagctatttttatgtcattatctatgccaattgtcagcggtatagagatccatatcgaaatagactagtagagcgtaggaggctacaaatagagaagaaagtgaattagagagtgaggagtgtgaatcataaacaacctcctttgtttatatggtagattggttaaaattgcatcaaccaatcagaatctatcaagtcaacaagaggtggtcaccgatggaggttggtactaatccacttcatccagtttagttctaccgactagaccgaccggtcgatagacccaccactcgtttgatcgataaacacagatttatcactggaccgaactaactattgatagagcgttgggtatcgaccttccatgtcgcaacggtaacaggctggacagtcgttgaacctagcttaaggctatttttagcatccttttatctcatcctctatcttactattttaatctttattttgtaaacaatacactttacagtataaaaatagtgttttatatgtccatataaatgctagtcggcaggacgaggaacgtccaatgctgtccaatcccagcaaacaactgagcagatcggggatgagatcccagctgataggactcgccatgatcaggtcccccctgacaagagcacagcagataagtggataagcacaccggggatctttgtctcccgaatgccgtcacatcgcttcattgtcgtcccaagaaatactgggcccgtcttgtctccgttgctagcttctctccaagacatgaaacaataataacacatttccacgacgagctggtttggtacggcttcagcttggactatcactcttgatggtagattcgttagaggggctgaagaagaagccacattcaggggtgtttaggataactctaattttaaaatgtttttaatctaaataatagataaaatgatttactaaatatcttgtaaaggcttgcaactctatctttatgattttctgtagcctctaataacatgtttcatcaacttcaccatttttttagagctagagttgtcttaaacatgacctaattga

SEQ ID NO: 4896 - DNA, 1197 bp, Zea mays
  misc_feature (1)..(100): optimal_loci_199079_G1, chr5:168529907..168531103, Cluster 30
gaaataacttaataattttgaattattttgtgatccttataagtcattttagagtacgtgatcaagggctgagctggccgtgaaaggtcatgaatgagcctcgcacatggttcggtcttctcggatcgtacacgggtttggtaggacaaacgttacaggagcaggccgcacatggtcaggtcttactgtcaatgctccttgagatccatgtcccaaatctccgtgacaaagaagatacataccacccctcaagtaaaacaaaacattcatacagttgcagcggatgtccagatcttgatctggttcatttgattaatccactaaattttccgttggcatcagaaatgtgcgtcatcgtccggtccacgttgcgtccatgatcagtcagccccctgattgtttaatttatctgatcaatccaaaggaacggatgacctgcagtcgtgcacgatcaagcctgatccagttggatcaattttccgttgccatcagaaaggcgcatcatcgttcagagggatccagttgcgatgaggatgcagcttcagcgttcagaggcggatcagcaacagcaataacaaactgcggcgctctcggttttcaaaaccctggccaattcatctatagtctaggacttttatccctaatccatgttttcatatgcttcctattttgtatggattcccacaattgaaaatgttaagttacaacaatctagactttggcattagctagtacttcctctgctccgagttataagcacttttagcttttctagatgtgttattatcttctatttcagtgaattggcactgctgctgacattttctagccaataaaagtatatggccaaaagcgagcaacagcgtcatatttcaaatgtgcaaaaaaaaacatcaagcttatcagccagaagtaaccaactaaacaaccaaagcagagcaaacagggattcaaatccttaatgagttcataactactcatagagcaatcttgttgaaaaaacggtacacaattcttcagattcaagctttaaatagcaagctctagttaaggaatgataacttaaaacaacatcatgcctatgaaacatcagcaaaaacccagcaagtaatatgactgtacaaactagtaagatataagtgtgattatggccgcttaaaaatctcaacacatagcctctgtaacaagggcgtccaa

SEQ ID NO: 4897 - DNA, 1400 bp, Zea mays
  misc_feature (1)..(100): optimal_loci_199812_G1, chr5:172584020..172585419, Cluster 30
  modified_base (30)..(30): a, c, g, or t
  modified_base (31)..(31): a, c, g, or t
  modified_base (32)..(32): a, c, g, or t
  modified_base (33)..(33): a, c, g, or t
  modified_base (34)..(34): a, c, g, or t
  modified_base (35)..(35): a, c, g, or t
  modified_base (36)..(36): a, c, g, or t
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(129): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
caagcttgtatcttccggcggtcatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttgtgattacagacgatctgagattcgtctgtcctccccgaccccgcatattctattctattctattctattcagccggttctcgcttgtcacttggcatgaagagaacgaagcacgcagacttgttcgctgccagagactttttcttcacccccccgaaccaattcttcaccaccgggcgttatttgttcgctgcagcttgcaccggatccattgcttggtcagagcaggtgagccaaccacgaaagtcactcggtcgctacgtggatgtacatatattattatcataaaaaaaactaactgctagtctgggttagctcgcctaataagatgttagtattagaaaattaggttatcatgggcaacattgaaaagactacctaggggcctcacccagtttctaagaaactagtttataaaaattgagatggttgcaaacatgtcagtttatgtctcagtttgtagaaaatttgattctcattttcttaaaaaccaagatgctggtatctcttggctaaacaatatataaaattcacaaaatctgggtggtccacccacaactagctaggggcaacattgaaagttaattactagtgctttcaaaagaagtcaccagcagctaggaataattcgatgaggtgaaatcgattcttttttttcctggacaatatatttaccgatgatacggaaagagtttaatctggaatcaaaacgacttgcagctagctgagtagcatgcatgcatggtgttcatctcggagaggattcattattacgtacgatcgacagaaattaaagaacgtggaggagctatagagagggagggaatatgcatgcatgcatgcatgaactcacaataatgtcctgtccaagcggtggcgtttctctgcaacggcgcaagcgacgaagcccctcatcttgatgcgccaagaggaggtgtagctagctagctagctgagatgaacaaaatcctcggtgtcgcctgatgatcttgtgcagcaacaagcagcaggaaaggcaagagaaggcgagctttgtcgatcgtcgtcgacgatcagtagactgactgtatgtatgtatatatatggtcccttgatcctccggcaagctatagctatatatgtggatatgatcaacccttgtatgtatatgagagagagagatcgagttcagctgttgtgatgtatatatatatgcttgcaacacaggagtctcccaagtggcaccaagcagcaggggaagagagacctgagaggacaaaatgcat

SEQ ID NO: 4898 - DNA, 1042 bp, Zea mays
  misc_feature (1)..(100): optimal_loci_201729_G1, chr5:184053105..184054146, Cluster 30
ggacacctctacctaccagattccctccacgctttattaaaaggaattccataatatgtctccttgatatggtacgtagatgttaacgcttttccttataaatttatttaaatttggtatagtttaacctagcacaaacttaggttacttatattccgcgataaaagtcgtacgtagtatatattagccgtgaacttatgtggacctaaacggattcctcaaaagagagaccagtttcacatggcgaagtcacgtatgcaccactgcaccagagcactccggagtactccagaatatccgcgtcactccataatccagtgcgatcctttctttgccccggccaccgatgctgaaacgctaatgcaagaccgcgacatcgccttagcacttcactcatctccatctcttaccccaaatttcactctataaacatcgccgtagcatgcagcacaaacaatattttctatggatatatacctgatctgttggattatagtcttagactatcagttactcattttcatatctcattactctgcaaacattaccgtccacctggctatgaccttagcctgtcgttgcagctccttgctccccgggcgtgtccctgtccatggagggaacacacctgttggcgtcttcggactcgagatgtgcgtcggagacccagcagcgcgtcactgtatcggcctttggtggccttggccggtttatagctagacacgtactctgcattggagaagggcggtcctctggatttcttgtacgttcacatcttgttcattcagatccagtccttctagatgcagcagatctgctgccgtctgacaagaacctacgtaatcgcaacaaacaaaagatgtttttacacgcgaaagcatttacgttttagttatattaacgacattgctagattattatggctaatatatattttatagaggtaatataaggtagatcatgataatgttgattgatttaaagtatatggattttattccttatctaagttattcattttcgattttaaaggatgatcgag

SEQ ID NO: 4899 - DNA, 1052 bp, Zea mays
  misc_feature (1)..(100): optimal_loci_202022_G1, chr5:185658716..185659767, Cluster 30
tcttctattctacttttcaaattgttggtccatgccattgtaccttgcatactagttccataaacctgcaccatccttttctacctccaccatccctgccaggattgcagtggcaacgtacggcggtcatttacccatgttccaaccgacctgatcctaccatgtgaccatacacgagctggatgatatgatatggaaatgacggccatcacgtaactacatccagagccttgaatcttgatctcttcgatcaaagcatctccttttcaccaagtgttacgatcaaaggatggcatggaccaacaatggatcgataccctttcaaaaaaatcaatggaattggtaaacaagttaataaaacgaggaaaactggaaaagttgagttggaagaataggttggagacgactgggatagatccaataagaagaacccagctaggcagctaagctaaaaaaagaagaggaggaaacagctatgaatggtacggcacggacacaataatcttaggacagtggcaccaccgttcatccaaggtaacgctttggcacttccaatgctagtaataataccagcagctataactgatcctgacttgcatcattgtacattcaactgaattaggaggcttattggtcgtccaaacagctcccgcaccttccaattcgaagtttcttgttgagtacagcatggttgacttgatactagcatctgtaatggaattccacaagctgagtaggctaaaaatatggaactgccttctgtgaatctgaaactaaatggcaatagatggcagttttgttcggtccaccttcagcttctcctatcacctttccttttttacacctttgtactgtagtacatgaaaagaaggcatacgtaatcaaatagtcactctaaataacaattattgctaattaccactgagcatatatgtttcgttataaccagcctatgaaacaataacgtaattgtggtattaccaagtgtgagataatatcaagtttagaaagtatctgggagagatgagggtaaacttgtgcgctcaactgca

SEQ ID NO: 4900 - DNA, 1059 bp, Zea mays
  misc_feature (1)..(100): optimal_loci_202127_G1, chr5:186233325..186234383, Cluster 30
actatacttctatcattctctcccaataattgaggctatgtatatctgcatcttccagttttctatgtgtgaatgaaattattaaattgtgtcgttgctttaaacatacactccccgccggtcacgaataactgattcttttgagtttgtctgaaggcaactttctaaaaagaacacttgatgaaagttcaagacacaaatctactcatacatattgtgcactattcaaattcaacatgcaaaagacattttgttgtcaaaatttagaatgtatatgtatgactttagttcatactactccatttatttctcatacaaggagtaatataattcccggtacagctacacatggtgttggcatggacaggaaacatatcatatttgaattatcacatatggaggaactttgaactttgtagttttttctattacagattgataacagcttaagaaagtaaacaccaaaatatcacttcacttaaatatattattatgctcagagaaaatttatagaccttacatattatttagcatttaaatatgcgtacacataagaagctaaaacttgtcggtcaaaatcagcaaatagcacgaattaataaggaaaaacagtatataatataaccatatcataagcttataataaagttgacaaaactcaattattacaatctaaatatttgatttaaccgaggtcaattaccatgagtacaagaatcaataccttgcttaagttttcccttagtcaaagaaaatagtcacatttgatagataatatctcttccaattgaaataccatcataccatataaagtagtgctaccacatttctgattatagtccaagcaatgagttatagaaagataaatggaagtttattgtcaattttgaggtaaaccattggcttaataaagcatccagagaaatacaattttaggctggcgttactctagtttgtgcatacatgatccgggtagccaattgttgtactttattttaaaatcatgtaacgacgggctatgtgaaatgcacttttaccgtgttcaatatatttgatact

SEQ ID NO: 4901 - DNA, 1345 bp, Zea mays
  misc_feature (1)..(100): optimal_loci_202629_G1, chr5:188899619..188900963, Cluster 30
accacttatcgtgttcctctatttttagatcaagacatagtcatatattcgtttaaaagagtaaataaatcagagattgctacctataaaaagtcgttacgttgttgtcaagggacagagaggatctagacatcacatctacgggtttatattacctgaacggaggtaaaatgagatgcgcaaaagaaaactaaacgacgccgactggcgactgcaatcagagcacaaaccatacgtatcagcctgacgacggcacaaagattttcgtcgttctttaatcctcgtgcatgtcttttccatgataaaaacgtcctaccgcactcagtgcaggaaacttctattggcgcttctaattatttgttaccagtgtactactagtaattactaattagagccagtaacacgcgtttggattcagatagcagacaccaagaccggcttggggcctttatttggtctaaaaacatcgtttatgtaactgtaagtaacagttgtgttactttctggctgctgggagccttttgggtcgtgtccagtccaggtgtcctcgtccaaatgcaagcagaagtcgtccaaaaaatttgtttgtggacgggtaaaactgagctgtggcatggcgcgcacctgctggtcgctgttactcctctgtgacttgagaggtacataccacccggtacttttgtaagtacgccgagatatagtcgttatactgacgaaggcgggataatttttttttttaggaaaacaagagtagtagtatatatagaacatctgtccgtttcaaagattattactgtaattaatgagttcttgttcacggtaagattaaacgttctgcgcgttatcacactaagaaatactactctgggtggtccgtatagagagtacttactctagtccagggcaggttccttattcaataattcaaaaccatctcatgcatgcacgtttggctagctcttacgtacgtcacgtactcctaataagaaatacagtacatacagcagtagttgagggaaaaaaaaaacagattcctagctacgtacgtagtagagtagtcacgtcagctctttcaggtcgtcgcaagcagtattcagtttccagtgcgaaaagcaaaaccaaacagcttgactgacttgagagatgctccatcctcgatcggtccagccagtccacgtcccgccgtctcgtagcaaacagcctatacggccatgcacatgaataagcgctggatcgtatgttctcaacttctcatgccattagaacattcacacaattctcttcttattaacaactcatatacgatagtaccgtggtttgtttcactgttaacccacgtggattc

SEQ ID NO: 4902 - DNA, 1045 bp, Zea mays
  misc_feature (1)..(100): optimal_loci_203182_G1, chr5:191987118..191988162, Cluster 30
ctaggcaatggtggaacgtggcacgttcatcgagacttctttttattgagttttcttgttataccctcaacttgattatttaatcactaatgtaattacatattgatattttatatttttatgaataaaacaataacacaattgctatattaattttaatctaaatattttttaaaaaatattattatcatatcatttgtatgcaactaaacagtatatgtatccaatatacataatttgatacatgcaaccaaacaaaaaaccctagcatgagttcaacctagccctacttagccaggctcactcatacgggccagattatactcatatacccaaccaattaggctctagtaaactagaaaacattaggctagaactctcactacatagggcaagagaactaaaaggtatgatgttgatacttgagcttataatcttctcgacctttgtgttcgttaattcatcatatatcaaagaaggtattacatgctctacaagctctctaaactatactcatgccagtacctacacctagatttaacatacgtttttagtacattaagtactcgactatcataacatgatgataataagtatatgacaagttgtccatatattatgttatgctgttgtagttcccaaacatgcaggtccgattctagcgatgagacactatcactcttgagcccttagagcctcaccaaagtctcttaaatttaaaatatacataagtataatctcattatatattttatagctttctcgttcatcggtttgaatcgtgtcggatcaaatctcgacactattataaataaattgtgcatgggagtgacctgctaaatacgactcatttagttatctataacccgatcgcggggcaggaatggtgtggtgggtactgggcctttcagtttcaggcatgctacgacagtttgactgttcggcatgaggagtgtgtgtcggccacttcacttctctcgagagtcgagtcgctatgtatgaattgcatgccgataccaccgggccgctttcgccagcttttagt

SEQ ID NO: 4903 - DNA, 1385 bp, Zea mays
  misc_feature (1)..(100): optimal_loci_204305_G1, chr5:198303967..198305351, Cluster 30
cttgggcccctgcagaatcactcccagaatagtggatttggtctcctgggtcgagtttcctggagctaagcatctttgctgccggtaccacaatagatctgctggcttttggccgtcagcaggagcagaaggctgttttgatggtacatttgtttgatctctagtcttaaagccaaaggtcaatgttctgtgctgcaaaaggtgcactggactttctttatttcattatcaatgtcctagttctgtagagggcacatgtctcttgtccctccgtacctatttaggtatcactatagattttttttttcaaattaatctataattttttaataatacttctatctctaaataaagttattataaaataaattcaacaatctatttaataatactaattatgtgttataaataacatatttatttgtatatttaattaaagttaaatatatctgacttctcacagtacacatctgtaatttttttagttcatcttgctccagtccagccataggcccatagccctggggcctgggctaggtcctctatctgcttgcattggacttgagaaaatatattgccattgcagaacttttagcctctactcccatgttgctctattctatattaatatatggttatcttaatccagggacatggcgactaacagaagtccaagattcctttctcatggatggatggtcccaattgagttggacgttttcggtgggaagcggacaaaccaaagcaggttcccgtttgacacctaaactttcttatacaaaattacttcttgcaagaccttttccaacataacacttacatataaatctgcatccttctaaccctaacgctttctagttgtctgaattgtgcccatattttgaagcacatgaaagtctattccttgtcatgggagcaatcaagagattgcttagatcactagctcactgttgaacgttgattggttggcgcgagctttgcttcgatcgtgaggagtgggtgatttgatccattcatcgcttgttctgagcattcggggactaggttgtggcaagacaaaatctgattggaagtattgatacaggttgtggcaagacatttttttagttttataatccctttctcgagaaaaaaagaactacgtgttctgcacgtgacgtacgacaacaaaaaaaactggtgctttatagtaatagaagacaaaactatatctaattcattctctatgcaccccgcagctccttgctcaaaccagagcactggactgaatgaacaatgagaatagctagatcgaactcagcaattgatatctcttaaacatagttggctctaagaaaaaattctgagagcgctgtgaaggggcgtggccagggggtgggtctggc

SEQ ID NO: 4904 - DNA, 1119 bp, Zea mays
  misc_feature (1)..(100): optimal_loci_204363_G1, chr5:198786109..198787227, Cluster 30
tcatctaggaaacaaaactccctagttggccaagcatggaagcgtcagtagaatatggcatacactagacttggtcctacaaccgagtagccccaaggagtatggccctagaaccacatccatctctactcaacataagcatgtggtgttggtgatctagataaggctcttgtatattatattaaatgtgatggatggcatttcaatcaaggagcgaggtaagttgtagacatgacagagggcaacatgtgtacctgaggccacggtgtaatgcatgccacttacactgtaaccacgtctgaatatgcaaacatacctacaagcattataaggtacaagttgttatattgtttactgatatgacatacccagcggcgtggactttagtacttgccactatgataggatatatgtgccactgtagtaagacatgttgaacactatgacacatataaggctcaccacaatgtatgactatacatctacgacaatatatgagtagtttagcctctactgaacatgttccattgcctaataagcatgtatcactcgccccttccttgacccgtaaaaggaagaggtagatcaacgtagaacatgcttttcacttccttgctacgtacatcctgactcccaacttacaagataaacatagtcgaattagggactgattagctaaaacttcaccataaccaaaaggatagggagagctagatagtcatcgacttagtgatatctaagcttgtatagtcttcgtcatccgttaattttagcaagatggaaaaatgctatctgataattccttatctcaactcctaatctttctcacttgaaaaagtcaatccaattacaagaaaatatagacactcatatatgtcgaccaatctggacatggggaaaagaaaaataagtaggacatgttctcaatgcaaatgaaaagagagagagtgttaggataattcgataaaggaaaaaattcttgatgtaattttttttctatatttaggaatgagattctagaaactattggaggaatccaacaaatatgcttcaacttttttagtcacttaataaaacttatcgatataccatttttaaccattggagatgctctaaatc

SEQ ID NO: 4905 - DNA, 1122 bp, Zea mays
  misc_feature (1)..(100): optimal_loci_204855_G1, chr5:201405973..201407094, Cluster 30
tcaattgacagttcacaaacaaaacacatgatttcatgttctaatgttgttatctacaattgacttgttcagtcagggtcaacaagttcaacattaattgtgcttttagatgttagctgcaatccttttcttaattatcatggtactccacataaatccaaacgaaaaaaactcttactctgtttctcaatcttttgttctacttgaagcttctaatgtaatatgcaaacattcattgtttctgctgactttccaaggtctctgtataactgtagtctgtaagcaagatactcaatacaagcatacaaaaaaggctaactagttaacatctgataatttgaaaatgaataatgatatttaagaataattctcaataacctgaaaatcatatgcttttgaacaacttgcaaaagagagaagttatatggtgctcacaggtttagtctgttttgaaacagagccatattaagtccaatagaaaaggtgtaacattttcctagagctacatcaaaggtactaaacaatagagacaaataaaagcaatatactgaaaattgctgttagtaaccagaagacctgttcatatgaagggctaactcgccaaaccaagccaagcccaagctttattgggactagccatactaagcttgaggctaggcagagatcctagaaaaccccatgtattagttttggataaaaattatcagcgttttccatataatattttcggaacggaacgtgaagtgcaaaacattttatttgttgtttctcgtaatatattggtaaaagctaaatcatgatgggcctcaacgacaattaaatcaagtgacctagaaacaaccaaaacatctaacgatggatgcttggataatcaaagtgcaagggaaatgtaagagttatggagcacaatgagcagggagcaacataatgtgagaggctgagtatcacatcatgcatttttttgtctatgccattctgaataaaatgttgtgcagcatggctggaagactaggtcatgctgacatatattacctttgaaatggccctaggcccctgcttcccacaactagaaggccagactcttcacttcgctgtggataacctcttttggatccccgtgtc

SEQ ID NO: 4906 - DNA, 1081 bp, Zea mays
  misc_feature (1)..(100): optimal_loci_205268_G1, chr5:203944023..203945103, Cluster 30
ttagttttgatgacgtgtaggacagtgtggacttgtttataggttttcccgtacaacatggcatgtcgacctgttaactggcgggaataggggatttattgaggagtttggtgccaatcttagctgaacactaacagggggcgacggtgaccgggtcgacgaagcgtgggcttgggtgcataggaagaggagcgacagtgaaatggagttgtcaagcgcacggtcatctccatggtccaagggaatcagatgcattagtcgtcgtttggagttgaaagaactgttggtcccatacaccgaggggtcgttcgaccatgaacctgcagtgttttgctattgtggatctaaggcagcaaagctgacatcatggatcgatgacaacctcggccaaaggtacttccgttgcaggggagctcgggtaagtgtttccattccagtaatatatattagggtttatggttaacaatgtgttattcatttgttttgagtttgattttgatgaagtcgactagggaatgtgtctatttcatgtgtattaatcgtgagtacacacaacatgaaagaggaacgctattaaatctacacaatgcattgaacaagttgaagcatgaagtagcagatctgtgtttgaagctagaagatgtggaaaagattaatggtctattgatgaatcaggttgcttccaagtcttaaccattgcaagaaattctgaaccacaagaccgaggggaaagaagtgctaaagcacaaggctactgtaggaaggtcatgcagttattcacgttgtgtttttgtagttcgtgttatggttttggtgtttgccctcctgtcaggtgcagttagtctaggatgaagtccatattctactgatggaagaatgtagcgaagaattggttaatgtgtattgtggattttagtttgtgtgaacggtggaatacataaagtgcaggatcacatccatttcttagcatgaaagcattaaaggccacatcacttagttcacaggacccattaactaaaatccacttggttcacatcacccattaacatcacttagttcacatgacccattaactaggaac

SEQ ID NO: 4907 - DNA, 1055 bp, Zea mays
  misc_feature (1)..(100): optimal_loci_206682_G1, chr5:211353348..211354402, Cluster 30
aaacttaaatggcaactcctttcctgcaatgacagagataaacttgccatgtaaccattaaggaagttatacggattgcgatgacaattttgcatgttgttgcaattgatgctagtatatataatcgaggaataatagtagaaaatttttcgtagatgcatttaaagtgaagaatttgaaaactacagtatcttttagagaacacttacttttttgagtttaagtgagataaaattctttgcacggacctcaatatcgaagtcagctgcccctttcctttttaaatttagaaaatgagcttgttttttatgagttccagcagggaatcataatgatcatatatattgttgagagaataatattatgcaatgaaaatatcgcttgcttcaaattatgtttaaacggtgtactgtagaggtggcaatggcgtttttttttgcatgttgttgcaattaatgttggcatgtataatcgaggaataatagtagccgaaaaaatagcattattgcagggagcacatagcgtaattgtgtggaagcaggtacatgtacatcttccagttgttgttcacttgtaggttttgcataaaaactaaacctcttaatagatgcactaaaactgtaacttttgagaataacagtattttgcatgggggttttacctgttaggaccaaggggccaaactgatatacacggattgtaatctcgaacactaactcctttcctacaatgacaaagaaataaacatgttatgtaatctcaaaggaagtggtatatagatgacaatggcaatattgcttctttttttggcatttaatgttggcatatataatcgcacaatataagtggattcgtagatacactaaaattggagtacttgaaaacgacagatcagaaagggcatcatagggccacaactgagatttcggtgcctaaggcctaaggcgaacataaaaattgaacctcctataagtataataatttttatatacatatatatatatatattcttatattatatcgacaacaattaatgttgtatccaaatattataa

SEQ ID NO: 4908 - DNA, 1018 bp, Zea mays
  misc_feature (1)..(100): optimal_loci_2085_G1, chr1:10895950..10896967, Cluster 30
tttgaaataacaattgttctagccaaccattcaaaaaacccaaatctcatacaagtgatgcccatgagccaattaatggttgaatgttcttagtgatgaccaagtaatacattaggacactcaccacaacgaatagtcaaatgtaacaccaaaactttcccaaacacaaaaatggagttctccacttcaaccgtaatgaagtaagaaactaactcaaaatcctctaaggtaattggtgattttaggattgagaaaagttcctaagcaatattggatacccatggaacaagtgaaaaaaagaggaaatcaagaaaacaattcaaaaatcaagaaaaatatatggcacgaaacttctgcatttgagcgtggaagttccatgttttagcgcggaagttttgcgtaacctgttttcaagagctcaaaccaacaaaaaactcaaaacaccatcaaacagagtccaattaaccttaaattttacacatatgtccattaagtagcttagaagttctccataaaatttcatccccaaagattagcaaaactctcgagacctaaagaagtatgtaatgggttggtgttttccaatcttttctcaaaatttggctaaatcatactcgtgaggaatctggccaaacaatttggtagatatgttcctctaaggtacttgcatgtttctagcaattccaatcggtctcaaaactccagaaacataaaatcactcaaaatcaaagattaagatcaaatctcaagaacttagatttaccatgaataattgttttatttcttgaccatacatctggttctacctgaagaatggttacgggaaaaaaacacacaaagagtattgttttcccgtattgtagatctgaacaacagaaaattagggaactagagattgggaaatctaaataatgacaaataaatataaaaatggaagagaaggctagttggaacaatctcctatcttatttataagctattacaagttcctaatatgatctttaatattttggttgaa

SEQ ID NO: 4909 - DNA, 1279 bp, Zea mays
  misc_feature (1)..(100): optimal_loci_209241_G1, chr6:9154541..9155819, Cluster 30
agcctcgtggtcttagtgtcctgatgcctgtatagggactttcaatgtgcagatgatatcagggccatataggtagtactccaccctcccctaagagacctaaaatctatcatgttgttacatccaactacttagagcaatgtgaacaacatctagtatccttaaagtgacaaacgactatgggatgtgaaaataagggttgatcggctctgttgatgacaaacttggtcatttatgtgatgttgtaacatcgttacatcaagccatggattggaaaaaagcatactgataaagagatgcctaagagagtgccaatcaaatgaattatgaccttctataatcttatgcttcctaggtaatcgtgagtccttcagaaaaaatttaggaagagatcagaatagtgatgccaacttttttttaataactttaaataaaatagtgatgtacaattattgatagccacgcaacatctcggttgtggtatggcaactgagatgatgagagaagcttaaaagtaaaggaaaacttttacacatggtcgccattgacatcaaaactttatctatatttgaggaaaactttgtgaccatcctagtctgatttactcatgtcgttgattctagatagatataactcaaacttcaaggaagttgagaactttctcgacaaatccttgtaaacggtgacaatccttggttttctgatgactttttttatgtaagatgcattgtgcgttcatgatcatttgaaactcctcctgcttaggtaccaacgactgatgtcgagccttttgctatgcttttgcaatgacctgatggtatgtctttattttcttattgtcactatcatcgaattcggttcctaatcctttcttctctgtctttttgggatgaaagttgtcattgaacttctttgcccactacatacatatgaacaatttgaaacatataggttagggtgataggagtcctttgagtgagcttctgaaccaagttacagtaattaagtcccttttagaaaatacatattaatatcctttcgaatatgttggaaataatatctttcatgttacgatgtaatcacacagggactcatcctccatatgggcaacttgttcaagatcatgttgagttattgctcggtctcgattcatgctaaagagttagttcttcccatgagttaatagacttagccaggagtccgaacaaccacttccaagtagaaaacctaaaccatgaaggaagataatttgccatgatggaagagttttctcctacta

SEQ ID NO: 4910 - DNA, 1103 bp, Zea mays
  misc_feature (1)..(100): optimal_loci_209973_G1, chr6:14026105..14027207, Cluster 30
gcctgatgatgcttgctcgcgctgcctatatttatacacatgagctttttgctgtttagtagtagtaagtaatttcatttctatcaccattcgttttaaaatatatacactacgtggtttcagttttgtactttgttttataactcgaccgtatctacaatactatagacatatttttttatagtttattctaacatgcaagttatccacgtcattcatactgagtatccgtatcatctcttactaatagccatgtcatcccactaaatttcaatatcttaattgcaagtatccatatatattatttcacttaatttcattccccgtagcaacatgtaggtatcttctaattttatataaatgctcaacacgatacacggtccaacgatcaaaaagatacgttgacacagtgtcctagtaaatcgatgcaaagcactcggaccatgaaatcacattcgagaggggtcaagagaatagcaaagtcaccgtcaagtctttatgggcttgaccaaaacacaacgacgcaaaactatcagcgcgctggtggtaagaaaatcaaagcaagaagcctagagttacttgaaaaatgaccgataaacgatagacaaatatggctaatacatgtatcgccttttattaaaacaaaatagttttttttaatttattagaacaaaatagttgatggcttcacattgttgcttttgtcatgtgtttaaaaaaaacacaggagggcatatgttcatagcaaaagggatcatatgaggttatatatatttacttgggaggtcaagatttcggaagttccaagttgcacaggactcccaggtctcaggagtttggttgtgcgtcagaagtttttaagctccctatcacagtttagatattctcgattccaacctagcgaacggacgctagatcggctagtctagtcctctcagtagcaccctcgcggtgcgtagtttgagccctaggtgtggtgcactcgtgtgttcttttctgaggatttttcacgtgtgaggtaaaaaaatcacctcgtttgccccacgccaaaggacaggtctaaggcctacattaccttttatcttctaccttaagctcttcca

SEQ ID NO: 4911 - DNA, 1166 bp, Zea mays
  misc_feature (1)..(100): optimal_loci_2144_G1, chr1:11133608..11134773, Cluster 30
cttgtaagatattcctacaaactttgagagaagtggctgggtcagtgggtcttcatgtttttattgtgtgttttcgtttaactcctgcaccagcaacttgtaaaacgtttatgattttaccccgctattttaaaaatgaagttacagtttggccttcactctcaacgccgttagtaattagtgattaaaaataaatggatgaaaggtacggagtaccttccttcagttttgtatggacgcaaccccaataaaggtaaaattataatcacataatataagagaggtaaagacacaataaattgtatgaacatttttgtcttttcgcatcagatttaacacctatacgtaacggcacagaagtatgacagatcgaacttcgttttcgaaatgaaggggtaaaatcagagagttgactatagagaagtaaaatcacaattgcatgcctagaggggatataatcacagatgcccctaattaaaatatgcaaaagtacatattaatttctgagcatgggtgatggactaggatgtctaattcgttttgtatctgctcaatgaaaaagatgccatgcttgcacagtttaagcattaccatatccaccgcccctcactggcatgaaccatgttctccagctgcgcatctcaaaaattatcgatcgttttttagcagattctcacaccggatccaaaatctctagtttcatatcagtatatcacgttcactgatttgccttggaatgtcaactactcaataggagagaagtgtcaactactgccgtcgaacaagtcacagagactatcgggcatggcaacaaattgttaaagcagacattgaattgaccgaaacaaaagtcaaagggaaataaccaagtgataaggagattccgagcgtttttttttgttctaatttagtttttacattgatactgattttgttctgtattcttggcatccatgacctatatgtcctttgagtgagtgaagaggcaggggatacttggatggcctaacctttaaagacgggataactggcgaagcatatattcagaggtcttatcacaatcccggatgatagcttctcaagtcagaaattacgagaccaaaagagtagcggtgagttgccgcgtgtgaaggtttacagcagtgacttgcagtgcgtttagttta

SEQ ID NO: 4912 - DNA, 1226 bp, Zea mays
  misc_feature (1)..(100): optimal_loci_221239_G1, chr6:88082289..88083514, Cluster 30
ctactaattattagttttgaggtttggaacatgacttaaaatccatcatcagacattctgtaactttactcttttgcattaaagttaacatgatgccaaatcatatttacaaagttttaccttaaaaacaattgaaggataccgagttcacaaaattggagtgacaatgaataatattagatggcaaataaaattaataacacctcaattcagtgtatatctaatggtttaacgcattcgtgtgacattagtcaaaatcattgcaccatgcacacagacaaagtaaaaccaatacttcaatatttatatctgtgtttgtatccatatctatatctatatccatatccatacccatatctatatctatatcatctatcatctatatcttatgtatatatctatatatcttgtaatttttaatatccaataatatcttatattggcatgcatattgtccacgttggcatccactagcacatgcggttatttgtttattcaatcttttttcacatcattaatcaacatcatttagttatgtacatcgaagtccacatcatcatccactatcatgcattatggcatttccttatccatataagtaaatataagtgatataatttatatatggtccatgcaacaatgtgtggggtatctttgtagttgttttttatgtggtgagataagtaagcctttgggttagattgttaacgaccactaattgatagttattgtctcacgcatagaacttggatgtacatcgtgaaaaccttgagcatgcctaacgttgaagcaccgtgattatttaaaatcaaattgctgataaaaataatgaggtaagatctaaaacaagcatagcataagaagtggatcgtcacaacacaaaattaatctaaaaacacatgcattaagacatgtttctaaataaaatatatttatgtatgaaaaagtaggacaacattattgttatatagcaataataacatgactgatgtatccgataaatcgatatgtgcaacgaccataattattcaaacataaaaagtcaacaagaacattgcattgctatattattacgcgttccatgtctcaatgaagcatacctatgcaaccatctttctgacaaacacaccatatctctgccacatatcaggtgcaaccaaatcaatagtggtgggaggacctgggcgctggctgccgacgccggtggtggtgaccgacaatgtggc

SEQ ID NO: 4913 - DNA, 1060 bp, Zea mays
  misc_feature (1)..(100): optimal_loci_222501_G1, chr6:95938400..95939459, Cluster 30
gaaatgcaggtccctttcgtcaacaaaaagcaggatcagtagaaagcgtggctgggtcaaaagtgctcagagtgggtcccgtccagtaacaagttagatgtctggagcaggctaaccatttttttgccgtagtccagggttgctgagacaaaacaaacatgtcagtgtaaagcattacaaatactctgccagtcctaaaacaaatgcacatctcgcatttatataaatcaactaatttcaagtttggctagatttatagaaaataatattaaaatttgtgtatccaaacaggcttactaaaaaatgtatggtttgattaatttgatggtgtatatttgtatcatgaatattgatatttttgtgtgtcctgtatagaaaggacaggctcagtgctactgactcccactgccccacatgaacataagtctaaaagaaataaccgaggcatgttttatccttgcattttgtagaggatgcgtccgacctaaaaccttttctcaccactatgtcaagcctatcattttttctgtgtcattgtatattctaagaagataagatttcagaatggccgtacctccatcctgattgtcttttatatataatgactaaaacatcaactgtattttcgtcaggactgttctactagctcctacgacatactccgtatacaattgcctggctacaggtgatttcagattgaactgtattgttggcacttattccaggcaggctctgagcctatctccagcagatccactatttcaaactccaccctgtaagttccgcatctcctattttaccttatctactagagagtctgacatacatagcattattcaataatgcgttttttcaaaaactattattcaagcatggaattccaattattacaaggcaaagcttgtgctttaatttgttcctccaatacaatcgacggtctagagagtagaaactcagataccatcagcacagcagatccgtgttgggcactaggcttcacgggaaagacaaccaagtcttatcttaaaaacaaagggactcgtgtaccgttctgctgatt

SEQ ID NO: 4914 - DNA, 1193 bp, Zea mays
  misc_feature (1)..(100): optimal_loci_224270_G1, chr6:105129546..105130738, Cluster 30
aatggttataaagagctaggtgggtgagtctagatgatgcttcttaattagactgaattagtcgaccatctctttttaagtgttctactaacaaagtcatatgaggcttggtagctaaatgcatcaatactatggtcattcctggtgatatcggtcaaagctagatttggctcaagaagcttatgcttgaaatggataatattcatcttataggtgtctcagctacctgcttggctacttagaaagctagaaacacaattatggtttaagaatcttctgataaaatctccaaatgaagtcatatgtcaagtgtgtgcgctcatgattcattgggtaggtttaagcaaaaaggaccttcaggacttgctgcaagaaagcgctaagctgctgttgagagatgtgagtgctaaactagagaacatggttgatgaacaagaggaagataatgatgaggaattgggaagaaaccagggtggtcgtcagtgaagcctgttttcgagtggttgcactcataattgtgtgtgcttctctttcatgcgacttagatggtttctgtgtggctagggtggcattgatgtttgtttgaaagttatgaaactctgtgatgggtaacactgcttcctgcaatctgtgtgtcagggtactgaattaggcatgtgtgcctatctggaaaactgttgtcagtccagtaggctcttgtcatcctcccccctcgtgcttgcgttgagttttgctcatcaccattggttttctttgcttttctgtaattttgttatgctactctagtctttgttgtatttcaattatgaaaataatagaaatgggaaacccccttataaaaaatggaatacaagtgactactgcacgtttgatttgtagaggcaactgtgatgagtggttggtctagtcatgagtcacatcttctatttcatctttagaaattagtgatttatatagatggttgcacaaccgtctttagaaactggatttgtagatgtggctagggaccaacgactgcctctacaaatatatttgtagcatcgaatgagatcaatatccgcctctacaaatccattttcatctaaagtgggtgggatcaacagccatctgtatgaatcttcttataattatatttttagaggcgagctatatttataattatattttcattccacatattatctactcctctc

SEQ ID NO: 4915 - DNA, 1207 bp, Zea mays
  misc_feature (1)..(100): optimal_loci_226145_G1, chr6:114937682..114938888, Cluster 30
ttagatggtaaaagacaaagccaaactaaatacaccctagttttagtcaccctatagtttaggagggaagctttagtcataatgtttggtagtttagggacaaaaaagagactaaattgtagtcactaaattctagaagatgtgaaccaaacggggcctggccttgatatggcttgtcgagaagccagagttggtggccctcgatctaattaagcaccatatagttttcgttaaggtgctaactcactctcacccaagtttattttcccgccagttgtctgcttcacttgttaattgcaccccaattcattacctgaaaggcccttccccaacaaatataattgatgagccatctatatttgataccgtttgctaggaagcaggctatcctacacccggcctgcttccgttgatctgaagccgagagcgcgcgatcgtagaacagcatcatctcgataatcgcgtcttaacctgcccgtgttgcgatgtctagatcaatcatcatttggtagggatgctctagctagctataaggtatgtagtagtagttggcgtttttttttttcaatgctctgtcttcctctgattagtatatgcggtagcttaatcatcagccactagtctaatattctgtcatgtgctatgtgctgctaattgctagctactcgatactagtatgtatatagtatatagattcacaaccatgtgcttgtgctctactaataatgcttgatcgggggaaatctaattgtaaaatggacgggaaaatgatggtcaactgtcggtagtagccgtaggcacgtaccttcctccttcagattaacagcaactgtgtgtgtcgtcgtcggtgagaaaacctcgtctccccgttcttgaggctcgagaatcagcaagagattattcctgcgtgtggcgcgtgtattgagtattgaccatatcaaatcaaatgaaaagaaaaatacacacaggaagctggtacagcactgtgcctgagcactgacaggacaccacacacacacagacagcatctcccgaccaattctttttttttaaaaaaaacttgcacatatatatttttgtctacgaaaccacaagagagagagagcgagcttgctgatgcagacgcgatgtcagccacgcagtttccctggagcagctggttcttttatttttctggtggaagtcactcccgcgcccggcccccagt

SEQ ID NO: 4916 - DNA, 1070 bp, Zea mays
  misc_feature (1)..(100): optimal_loci_228255_G1, chr6:126086868..126087937, Cluster 30
agggtaggaggtttgttcttcctgaagatttgatgggcccagcctacaggggatgggccaccacacatactgcttggaaaggtgatctcttaggcaatatttttctatgtgcaccgggaaaagcagtgatggcatctaacatcccccaaaccgtccctaatcaagtcaaaggggaaagacatctaaagcatgattttttaggatgttccacattcgaatgccagacttgtgctcacccgacccctgaacctctaacatgttctgagtttgcaaagtggccaagggcggcacataaaatgcaggacatgttgaagcattaaactttggatacattaaatattgtatgggtaaagacgcctgaataccagatttgagaaatttggaatttaaaccccataaacaatttttcaaaccaattgaactcatcacgacatataatcaaaagaaccaaatttgaggaatcgaaattgcattttcttaattgtcggtttggctgccaagacaaaagccattaggctgatgcttttttggttggagacttcataatcaatttttagcgaagactaccaatgaagtgctcttagaagagaatttcctcgttttatttctgaggccaatgactgtccaactatcttcttcctcatgataccaaagaacaaattctttttccaatcggggccatcattcctccaaagatagaaataaacctcaaagatcttagagatcactctcatgagagtaagtactagaaaccctagttttttagaagccactgcaaaacaataatgcagatctgattcttccttgacatgaaatcaagcaagagcccctccagggattgcctgaagcaccctactcacaaaattctccaaatgcccgaaggtgtgacaacgaaacactacccagagaagaaaagatccatcaagaaatggtgaggtatgatgcaaaacagatctaaatttgtgtaacacttccttatataaaccaataccgtgagagaagtctaggtccgaagagcagagagagcgatgctctccacctgccatgaaagcagggaggagaagaacata

SEQ ID NO: 4917 - DNA, 1378 bp, Zea mays
  misc_feature (1)..(100): optimal_loci_228739_G1, chr6:128792164..128793541, Cluster 30
ccaaagacatgtcttctacttcactttcttttccttttcctagtaaggtttttagttagcttcaacaagttttgtcccgatatatattgttcagccttgatacattaattttggtatctatgccctgaacttctaatgtcttgtttatttccctagttagtagcttgggtaggtttatgatccagcgcagaggcggatctacgatccagacgttcggtattcaaaatcacattaggtgctcaaaattttgaagaataaagaaaattttcccttgtcaaaaatgtacgtatagtgtatggaaattgtttttgtgtgaatcatgggtatttgacataatgcccattatccttctgtgcctgcccctgatccagcgtatgatggcaacgatgagtaaatagttctaacttttatgaatcatgggtataaagaaacttttatgaaaagttctatgtgtagtcttgactttccccacacataattgggttctcaagactgacctcaccaaactttctatcccacattttctatttcgaactccactgtgcctacagtgcgtgaacagtttcgtgcaagtccatatacatggacctcgcaggacttgcaaaccccacacgtagaacaatggtatgcacaagtattgataccatcggtgtgtgcaaatgttatacaaaccttgtcacaaccaaaagcaatgtactaagtagtataatcaagcgcttgcaagcactaagccatactatatatgcacctaaacactttattggctagagcttcacaggaatgaatctctatccaagagtatattctagtaactcttaactacactaaaacgagcaccaaccatcaaactaactgttgctccaatttgactatttatgtgttcgatgtacaactagactgtcaggtgcgtgcaatcgattcagtgtcatcatcaaactcaatatctcctcaggtcatttaatcttgtgaatcgttagaccatccaatgcattatgcatttcctttaccaagctcttctaatcactggacctttcaatgttcactaacattcttataatcggaccatctagtgctaagagttgtgcatcattgcttggtcttcatttttcattactttcctcaccaatttgttcggtgcatgtttctccattgtctaggccatcaacttcttgaaaattctgaactgtggtttattcagtgtgatgtcttaggtcttctagttggtattctaggtcttctcttgtactctcgatcactcctttgaggtgtttgtttaccaagtccattactttcatcattggaactaaatgaaatattttagcaagctatattagtcacaatggttatgttgtcactcaaataccaaaatctcatacaa

SEQ ID NO: 4918 - DNA, 1254 bp, Zea mays
  misc_feature (1)..(100): optimal_loci_232553_G1, chr6:146570672..146571925, Cluster 30
tctttttttaatcgactatgattccacgacgccagaaataagaaagaatccgtccttaacaagatagccacgcaaggacattcattaaattcagaatctattaattacaattctagcgcaacagtaatctggatggtttttgttgactaaagaccaataaaaattatatgctagccacataaaatagttaattttgattagaattttcgtcatccccttactcttgctcttgcagattaatagacgtaaaattagctactttttgtggccagctaaaggaaattaggttaaactagcattaccagctgcagattaataatttattttcatccgcaacacacatacatattcatatacatccattgataacacatattttttcatccacatcaaatacattaacacatatcagctcacacaaataatccataccatatttataaattcatagaaaatcttcaagtagcattaactgttctagtcaaaaccttttgaaatagcataacgagtatcaacatgcatacatccaatgagttttaattcagattcatcagatgactaaaattctcaccgctatctggagtagtgtagctaaagacttggttgataaatgagttagacccttggtgttagtgtgtcgaggtgccgctatttatggaggagtctaaaagctctacagattagaattagttcgaattgagttacattgacagctagatagagttcaactaaattgactaatttttgctagaatttttagcaaaattgactaagttatactaaaatgaccaagtttcgctaaattgaactatattgactagttttttcttagaattaagctaagttggctaattttgctatatcgactaagtttagatagaactgagctaagttgattatttttagctacaattaagctaaattggctaatttttattagaatttagctacgttgactaaagatgtgattacttgaggccaaagcatatcgataaagaatcctattgcaatggtggcaatggctatggtatctagaatgcgggaaaagtgatattaattcccatctactgtaatgttgtctatgagaggaatagatgaaacatcattagttattttaatagctaagatgataatataaaattagtcgaacttacttaaaagtcgcatgttgttgtgccatatagttgaaaaatactcatcatgatgtcggtcatagacctaacgttgtcggtcatactctcgacattgcttctc

SEQ ID NO: 4919 - DNA, 1081 bp, Zea mays
  misc_feature (1)..(100): optimal_loci_233740_G1, chr6:151556987..151558067, Cluster 30
tcttaccatgttgctgcggcttgctgtagttttaatccggctgcggctgtgagtgacttctacggtattttgtctttataaattgtagttgcatctacaacagtcagtagctatggtttacagaagtattgcagggtgagaagatgatagactaactcataccttaaatcaaacacactattagtttacttgttggttacccatcaattgtttttttcttttattcttagctggcaatgcacatatgaactgtattgatggatattttacttcacaatgatgcatttatgtacatgcggtgctgctcattagtttttccagggatgttcgtcatcctttctacggcagtacctcacttcaagccaagtatgtaaaggcttgactcttttagttggtgagccaactttctcgagcttcattcaaaactctcttctattctaccagtactctctccgtttcgtattacgatccattctagcttatttagagagccaaagcatcatagatttaatcaaaactatagagaaaactgcaaaattctcataacatcaaatagatatagttttaaaatacaattaataaaaaatctaacaacacttatttggtgtcataatataattattttattatataaaatttggtcaaacttgagatcgtcttgattctccaacgatttcaaaattttaatttgggatggactctgaactctggtttggacatcctggcatctgtttatggtatccatagttgagaatagccggtgcgctttctgatgatgagctctctgttacattgattcattaacgtacccattcagtgcagatcaattttgagctttagaccagggcatttttatatgttaaggttggttggttggtggttacacttgagaaatcattgtccagctgtacctctgcgatgtacttaagcttaatatcaaccaccagatggccgctaggtacttgcgtctttactctccactgtgatccaagctgacagaaaagcaaaagagatcacgtctgtgaaacagcaagccttggacatgtaaaccttttaccaggtccataaatctgaatctgtc

SEQ ID NO: 4920 - DNA, 1085 bp, Zea mays
  misc_feature (1)..(100): optimal_loci_233864_G1, chr6:152291962..152293046, Cluster 30
tatctcttcccctcttcctcctgatctcgtaactcaaataatggtaccatcactcacactttgtcgacaatctcgttgcaggctcgccagatctaagttctcaattgttttgaggtacggatccaagttttttagggttgtttgttttgccttttttgtcacctcatcccactccttttgcctcatttgatgttctaagatgtctatatcactgcaattgagagcttgggctcctatatgagcatcaaccgaggactaggactagtatactctatattctctagcggtattctcaactgtgagggaccactctagatggtttgtcagcagagagaatatatacaaaagatagtgtgcatatgctcttggctatgctacagaggaaatgtgatggtgcactagtaagccaagtagaagcttaagcgacacttacatggtttctaagatgagcaagcatacaaaagagttcttgaccaggagtaattgtgtttaaattggtgatatggcacctctacgtgaagattctctacatggtaatgatttaatttcgaaataaaagttattactaaaactaggtggcatgtgttattgtcaaatcccaactgaattaaaacaacaagagaatcgactattgggcttaacgggccatctacttttggccgattttctagtgcgacagctagcccgatgggtagtggaccatagatagaagtaagtttagggttagttagattgagaggatgtgccttccaagtctctagactataaatatgtaatctttcctaatgaataatcagaaggtgcccaagcaatacatgtctctcatctctatggcgcatcgccactcctttataaagttcccatggtaagtatcatgatgccttaatgtagtctcccatggaggcattagggatatttggtgcttcatcttgccttgataaatcttgtgctaagcattgttgtcggcaagatttaccaattatctcatgtggtaccaatctactatttctcttacgcttcatgctatatataggtttcacatggctaaatgtgtattgcttgcccggttgctataatccacggtg

SEQ ID NO: 4921 - DNA, 1339 bp, Zea mays
  misc_feature (1)..(100): optimal_loci_234535_G1, chr6:154988195..154989533, Cluster 30
ttcaattcttcacatcaaattttctacgcaactcagtgtaacatcttgagcaaccaggatttatacggtggagctcccctcagatagaataaaggcttatttctatgcacgtcaaagcataatcttgctattttttaaaacatggtgctgcctgccatcccttgcaaactggaccttcaggatctcaaaaaacacaaaatgttgccatatcatgggtttacattgcaatcgtaaatgaaattggggtttggatctcaaactctggtgatggttgtgcaatctagggcttcagattattggggaagatgaatcagtgcagaagcaagtgtgctggaaagtgtaataagtccgtggaagattaagggccatggaccgggtatatttataagttgtaactaaaggccaagcactacgggcctaaaagataagaagctagagcaatgtgaatattctttgatatgatccttatcataattatgatgaatctgagatggatggtacaaccactaatctacaacaaatattggatacatataggaagacaaaagatagctaagtttcttaattgttctattagaattgtctaaatatagatcatgtatatgtgttggtgcatttgtgccttgcttttgactcttaagttcctaaattgttccacaaattgtggctgattttacatgccatgtgctctaagtccatgtacccccatgacgagggtatgtgatgtactcatatcaaaatcttctaattgcaacttcataactaaaaataatagcatagccttacatttaatatgccacaacttctgctaattaagtgccaactcattctcacaaccatatttacacaaatctaggaagaagacaccgaaagtgattgtgatgagatgaatgacgtgggagagctttgatccgtgtgaagagtatttatatgtgggaatgtgctctcatgttaaatttttattgccatggtgaactttggttattgtgtggtttgcaatataatttgatggctacaacatgaactaaatgttggtcatggtgatctattgaaccactaaactttaattactgtctatttgtatagtctagagcatatacctagtcatgtgcttgtgatcagtttgtagaattgtgaaactcatttgattatttttcatggttaaaattatctacgaatagtgcaccttgtgtgtgtgaagtgtgcttcaacatatttcttagctaatgaaaaattcgacttcaaccttctttttagaagaagcatcaagataggtatataccaaattaaaaatgaagtgtgaactatgatgtgcgcttgtgcaccgattgtgtagtgg

SEQ ID NO: 4922 - DNA, 1156 bp, Zea mays
  misc_feature (1)..(100): optimal_loci_234892_G1, chr6:156757203..156758358, Cluster 30
tattttcatatgcttagtttttacgtgagctgtgtgtttagttatctgcaattctgcataaaaaatttatgcataaggcattggatatttttgttttcaattaaagtttacctatgtgatttacagaaaccgtagcaacgcatggacaccttaactagtttaaaattagaattctgcatttgtatattctcaaagaatagaagaagaaaaaaactcaccataccttctccctctagatcttgtgaggagactaggagagaagggtctaacaatataaccaagttatcatgttatcgttcttttgaaattttgacatgtccctgacatatggtatatattaggatggtcgacgatacacttcaaatgttttttcacaatatccattcgatgttatcttctttcactactagatacggatattatggaagttcatccattcgaacctggaattatattcccctaaatttgtaatattcttcttctaaacgtacgatattttctgtgacaacggatttttttgccccaaaacctaaaatatatttgcggggcgcgcggtagaaggatgacgcacgaaaaaaaaactcccattttaaaggcgctcaatttaaatatagttaaattaaaatttaaaggtgtggagatcgtgtatataccataccgtgcactcagactctttaaactttctggctcggccactttgtcaaatgatcagtaaaaccctatctcggtactggtcgtcgggctgtactgtatatatgcttcaggtaagcaacgcctaataacgctagtcaacgcctcgatctgacgtcgtgagcgtgttgactaactggccaaaacaaatccactgatcgaccacacgcggtttccagggattcgatcggaccttgacttgaaaagaactggacgaggacgataatcaggtcaaatctctttcctgagagtggtagtcgcgatcgcggatcttcaaggacgattacggtgccgatttgacactagcttcttgacttgagtgaaggactatcagcaatgtgtttaagctactgtatcctaataattgctttgccgcttggtcgacgcgttggcctcaaggccattgttgcagtagtagattgtgtactcagttgaccctataccatttcactctcctcttaattaa

SEQ ID NO: 4923 - DNA, 1069 bp, Zea mays
  misc_feature (1)..(100): optimal_loci_235172_G1, chr6:157981285..157982353, Cluster 30
actatatgcttgcatattagtcgtcatctgttgtactatatgtcgccttttaatacagcataatgtagatcagtggtgaatttgtctcgcttaattctattctctactaccggttgttgttttcaaacaccattccccaaaatgtgtggatggaactatacaaccaacaaaacatgattttgaaccaactcatgccatgccataccctacagccatccaaacaaaaaccatgtacgtacgtacgtacgtcaggtagccaaacagttaacctgtacccgtcaatcgttttctcaacctggatgtcatcctttttaggacatgtacaaatttatttaatatgcgatcttttgtaaggtctctaaggagttaaatgcaaaaaatacgattctcattatgcatatatcttttagctgcatttattatcaaagtcttaaagttatatcatacagcctcttaaccgtatcttgtattttgaaaaccgaatcaaaatgtcagactcgtacatgccctaatctctttccatccaggtggcacgtcccactcatctctgtacgcccaatcagcactgctcgtatttcgtaacacgtgcttcatctttcacaacactgtctgtattttgcaacacgtgttcatcatcattagcttcgaaaccgcgtctccaagccagaaccatgtatgagattttaggtgccatagccgaaatcttatataaaagcatttaacctagtatatgcaataaatatatatatgtgcatgtatataattacaatcacatatttccatgggccaaaaaacaaacataattagctagctcttgcacatgttatacacgcacacttgtctcgatcattgactgtgtgttccaatgtttacatgactgtctagttctttggcgacgtggcagcgacaccgtaacaggaattaggtgtttgaatgtattatgttctgaatcctgatttagaacatgacttacatgaataggtcagcagccacttctggcttatattatatgagcaagatagcaaagattaagttgcccaattacataagcgaggtagcaggtggtagc

SEQ ID NO: 4924 - DNA, 1167 bp, Zea mays
  misc_feature (1)..(100): optimal_loci_236255_G1, chr6:163916055..163917221, Cluster 30
tgtttgctgtcaaaattatatatgcatgtttttcatttttcgtttggtaaattgcagaggcaagtacttcctcgtctgctcatgctgaagatgagaagaaggctgatcgaggactctctctaatgggtcctcccataaggccaggcattgcaccaaatgtcaaatttgcagaaaattaatttagcggttcacagagaatgcttgactaataaatccttacgcctcttgtgtctatatcagccattttcactgtaatgctccgtgttcatctcatattgattcttaattatcacgcaggtttagggttcttgtattttgagctttgtttgagcacaaaaattgtgtatctttagtgcaatgcgtgcgacacatggactgccaatgctatggttggattttgatctatagacgatgtgctcattgggcatgcagttagtattagggaggaacaaaagagcaagtatttgaagaagggaaaaaaaagagagaaacagagacggtcttgctcgtgaagggttatccttctagttcttaccaccggcgtaaggctgtgtttgttacgcaaagcaaaagctagtgtatataggttttgcctggctacaacgctaatgtcatgcgtgtgcgcaacttttatactatacacacacataattccagtattcttgctctacttatatcaaaagaactttattcacatcatatatcgtagcagaggtagattccaaagtctcacattctcacgacaggaaactcgaatttcattacttcgtagtcgtagcaaaaaaaatgcaaccaaataaactatcaaatatattttaaaaccaattcaaacaggaatccatagtctagccttacaattgaggggaagggagcattccttgatctagttggtcatatgctatttattagtccatagaatcaacactgtttctcaaattcaaaaccatgcatcaaactcatacggtttcacttgtaaaatgttggaaccaccaccatcatgaacgattgcacaagacacttctatgaattctagaattatagcttcaggttaaggtctaggtctcgtgggtcctccgataagttttcagcatccttccttttcaagtcaatgtattcatgttcctgtaagcattagaaatttagaacacgaccattatcactaagctt

SEQ ID NO: 4925 - DNA, 1271 bp, Zea mays
  misc_feature (1)..(100): optimal_loci_237414_G1, chr7:1571165..1572435, Cluster 30
acatcactcaacacaaaacaagccatggataagggatcttgtagggacaaaataaatattgaacgcatggttttgactcaccgcgactttgtgctaacaccaaagttagatggatttcgttagaatttcatcctaaatgagcatttattagtaaaatctaaccatgttgttctagaccccctttaacaaatgaccaaaaaagaaggtgccactcaaaatcaaaatcttcgtttggtaccatataatgtttgatactattactaatgggtaatcttgctggcgcaactaccaatgcagcaagaatgggtgatcttatcactaagatgagataattaattattaatttttagaatgaaaaaatctacttaatctcttttgactattgctggttgcttacttcaccttcttacttataaaaccgtttgttccgcccataaattattgaaatgtctcaataaccctctgggtagtttttaaggtgatttcgctgatgtggcatatttaaaagtttacataaccccaaaaaaaatcaagggttcataacataacccggtcaattacaaaacatgatacaataacccttaagtatgtaatagtgtacaaatgattcttcctagatggttttatatggtcgtttggatatcatattccaccacattggtggcctaactacccgtgtttgcacgtaggtccactgtctgtgtgcaagcatgggttttaagctagcgtagtgggatatgcatggtgttcaaacatccctacaacaccatctagggtcatttcaatactattagatgcttttagcgctataatatcatattttataatcgaggtgttgtattgtcaaaccttgatacgttacacggctatgtagactttatgtcacatcactgaaatcacttacaaaaccgctttagctttattcaagatgattttaaagtttaaggaatagaacatatattttaatagttgagaagatgaagtagacgggcaccagtagtttgagggattacatagactttttctctttaaattatcttacatatgtgcagtatatggtctattatcttaaaaatgaatggttctttaaaaattaaagcgagaactttaacaattttagggcaacaaaagtgaggccaaagacaggtggattccatccacgaccccgccccaccatatcgccgccgccgcggtgaggtcgtgacgcgtccggtgatcgtggcgccgaccaaggacctgaccatcgttcgttctccgcgactaatgaggcg

SEQ ID NO: 4926 - DNA, 1056 bp, Zea mays
  misc_feature (1)..(100): optimal_loci_237682_G1, chr7:2911427..2912482, Cluster 30
aagtcaaaaatctttacttaaattttccacccacatccaatcatatatggtgtaggaatgcatcttcaggcgaccgaaccgcttgctttatttaattagatgaggccacacactaactcccacatgaagttgtccaggattaaaaaaacatgatatgcagctgcctgatacagtacgttactgttttaatttgcttgtcattttgctcatgttaattggtgcttctgtttctgcatgcttagcagctgcgtcgtaaccttgatggattatgtgtagtgaatttttttggaaaacaaagctgcaagtaacgtcgtaggcaagtatcctgatcctccttcactcctgagcttgatgagctctggttcccttcccttctctgtctcgtgcgcgcatatcatatggctacaagagtcgagactgcattgctcatcagaggccatgcactattatatgaagtggactcgatccattcctgatagatgattgtggtggtcctgttcttgttcttgggttgcgccttagctagtacacatgctggcggccctaattggatgacagtacgacgacgatccggcgacgaccgatcccttggtgcaaatcttgccagcggaagagctcagctggcagatcgatcgaccatagccagtcaactgaagcagatgagttgagctttgatatgcatgtgcgcacttcatatccttcaatgcatgcttgtatttcactaccttagtcttgtatatgtgtttataaggataagtttattctctataaatttcgaacacacatatctggtactctttaactggcactggcttcaaatgaagaactttttatctacagagctgcagtactataacttttatatagacgaccatatgtcagtatctgagattgtttgatagttttaaacttcaaaaaccaataatttacaataatattttagcaccctaaacaatgtcaactaaaagaatatttcaacttcaaagctgtatgcaccaaaggctacattttctatataaactttgtatttattcaagtttgtacaaaaactatgga

SEQ ID NO: 4927 - DNA, 1299 bp, Zea mays
  misc_feature (1)..(100): optimal_loci_238472_G1, chr7:6920098..6921396, Cluster 30
gttatccagacaccaaaaaagtactgaaattttacagactttttttttctgggcgacggagcctacaaattgggccgtgaaacaagtactagcaagagtccagccactagcacctgcacgccaggctttccttgagtcattttccgatgatgaatggtgaggttgggctgctgggttgtggacttgatgggctaactcgatccgtcgatcggtacgcaagcggcagctggtgtctctggcccagtctgaaacgtgaaggtggctgtgaactgaacttgaccccttgtactactactactactacataacatgcagtaccattttaaatctaagatgtttcactgcacatttggtctggaacggtcgatgtgtttgtgcaattaagagatttgctagagtgctgctcactttctagatttctacaaaatccgttgtaacgtcacagatactgctgagatggagacgacggcaacaagagagtgctgaagaagatgattgggagagagatggcaacaaaaaaaaatatggtcaaaattagacattgtacttgtacatgtagtgtgttagagcatgtttgggtcctttagggccagttttggttcatttagtccatagactaaagtttagttaggagattaaaatttgagactaaaagtatattcaaaacacattaaatgagtttagttaggagaccaaaatatcctttagcatcctctcgacattaatgtaattgaaacaaaaaagggacaagatttagtctttttttagtcacggactagacactaaaacagtttagttccaccgtttagcaatttatggagtacaaatgcatagacaaaccaaaccgggctttagtgatcgatgtctattaagcgtagtcgttttttttttgaacgagagaaactgcccgatgaaacttgttttgaaacacacctttttacgttttgatgattgatatggttcagagtgaagatagagcatgggtcttttcaactgttcgctttcaagaggatgattgctgactcgtcactagttaccaagttggccatgttttataatctggatgtgcacacactgacgctggtggggtaccaagctaacagtgttgtccttgtttcttgtcactccaaggttccaagctctgaatccgtccgtccgtccgtctatccatccaaacaagacaaaacaatccatctgcttttcgccctagctactttctcttcgccctcttcaacctgctaggcccccatagctccagtggaagcatggataagccttttctagtttccttccatctct

SEQ ID NO: 4928 - DNA, 1307 bp, Zea mays
  misc_feature (1)..(100): optimal_loci_238665_G1, chr7:8360975..8362281, Cluster 30
tccgggggtcattcccccccaccgtaatatataaatttgtgccaagagtaattataatcatgattagtgtttgtttatggatcagtagtcctactttgttttaattgatgttgataagagtaagattaattataaaataaacatatttgttaacaaaataacaactgctatgaaaagattaataatgtttgattgccatgggaatattattatgccattcgtattactctgatgttgattggttagcaatcatcgttccatccatcataatcagggcaaaattccattgtgggacggggttgggggctctagttccttcagacctgtagatggcctcttaatatttatctagaaattttttacatgcatgtatcctgaggaaaggctaaacctgtatagaggttaacgaagtccccctagatatttatactagtttctccactgaccataatgcgccccaactgagcgagggctagacgtcttgagctgtcactagggaagagctcagttactaataaggacatgtacaaccccattaattatgaaatttcttgagagctctttaggggctaagtgaaaaaaataggagacactcttcgcgaagcgtcagtctctttacgactctctatacatactccaggttatattatgcaatcttttagctatctcgtgtatcttaaaaaaccaatccagggctctaagttatacatgttctaaggcgataatgtctaaagtttcgagccagagttattgtatcctttactaatgaccatcatctcgtttatagcgcacaattataatttttgattgttttcttttgcccctaattaacctacaagggctattctcgaatatctcgagtttacatgacataacatctcaaaggtatagaggccttttacataccacccatttttcgtcgtgggcctttatcaagacgtggtgagggcttattaaggttctcttcaatatggtggtcctgaggcatgtctctcctgaaggttgatcgtttctagcaaagaccttcaatatggtggtatcaacaaatgcccttagggcttatgtcttgtcatctccgatttgtgctcttatgatcctgatcctggtggattgggtgcttttgttatatgttattattttttaaactaaatggataagataatgatatgttcattcgtacgatgattcaattcgtagcttaaaaataaacaaatgcaggctttaacaatctcatgagaaaggaagcaatattgacatgaccatggaacccctatctcatctgtctatatgttctatttaccacccta

SEQ ID NO: 4929 - DNA, 1072 bp, Zea mays
  misc_feature (1)..(100): optimal_loci_240136_G1, chr7:16188524..16189595, Cluster 30
cctctcattagctccacgggggagaaactatcctcacacctgtcccaaacaggtaggatcctcatggcccccgctcccatggagaattttgccatcactagaactatggggcttcaaccgatagagtgtgacaaaaacaaaaaaacaaaattgacttcacacaacccaagcccaacaacaactttcgtcccttctcccctaaccataatggcatgtgctgatgtgtaagcttcgacttgcggcccatgggacgggaagggcgtgccggctatcgagactcgagagtcgttcaggctccgggccttcaggcgagcagtgcgtcaaacatgctgtaatcctggatgaagcggtcgaaattgctagcagtatttgcggcaagccagaaagcaaatgatacagcatgccaatgtaatttggaatatttatttgatcgattgtccgattcaaaatttcatcttcctagcaattaatggtgacgtcaagcattctctggtgatacatcgcccacaaatcttcataattgatgactagtgtcttctcttcactaaaaaggcccctttgggatagggaaatgttgcatgtatagctgcacgatgctctagaatggtgtcttgtagatataattatcaggaacatcttctttcttgaagatcaactcatttacaagcatatacaacttctcatgagaataccttactctgtcctcttcccaaaactcgagatgttcagtaacgtgaggtctttgctagaagaagataccatactcccaaaactcgagatgttcagtaacgcgagcactcgagatgttcagtaacgtgagatcgctggttggagattactggtcctttggagaagaagttggggcatgtgaccaattttttttgtcgttgcatggggacaccttgtaagattatatttttccaatggtagacaatgaattgcttcatagcttcctagttgtgtgattttctctggtgtgcccatctcttaagtgtacattagccaattgctcgtgttttactatggttgttatataacatataaataggtattgactattaagatattcatt

SEQ ID NO: 4930 - DNA, 1085 bp, Zea mays
  misc_feature (1)..(100): optimal_loci_242736_G1, chr7:30501305..30502389, Cluster 30
taattacggtacccgacaaccttaataattgattatgtacacatgggtactcgatttttagcctcgagttgtgggatatgtgtccttagtggatgtgtttgattttttggcaaaattcaaaagacctttaagatctttatgctaaacaataagaggctcgaggctatacatattggatgcacttcgcaagaaagtagacaacatttgaagaaaaaaaattcaaggagtacttcatggattctctcaagaaggtacttgaatgtttctttattctatacaataatgacctagatattcaagaatacttcaaagttcaaccatgaagagctcagggtctcgatggaccaatatttgaagggttccccatatgacttactactcgataaagagatgaacatgcccacgttttgctgggaagacatacaacaaggtggcatggtttctacgaaaactaaaccaacatagtatactaaaggaaacacaatctctacgatatgattacgatttttctgttgtagcaaactaggactagaatcatgcacgtgccatctgtactatataaaagagatagagatactcacctggtaacatctcttattatgcaatccgatttacaaggcatatggtattatactattcaacaacttgaaccaatctaaatctttgttttgtgtttaccaccaaatttagtttttcatcgaagcctaccaaaccttatccaagtaactcctagtaagattgttgatcatcaaacaccaacatgtacatagcaatcctaaccattaatctaaatctatttccaagatcaatcctcacataaaagattttggaattaggacacatccaactccacaacatttgtagtaaaagcaacacaacacatatatagttaccagaaatcaacaaaccacggggcggtttaaagccatcatgatttagcaatccaatatccaatctaatggacaaccaactctagaattgaacatagtgcacgaatcaaatacaaaccctagctaagatccacacgcaaaccttcacaagaaacgaggttcaagatgagggcacattggcataccttgcatcta

SEQ ID NO: 4931 - DNA, 1329 bp, Zea mays
  misc_feature (1)..(100): optimal_loci_252525_G1, chr7:99302389..99303717, Cluster 30
cgattcccatcctatttctgacagcagaaagcacataatttttccctataacaacagcaattatgttataattcatccggcagagtatgtagttcatgcgaaccaagtcttgtgtcttgtcctgaattttctatggcaatattagtccccttcacccggttcgtatttgaagttgtcaaacatctatttaatacgttacgttgcacacaaaagaaagaaacggatgatcttgtatgaaagatctgttgggagatgaggactctttttctataaagtacaaccttttggattattaatctaaggaacacgccaaatcattttatattgacgttatattattgaggctggttgttaacgggctattctttgtggagctttgtcttttgattctggggaaagtttccacacactgttggatcactgatatcaagagttcatttcaatccatcaggattcaggaaccgtggactggtacatactagagcaacagagctgacaacaatttatcttggggaggtcagtttgtactaactttgtgactactttagaattttcttggctattcttttggaaaatatcaccttttgaatactagaaaatttctccttccgctacatggtagtacgatactgccacagcatacacagcgcaatagctcaatgagcgcctgaacaaaagggcactttttcccttgagaattaaacaaggattaaactaattaaacattccgatccgatcgattaaatacctgtaagaaaaaaactaaaggctgctgtgcatcacgcatagtcatagattaagaaccaagccatgagatcaacacctaatatacgtgtcccatttcttactggctaagtcttcccaacggcggcatgcaagcaaggaaggagaacatatggaacaccatttcactaagtaaggccgtcaaatgagtcaaagatacgagctgtttgtgtttaatagttgcgcctaactttactaactaatagctagaaagataacggccggccgaggagacatgattatatattcctcgtgcccatttgcattgcatgcgatgccgctgtcacgttgatttgccaagcatgcctgccggtacaggtacagctttcgtgccaaggctccccaagaatcccgcgatgttgatcggtggtactacggcacggcgccaaagggccaattcatcgcaacgtgttgtgattactcacgcgacctaataataatcaattcatagtgcattgttactgtattagacgacctgaaaaggccaagagacgatcaaacaatacacgcacctaccacacgatgttccgagaaaaagtcagccag

SEQ ID NO: 4932 - DNA, 1290 bp, Zea mays
  misc_feature (1)..(100): optimal_loci_252636_G1, chr7:99952232..99953521, Cluster 30
aagccgagaatcaaacctagccgagttaactatgagtcgagtgagctgagtcatgactcatgactattttatccaaccatatacgttctgaaattcggagcccatgcagtcaaagccactgggctccctcagactcgcagtgcgcaagcaacatcatttccgacggtctcgcgtgtcattcgcaagggcctattatataaccagccttgagcccactactttgatgggcctagtatcaacaacacaacatatagtatttaagaggtaataatgcaaatggaaaagtctgtcttatcccttaaactattgatcgagtacaatttacatcacataactaggaaaccaaaattttagactctaatttctcaaaccattcaatttacctccttgatcattttgcacggcctagccatattggctgacgttgcctagccgggatagatataagttggattttcacggaagttccggaagatcaattcaaaattattttaaaaattctagaaataattttcaaaatataaaaatctcgttttagaaaaagcacatctatgttaaaatactaaaatcttatttaagcttataaagtttatagaacatttgttttaaatcaaaaaatatataaaaatagttttatcttatataaaatcatgttgtacattttttcccatacttaagttaaatggatctatcgaatcaatatggtcccctaatatctaaaactaggccaaatgaacagaggatggcaccctaaggcaaattcttgcaaaacgcagtgtgaatcaccacgcagacattgtgcaaactgcagatcatgtttcatcaatggcacgccttttcttaaccattgagagatgcatgagaaaaaaatacagtattgtaaatagtaggccacgacatttggtggcgttttcccctaaaagttgtagtgaaggatattaaactaacatgttttatggaatatatgaaaaatgcttaactatttatatatgaaaaatgtaattaaggaaaattttatgagcttaaatactgaaatacagatcagcttgtttgcttcctcgataactttcatcgtcgtaggttagcgcacacatcaggagcacatgaccaagcaagaactgcaatttggatgagcttgaaatgagagttcttgtgtccctaaaattatgctctatataatggttcttgctcaaaacaaacatagatcatgatttttttaaatgtgagataaagtaattttttctatggattttctaaagttatatcaaatttaagtatttttatcaagta

SEQ ID NO: 4933 - DNA, 1145 bp, Zea mays
  misc_feature (1)..(100): optimal_loci_254925_G1, chr7:112626986..112628130, Cluster 30
cacctatctagatatgttctatagaaccttagaaacaacccacaccaaggcacaagcacaaaccctagcatgggattccatttttgaagactcaaaacacatgaactgtgttcttgcagactctttgtgagaacaccagatagttcatgagaacatcgtctcagcacaaacactcaacctccatagcacttgttcccacggactgcctaaagaacactagacactttagtaaaaaatacaaacccaaggctacacaatttgcacctactcactcagacactccgaaggaacatcaggccatacaaaaatcacacacttagaaaaaacacgaaatgttcccatggactttccccaaccatccaatgtacacctcaactggtcaagagaacatcactatcttctattgcactttgcaatacatcatatattattgtagcccatatgttatacatcattgtgaagcatgtcttgtaatctagttcataacattgtactccttttgcatcatgcattcaataggtcttaaaggtcctgaagaagtcacaaccgaggaacctctaccctagaagttgtcgatgagccaccacttaaattaatacaaggtatgaacctaagcatctgtaattttttgtagttcgcataatgtgcttaaaggtctagtataagcattactatgttactatatgactatcattcctatactaacctacttgagctttcatccttatacttgatccaatgtcgtgtaacattgcttgtttacttttgttgtcgtgtattttattagacgataaaagtcaataatgtgatgggtttctcatgtctcgcacatgtactttgtgttttcaactaaaaaacatatattggtcacatgatctaaacttgaccaagatgatgagaataaatcaagggctagagaggtgttcatccatgtaaagataggcaaggtattgaatggtttagttcattggggcagttaaggaccatgaatctagagtagtaagaaatgattgttgtttctctagactaaaatctttgaaccaaggggagtcatcgaactaaccaaatgaccataaaatagagaaacgacaatggtagtgaatcaaagagagaggacaaaaacttctttagacgtagtcggggtt

SEQ ID NO: 4934 - DNA, 1087 bp, Zea mays
  misc_feature (1)..(100): optimal_loci_256401_G1, chr7:120098498..120099584, Cluster 30
gggtggggcaggggttttagggttttcttgactagcatgaaaatgtattcttcttaatataatgtccgagggttgtcttaccccacacatgttgattttctaaataagggattagatggggctttaccttgtttatatgagtttatttctctcttgtttcctcaacccttcaccgcctcttcctcctccttcatttagtttgttctatccttgctaacctcatgcctggcgatggcacatgtttcgatgggcccaagtgatgaaataagagggcctcgacaaggactgggagaacctttgctaggtttcttcagcattgtcaggccatgttcaacttgtggttcactcagagcaactcccatgagaagatgacagtgactatgtgatcttctatggccaccttgttgccaaggttcacttccccgattctcgtttttcatgtgccatctttaggtattgtggtatcaagcttgggctccttattgttagggttcacttggtgcatcattttctcatttctagttgatttctcttgttcaatgtgaccaatcgacctctgcttcatcttgagagatttcatttgccctagtgtcttttagaattgtgattacctcaatgtcctatggaatatcttcaatttttaatgcatgcacaataacctttccttcactagatggctctacatctctctcctaggcatttgagccttaagctttgagtgaattggctaatgacaatcaattttaaacatgtttgccatcaaggctaattgaatctaattagtatatttattgagattcaaaaaacatcagttgtcctttatcaatggttgattggatcactcgacagaatatattagagttagaagtattatgatcaaatcaactatgccacatgcaatgtgtaagctcttcaaaattttagatagatagcaaagcagtatgatcaatgattctaataaaactatcatctagcaagatatcaaagacatggttacaaaaagtaagtcaaaggtgcactttaatttctttagccaattttttgagtcatctttaaagataaacaaatgaacgaatcggacttaaca

SEQ ID NO: 4935 - DNA, 1321 bp, Zea mays
  misc_feature (1)..(100): optimal_loci_256591_G1, chr7:121179703..121181023, Cluster 30
  modified_base (728)..(728): a, c, g, or t
  misc_feature (728)..(827): n is a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
  modified_base (785)..(785): a, c, g, or t
  modified_base (786)..(786): a, c, g, or t
  modified_base (787)..(787): a, c, g, or t
  modified_base (788)..(788): a, c, g, or t
  modified_base (789)..(789): a, c, g, or t
  modified_base (790)..(790): a, c, g, or t
  modified_base (791)..(791): a, c, g, or t
  modified_base (792)..(792): a, c, g, or t
  modified_base (793)..(793): a, c, g, or t
  modified_base (794)..(794): a, c, g, or t
  modified_base (795)..(795): a, c, g, or t
  modified_base (796)..(796): a, c, g, or t
  modified_base (797)..(797): a, c, g, or t
  modified_base (798)..(798): a, c, g, or t
  modified_base (799)..(799): a, c, g, or t
  modified_base (800)..(800): a, c, g, or t
  modified_base (801)..(801): a, c, g, or t
  modified_base (802)..(802): a, c, g, or t
  modified_base (803)..(803): a, c, g, or t
  modified_base (804)..(804): a, c, g, or t
  modified_base (805)..(805): a, c, g, or t
  modified_base (806)..(806): a, c, g, or t
  modified_base (807)..(807): a, c, g, or t
  modified_base (808)..(808): a, c, g, or t
  modified_base (809)..(809): a, c, g, or t
  modified_base (810)..(810): a, c, g, or t
  modified_base (811)..(811): a, c, g, or t
  modified_base (812)..(812): a, c, g, or t
  modified_base (813)..(813): a, c, g, or t
  modified_base (814)..(814): a, c, g, or t
  modified_base (815)..(815): a, c, g, or t
  modified_base (816)..(816): a, c, g, or t
  modified_base (817)..(817): a, c, g, or t
  modified_base (818)..(818): a, c, g, or t
  modified_base (819)..(819): a, c, g, or t
  modified_base (820)..(820): a, c, g, or t
  modified_base (821)..(821): a, c, g, or t
  modified_base (822)..(822): a, c, g, or t
  modified_base (823)..(823): a, c, g, or t
  modified_base (824)..(824): a, c, g, or t
  modified_base (825)..(825): a, c, g, or t
  modified_base (826)..(826): a, c, g, or t
  modified_base (827)..(827): a, c, g, or t
ctgctacgctgcatttcagttatcgcgccgtgtagaatcattgcagaccattacgtaaaacggtagacttggcgaccaagatttacaccgacagaaattaccagctcttgagcaagtccgtcccggttcagtgcagtttatttgtggcagctgagaagggtcaggcgggagtcgggacaacaaggttccagttccagttgttgtcccagcgcgggcgcgcggcagaaatgttgcacgtccgaactgtggcagagagacaaatctgcgccggccggcggtctccttgccttgtcagcgacgggggtacgcgtacgctgcagcctatactcgtacgggtttcatatgatccgcaggccgcagctcagtcacagacaggcgccgcatgtgtcaaaacaggccgttgcgcggtgcgcgcgcggtaggggcgtgtgctggccccgccgatgtcgggcccgagcggtaggggcgtgtgctggccccgccgatgtcgggcccgagtaacgcgcacaccgtctctccgtagcgcgtggctttcgttccagaacagatgaattattatattgggccgctaattgttcatttgggccgcatcttagctgtatggctggcagagtagcacctatttttcggagttagtgcagcatcggagcatcaatatctcttttactccctattttcctttcttctatttctactttttaaacgaattcaagcttgatttccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtatactcccctattttcgtttcttctattctacttttttaaattttttaaattttgttttatgccgatttttattcttatttctatttttacattaattgatttctttacttctccatttttttatttctcgattccattatcctctacctttttatgttttggtgtatttttttcctttttcctttctctttttacattttactctaattattttagtttttatttgatagacagaggagatacaaaagagggtgaccagtggttcatgcatacgtctgattatacgtgtggtttttctgttttaataaatacgatgaccttgttttaagggtatccgtttagtctagaaaatatagtgctactttgagagctatttgtgaagtaactctcacagtaatatattttagattgttcatttagcatacttcaaatgtcaagcggctcgagtagacagacccttgtgcaccagttgacgtagtagttgctag

SEQ ID NO: 4936 - DNA, 1186 bp, Zea mays
  misc_feature (1)..(100): optimal_loci_257069_G1, chr7:123596924..123598109, Cluster 30
ttttttaagccgaccaaataggccagtagtctcggaaacagaactcagcatatgggattattattgcactctcagcatatgggattattccagtctccagattgctaaaccctacaacttcatttttttttcggaacggacttcgttttgttgttccgagagccgtcttccttttgagttcctccgaagctccgccaggcggccaagcttaacagaaaaaggcccaagaggcgccctcatcaacactggaaacctagaagggcccaaaacaatcggctcggtatcttagcgtacaagggctgggcttgaacaacacaagagtttatcccagaatcagcccatgtgcttctggtgtatatattgcttatagacgatttcacattttttttttcacttccaaatgcgtacgcatcaacgcctcataaagtcatcataattcggaattcctcgcaaacaaatgttagagtagcgctatgtctggtagcgtggtagcgtacggcatccaatccaccggtgcgggcagccgtagagcacgagtatcgcagacattatttctttgtagatcgatccaagtatccaactgtgagctagcttgtcgtctttggttccccagcgatgctctttcgaccgttcgcaggtcaaaagaacgtgatccgtcccgttcgcagttttgtaggacaataccgtaggtagcagcttgtccttgctgaaaggtcattaacatattattagcacctagtctaaccctataagatcagctgcatgatatatttttttttctattcgtatggctgaatcgagacaccgtaattgcatgcggcagctaaacacaacaaagattagctgtatgctccccgctctgtcaaaacaaatatacttaaaagttgtatgccaattaaaatagatcatatctgaccaagtctctagttaacagtatttatttttatgtctccaagtcattttattataaaatggtaattaatctaatatattttttctatttttctgagcatgaattgattaagatttataattaaatacataaactttaaacatttacgcgttttctcttgaaatcaaactgtctgtgtgtgtggtggtgggtggggtggggggcaaaaggccccttccaacatttttttaacgccaacaccctaacacctcccacagaaactaaaactaagca

SEQ ID NO: 4937 - DNA, 1057 bp, Zea mays
  misc_feature (1)..(100): optimal_loci_25741_G1, chr1:156213342..156214398, Cluster 30
aacgtcactcacgctaaatgtaagaaaatggatgaggagagaatggcactctccaacatgattcaaatagtggtttgggcttcacaaaagccaaaacatatccagctagggagttcgtacaacccaaaacatggagagtcgatgactccaatttagacgttgagggggagattgttgctggtgatgttgagatttcaacacttaaactcatagctgaagcattagcagctggtttcaagttaggttgtcttcaacaagcggaggaggaacttgcttctatcaaggttggttcaggttcttctcatatgttgatttggaaaaaatacatatggcatagaatatggttcaaacaatgtgagcgctccatttgtgattttcgtaattgaggctactagtaaattaacctctactctaacatttgtgaatgtgatacattaaatccacatctaggattaagcaagaatgacgaccataaaagaggtgatggccacaaaggatatgcaagtgctcaacgtggagaagaggaggaagaaaaagaaatatacaagagcttaagacaaaggtataagtaggatattttattttgtcggtcaagatgcggtagagtacatgattagatttaggacatatgtctatcctattaaaagggaagcttaattagacaatttggtcatctcgtaccactggatattggaatcacatgcattgcatatggacctaagtgatgcatatgagagcaagcgaaaatatttaacaaaagcacattgaaaaacgctaagtatatgttccaatatgtttggtaaaacatttgaagagctagtgcgcttaaaaagggttttctcagtagttttctagagtgcattagacatgcctggtggtgtactaggcatgcatatacaccaggtacgaaatagatttatacttgttgcaccattttttagtcgagcgcgcaccagacattttggcaccaaacgcttaagctatagaatctgacatataaaatacaataaaaattgtggttatatgctaggttttttagaataacggatgagttcta

SEQ ID NO: 4938 - DNA, 1224 bp, Zea mays
  misc_feature (1)..(100): optimal_loci_260269_G1, chr7:141543404..141544627, Cluster 30
attcatcttcggtaccttgagatctgccgccaattcactcaaaaatctcgggctcatccttggcttttttgtgactttagcgtcccatgatcaagatcataaagatccaaccttcatcgcactggatctaagccgtcctgatttcgtgatattgactcacactctaactctacatcgacaccaacttggacttagactcaagtcaaacttgggcttctacaccaacactgactccaacttatactagtgtttggacttagattcatatgatcaatttaaagaccacttcatgttcatggcttactcagtagatggacaccaagatatccatcattatgaccctaaagatgacaatgaagccaagagttgaaggaatgtagaagacatgatatggcaggtagaactgttcacgactagatctagatggttaacttccatggtcaacaagtttatactacacatacatagattgtcatattagcaaagcaattgtttgatcaactcacaccattgatgcttaaggacaatgcataagcctatgaatacctaaattagatcaacaacatgttagcttatacgactatgtgcactaaggctccaactccataagaattgagccttgatcaaactgaaccctcagttgcaccaactcgagaagaaccataacactcgtaaaaaagctagtcattcaagtatcgagtccttggttctcacacacaatcatcatgataggacttggccagtagctcaaccttctaaggactgagaccgactcctccacgaagacctcagaccaaattgataaaattttatcaaccataagaccaaaacaattatgagcacaagattgagagcagatctattattggagagagagaagattcaaactgcgatcgagttcagcaggatctgactttgggacatttgtcagttattttcaaactttatcggtcgtttaaggaaagtaggttgtctaaggaacttcaagcctaccccaattgatccatatgatgatcgcaccaatccattatactagctcatcattcactagttgtctatcacaacagtaggaggggactctgctatcatagcaaactattcacccatatgtcttggctctaccattaggaagtggctattcagtcctcctgtgaatactattgagtcatgggaagatttgaaacatcaattcattaacaacttcaacatgacttgtgatcaaga

SEQ ID NO: 4939 - DNA, 1228 bp, Zea mays
  misc_feature (1)..(100): optimal_loci_260988_G1, chr7:145378953..145380180, Cluster 30
tgatttaaaattggagagaaatgagggagaattgagagtctccaaatgacgagttatgcaagtacgaatagtccttagcaccgatttgaaaactcaaatttcattcaaattggagagaactgaggtagaattgagagttcatacttaagcgaaagctttatctatattctagcccttagctacatggaaagtgaagccctcaaatatcaaaccctttttataccgggaaattttgatttttaggtcgcttgtcattgccactcgtcaaagtacctcgatattcgttgcactcacttattgacctatcttcctttgatccaataattcgaaataccaattttaccctcctgatacccataccttgcgctggagattggagaaacaagcactactgaagcacaaacatcatttcttaatccctattaaacattttcttctatagaatcttgttcatgttatttggttgtctcaattttagatcagctgttcttagaaatcttgacatggactaccaacgccacatcacaacaacaaatgaaacctaatttatatcaaagtgagctccctcgatcgtgatttgtgaagatgtaggacaactgcagacattacgcacatgaccatgccatggggttcttgttcttagactccacaatgtaagtctacatcattagatgcactgttgctagcttattataatgctttctggtgagcaaaccgtgacatgattttgaccgacttcttgtaaacatgctacatattttgactaacagcaccaggccaccagagagcgaactgttgcgctccagtagcgattttgctctagtctccagcagaaacagagacgaacgttcgtgtatcagtaggataaaaatggcattttgaattattggatccaaggaaaacaggtcaatagttgcagcggggtattttatcaactatgtgttgcttgtggtgcaattaagcgagtgtaatgaatgccagggcattttagcgagtggcaacgacaagcgatctaaaaatcaactttccctctatattgctctacatctcttttttaatacagaggtccaactactactattttttcataattgttgtatcatacacaagtacaactttaatgtgtcacagcaatgagtgtgacatgccattgtggcaagtatgattgtccataccatagagtatggtgtagctagtagctattgaaggcatatgtacgacatagtgc

SEQ ID NO: 4940 - DNA, 1366 bp, Zea mays
  misc_feature (1)..(100): optimal_loci_262375_G1, chr7:153721227..153722592, Cluster 30
tgacggttaatatatggtgccaacaacgaagaggtggaggaagcgtttgtggtagttgtatggttgattgtgcatttaaacggtaagacttatcttatttagttgttaggcgacatctagggaagaaaaatagatttacacgcatgaaactcatgctttaaatgagtagagattatatggagacgaaaaatagatctacactcatgaaactcgtgctttaaatgagtagacattgtgatctcgatggtgttgtgttctgtatacataatgttgaagcaagttgctatagctttcctagctagctaccttttcatgccgctgttgtgtgcacgagctttataagaagtgatgtgcttcaagggagggcaaagggattccgcttgtctggtagtggtagctgcttctaatttgtttgctcgatcgatctctgatatgtagctctttcggtagtggactagtggtagggctagctaagctgtcaaggaaattagttattagggcaggtacaactctattaattaaagggtctctaagtattaaatataaaaataaaatcttcgagaagagtctgactttttacgattttctatacatattgtctcttacttgcataatgttctagtgatttatgattgtataatatagttttttaaccgtcttttgtatttataaaaccgagcaaaggcctttaggttgtacacgcccttacttagcgacacttctctaattaaagcgaaggtgcattatctatgccactgcattcaagactagctgttaattaacaaatcttctgcccgttggctgctgctggttaaaggtatgtttggaagcatcacaatttttaataagaaactaattatatcgccaattttttgaaattggtttataaaaaatactggatgtgtgtgtttaaaaccagtctgttgaaaaccaatttctagcttttttccacacacaaagacgaatctaccgttactttattttaaaagcaattgattcaattattccttttatctttctttgctaccaattttaaatatagattactaacaattttaaatatagattggactcatatttttgtaatttaacttttacaataataattaaacattaaaataggaaagactaggtatcgaggggatcacatgcataaacgacctagaagcagtgtcaatcaccgtaatttccaacgaaccaaataaggacaatacataattttttgtcagtcaaacactagtttcaactagtgaaggacagctttctggttccttagaaactgagaatccggtttctaaaagttgaagtgaatataaattggtctgtttttggaagcatcatagtttttctataaattaatttctta

SEQ ID NO: 4941 - DNA, 1205 bp, Zea mays
  misc_feature (1)..(100): optimal_loci_262690_G1, chr7:155221353..155222557, Cluster 30
ctatatattggctcgttttatcgaagctctagctctagaaaatatgtggatttcctagctagttaccagtagcttacgaaattttggatctataaatgcatgttaaacatatttacaagactcactttattatttacaatttagattaaataacagtattttaattattttaatttagtttaaaaactatacatctaaaataaatcttagggtcagagctttatcaaacatgtttattgaagttatcatcgggtaacccaacacatcgacaagcaaatacaattaggactaatcactatttgattaagtttataataacatcaatatttatattccggtagataactataaaaatataccttgcaactactcttgtttagtatcagacatgtaagtatgtttgtaagatttggttaaacttaaaatattttgctgctcgaaaaacaagaatttataatgttccagagttcaaacagtttagatctattttacacattaagtgaaccacacaccatcactaactcgcttatacttttggtctcgcttcgcatcaaaggactcacctgaggtttatatttttaaaacctttttaaaacagtattttaaaaataaaacatatcctaaatatatatctaaccctttttggtaatgctagttcatgtgagtcaaaaaataatattgtcgtgtgagcgacacatattggcaagataaattccccacactaggaggtatacctatatcatatttatatatagggatgtcggaacaacaacatggttgtcacgggttttgattctatggtgtgtttatgcaagaaaacatagagatacctaatttatcctctcttagatgtcttaatctgattattttaaaaaaaaatagtcacatgacatatagaagcagagctatgtgactttaaagagaggagtatcaccccctaaaatttcattgtctatatacattctagggtagaaatagatttgtaactgatgtactttattctctagttccaagatacagtgggattggaactttgttgatatttgatagtacagtattatagcatgatataatcctattctgatatgatggatacaagatgggtccgtgttggtccttcagttcatgcccttgatgggagcacacaatttccgacctctgcatgaaacaatggagtaaacattatctcaacctctatttgagtg

SEQ ID NO: 4942 - DNA, 1104 bp, Zea mays
  misc_feature (1)..(100): optimal_loci_262866_G1, chr7:156080560..156081663, Cluster 30
tatacttttaatgtgtttgggtaaaaaagattagagtgctattcaaacaattgtcgatacaatatcacccttagaacatatatggttgaagtacatcacccttgggctgactccaacatagtacatataagagcacctaaacaaattgtagatatctaaataacattaaaccgtctctgacagggcatctataccttatacacattttagacgtgatgtgggagaatacctaaatatggatgatcatctcctcaaaccacttgaatgcctttttggggtatccggttgggcactacaacatttaggtttcgttactcgactgactgcataacccaaacttgtatcgagttcccatttttacataccattgttggagttagccttagatgctagatagtccataagttgaatgttattgctatttagtttgtttaagttttcagattcattgcaacattcacctaaattaggggcatatattgacacaaaattgtatcaacatgcagtttggacaatgttaataagttccttgcatcaaaagaatattggcaatatttggtgaagtgagtgaggaagaacaaacaaaaaggagaaaaacgacatatgcatgaggaaaccggccatgttggtcctgtgcgacccccactggatctattttgtttcaaattagtcttggatataatttggtgtagaaaagttggaaaatacgttttggagttgtttattattgtgataaaatcattcgtcattctatatgtaagaggattatggtcgattgagtatctcaactttcaatcgtcacaaacattttcactacaccgttttctcctctctataccatgttgttcatcacattttctattgagacttagtggtactctagatggccttgacgatgccagagcaaccttcacatgctgtttttttcgagatgttcgatagtttactgtataaaaaacaagatccatatcaacctgactaacccttcgaccgattgtgtcgctccacaatattctcattaagatttgttgcaaccataggtatgctaatacttatggtttattattgtgtaatccggaatatgttgtcgtttaatagatatac

SEQ ID NO: 4943 - DNA, 1084 bp, Zea mays
  misc_feature (1)..(100): optimal_loci_262911_G1, chr7:156282344..156283427, Cluster 30
ggcgtctgaatcagacctaccaactaccatcgggaggtttaatgggcatgttcccatgatcaataaaacatgtgacgaaagaactgattacaaaaacatcgtatgaggtgtactctacaatctacatccagggtgcaatattagtttaggatttaagatccactggatggtttgtggtcacactagtttagatgcaactctgaacaatgacatgtttcggttgtctattccttttagtagacagcaagatccaatggtgtggaaaattctgatatatgtcaattcaccatggtcctgacaatactttcatagaaaaataaacccctacaactcctaatttacccgtcaatggtaatcgtttctcaccctctaaactgaacgatatcctgttgggcagatgaaaatctgactgactatacaacatgcatagtgttcacgtataccttttggtggattccaagaacaaaaaggttcagatgattattcgcaccaattggagcagaaagctgctacactgctaccttgtacgtgcttgggaatgattacgtgtccaaagaaaaagtgggtattaaaaagtatgcagatttcccttttaaaaatgcagtttggaaattgttcgccagcagttttgcaggttttaatggaaaactacaaatcacattactttttagtaccagttgtacaagttgtcaaagttttcagtcaatgtttgatgcaagattagatccaccgtagagctactctacggtcgagcaactgtttaaaaacggttttcattggaatcataatcttaacttctttttgatgattcatgagtccaagggtgcttttggccacagttttttcatggaaaattttaccactaatggtttggtgtatttgaaaacggaggaatgacttcatctttatctttagaaataaggttccttccttttcttcttggcgacgctgcttcaacgatatagtgaagttgcaaatgctgagatttaaccactctcttaaagctagtctaaactctcgatagctcctttctttcttgttttctttgatcccgcttgtatttttttcatctcaaaaagtttca

SEQ ID NO: 4944 - DNA, 1293 bp, Zea mays
  misc_feature (1)..(100): optimal_loci_264061_G1, chr7:161808156..161809448, Cluster 30
ttgtactgtagtattctgtgcacttgctgcccgagaatatgccttgccgaattaatcattgacgtgagataatgaacagttttggaatgaaccatcttggtttttatctatcttcactgcgctcatttcttgaaattgagctgaagtgattccttgaccttgaagaatgcatttgttccggatagcgatattattcctctgtttttcaagtaccaatgcaaactagtatttccactgagaccgtgcacaaatccagtccatacgtcgggatcaacaactgatccatcaggttaaagagcagaaatgctatgaggctggtgccaatgcagcctgtagtcatgttgtgtaaaaattatttaatccccaaatccatcaaggcaggagaaaaaaatatactcaaaatacgtaaagtcagtttctatacaacataaatcattgtccattgcaataaaaaaaaacggtaacataagaacttatagatgaagacatcttgtatcaatatgagaaatcatctattagtattgaagcatcaaacatcatgtagtgtaacatctcaatttttctactgcaacatgagaaattatctattaaaacaagatcaggtaccacaacatcacaaactaaccactatgacataacccccatagtttttctaagccgagcatggagcaccgtacccatagaaataggattggttttcaagagcgtagtttaaaagtaagcatgtgaaatgctattttcagagctgcttgcacccagcatcttctgtaaaaaatctaggcgcaattcaaaatgcactgcgtaaaaagcaatgccaggccacactcatctcttcagcgtggggcctaaactctctctctctctcctccattatttatagtcactttatggtggttctggcagtctggctcagccttttatttgtgtttgttgtttttctctcacttttgttttctgtggttcaaactcttcctttttctcatgtcatatggactggagaagccatgctccgcgcctaggcacaccaagtagagcgtggcagtggtggcacacaggtgagcagcaaggcggcggtggcggacaagtgtggcgcttgtgggccagtgtggctgcgcggcaatggaaggctcgtgccggccaacgagctcatatcttttctttttttttcgctcaaaaattatttttgaggtcagttgcttaaaggtctgtttagaatctctaaaaataatagttagccgctaaacagtctaactaaagcctcagcgaaatgttagcttagatcccaactaacaa

SEQ ID NO: 4945 - DNA, 1084 bp, Zea mays
  misc_feature (1)..(100): optimal_loci_264654_G1, chr7:165316738..165317821, Cluster 30
gttaccaacttaaaactacctatccggaccttaactaaaacaagccctaaatccgaactagaagtaactaaactataactaactctaaaaataattagaactaaaacctaaaatcgactaagtcatctaactctaacgaaaactaactaagaataactaatttaaaatgaaacataaccaaatctaaccgtaaaaataactacaacttaaaaaaaataaatttactaactaatccaaccctaattaaactaaccaaatgtaactaattaaagtaataaactaactaaatataaacaacaacaaaaaactaaaataaaaaagtagatgcagcaatagctggccgagtcgacgtcgagggttgcgtaggcgggtttgagggaagcgtcgtctgaattcagcgatcaacggcaatgagagaggctgcccactccgcagtttggtttggtatagagacggtgagcaaggccaccggttgagagagagtgtgcgtgggagagcgagaggaagatagaggtagctagatttcgtagggcttatatctatattttttataaaaaaaacaatgctattgtttattaaaaacagctcaccagctattcggctgcctcgtggtcgttcctccagcgaaggagtgtagaggtagagccaataggggcactacatgtggtagtagtaatcgtcagcaaattaagaaacggccaagagtccattccgctccgaattatgcaaatgcgtgaatctgacatcgtatctataccgtgtacaaatcatggtttcggtgaggaggacatatatattcgccaccacggattattccgcgccccggcccttttgtgctcgatatggattcgaagtccacatcacctagactagagggggccgtgctgatgtggatccaccagagcagccaccatggggggaactagaactaatcagcgtcagcgcctcacttttatctatgtcaccaccgttatcaaacgcggtgataagaccaaacccaaagattctccgcaaattcacgcgatatatttggaaacagccaaggtgcttccgatccatgccaagcctcccccagtcgcaccaa

SEQ ID NO: 4946 - DNA, 1106 bp, Zea mays
  misc_feature (1)..(100): optimal_loci_266136_G1, chr7:173036894..173037999, Cluster 30
atatttaacaaataaattagaatattttggttgtattgagagagtgcatgcatttatctcttcgtgacctaaacaaacttgtgaagcacagtttcgatgtggcctttcaatgtggcctaaacaaacttgtgaagaatacaacaaggtgttataaactcaaaaaggcatctattacatttaatgggaactaagtttaaaacaaaataataaatcatcaagtgaaatcgactaggacttgccgtaaaaaacagctacgtcataagcagtaagtaaataacctcataatatagcaacactagaaaattccaaaaccataatgttgtattatccaagattttgtattgctcaaatgatattaaatacatgtgcatgctcagtataacttcatttgaatgttcatttgttggatcatatgaacctcttatgcaattctatgcataaatacttgtcacaacaaggtggtggtgattggcttttgtatccatatgcaatttgtatgatgaatcatcatgaatgcataatatcttattatagtacaatgctgccttattagttacccaatcgaccatataaatttcgatgactgaaggatgacaatgtcatcaacaagtctaacaagaattactcgtaatgcaccatcaatgagagacattgcataattggaatagagctaaaaacatggacacattgttccacatccatcatctaaccaacaacccaacatcgagcataataaccaatataggtccaaaccaaggcacgattcaattgtaaacttaccacgagcgataaaaaattaaaacaagttgttgttttgttgtgcctctttttattcataaaacatattatccttatgttatttttcctttatcaaataacttgaccacatctaatcataatagggtgaaaattttaatgaaaaaagcgatatatagaaacatttaacctgaagattcatagcatcgaataaaacgatattcctacatacataagtagaccacgccctaatataaaagaaataaaatatattagacatgcattgaaggtagtttaacctcgaatgatgagacctaatgttctaaaaatcactagtacatagaaactcg

SEQ ID NO: 4947 - DNA, 1287 bp, Zea mays
  misc_feature (1)..(100): optimal_loci_266169_G1, chr7:173218722..173220008, Cluster 30
cctgcatactagctagaggggaatggagttgagatgattattaattaatcgtttgagatctgcatagattagcgagatctactgcccaactaacctgtcttagacagggtccaaccacgcacgtgccaccttcactcgtcgttgaactgatcaacagattataatcatcagaaaaaagaaatttatgccttgagcatttttttagcttgcttccatgcagcagctagccttttgtgttgtacgcatgctagatatattgttggtggtgtagcatataaaatcttcctttgcacttcttttcattagagtgatagattatttcagttgggttcctttctccctagtctctagtggtggttgctctagtagaccaaaaaaatgggttctcttttcatgaaagttcttttttttttgctcaatgcatgcatgtgtcgagtggttgagatatatccattttaatttctctatgtccttcgttctgttcccctaaaacaattgcatgcactactatatatacaattaatgtgttagctcttggttgctgcttagctactagtcaaagtctttggagtgcaggacttggaagtggacgagagtgtgagcaatattgaactcgggctgacagccaatattgatgcctttttctaacttgtgtgttgtcacgagcgaggggcctacgtggatctccataggtccaaccaagcaccgatgcagaaaagaacagtggttattagttaattacccgactagtgacaggaatgatctacacaaaaccatattacaatatgatatatataattattgtatccaaaagcgttaaagagagttagcgcaggccacaaaaccgcccggcgggttggcgaaacccgtgtactgatcccactataccgatcatagtgtagtgttcacttctatttgcagctaactaaagtgcaccatgaaaataatcccaatatgatataattgtttgcacttatttgccctataaacaaacactgtactcactacttacacctacgcacaatcaccgctataaagcacacctagaaacgacaagatcaccatggaccctttcttaatgttgtggtttttttattgatgtttaatttgcactactctgaaacatgttttcgtgccaatgcaagttgaggattataacccgaatggataaattccacgctgcaaatggacataacacgaccaatataattgagctcagttcactgtatactttctgtgagctaattaacacacacatacgcacatccactgtacctagtcatgcat

SEQ ID NO: 4948 - DNA, 1198 bp, Zea mays
  misc_feature (1)..(100): optimal_loci_267464_G1, chr8:3490636..3491833, Cluster 30
ctatggaaatactgttgattactctttcattagtggatacaaaactaattgttcaaccaacactccgaagcagctaatatatttacttttaatactgttaatatatttactttgatcacgaataagtgctgttttaagaggataacggataagtgttgtttaggagtataacacggtcacagatcgcaagcttgacaagtagtaatttttttacagtaactacacaaaacggtatgaagaagtaatttcacacaaaattataaggtatgaagaagtaattacaccaacatagcatcctctaaatcgactttgggcgacatttgtcattgatgcgacaaggctttcaggtttcagcaccagacctgcacacttgcatcttcccactatcacggtattgttcttccaagctcagaaattagtagtagtaattcaaataaagttattactaccaatattcaatcattgaaggcacacccaccagttttatttcgatcctgatacagatattttgaatgactgtttggttgtcgagattagatttcgattaaaaataatagaaaaatatataaataaaaatatgctgatgataaagctttaaaccttttgtgggtgaataacaacttaaataaatatagctacattttaacttgttgcacttaagacagattagctgaaaaatgactgagacttcaaaccttttgagtttagaccttgcttgcttgcactgttccacattcgtagacagcacaaggtgaatcatactggccgtcgtggccgatctcaggtttgaaatgaatgcatgcacctggacgtgttggaggcttcgttcatgtctacaggctgctagggaggtacagtgaacgcacttgcgtgctctctctccttcaaagttttgaaaggtactccgcgtttgttcggcttcagagttcggaccgtgccatgctcgtaccttgccgtcatcacggcagtattcagtgagcagagcaatgtacatgtgcggcggtctgaccgcacgcatggcacttcttgccgcgacgtgctgctctcgccttcccatgaaagtagaagccaagggttgatttttaagtcaatcttctattttctatacataactactgtattattgcgctgccgtttattataaatcttgaatttatttaatttaaggttcaaccaatctctactatattatttgaac

SEQ ID NO: 4949 - DNA, 1281 bp, Zea mays
  misc_feature (1)..(100): optimal_loci_267652_G1, chr8:4598251..4599531, Cluster 30
attgatgtaaaaatgacatattttcatatactcaaaataatgtcacaacaacataataaaaggaagatggtcatatcatgagcatattttaccaaataacaagttctacatgtcgatggtgtatttctttgtagaactatataaaatggagaagataagcttatgggcccaccataagggggtcaaccaaccactctatggtgctcatagccctttcaaatttgacatggtccatgtgaaacactcctaagtgattctcaaccattggatgcaatgtgtgttttctctcaatggtggaagatcaaaacacatggattcgatggcccacatctcagcaaaaccaacatcaatgtggaccaaaaaggatgtacacccactcaagaccaagctaggacccatcgcataaaagaaggtgggcacacattgcatagaggtgggaaaccaatcaccccttggtttgacaaccacttaagtgcccctaatttgcttcactaccttcaagtatggaggcatgcataggaacacacattaagaatatcatagtccttgatttaaagtcagtttgatttaatggcataaaatgatgatcacatggatccatgggctcacttaaactagtatcaacttaggggtgcactccctctccattcatgaactcaaacttcaagtgcaaagtagttccattctatcttgtagtataagataatttagcgtgggagtgagaagtagagtgagctttgctcagattttcggattcgaccttctagagagtttggtatatatcttatacctttccatttttagtattactttacattattcaatatattattaattttgtaccttatttagtatttacttcatgcaacattaatttagtgctagtgttttgtggttaaccatagcttatggttgtatgcttgttagattaattatcaaggaccctaacatagtcacatgtacattgatttgtgtatacacaattagagtatagagagatagtgtaaaattgttgttcatacttgacttgctagtggttattgcttatcgcatggattgttaaagtagctcgcatgtggtgatagccctatcttgtgtttatattccgtcatgtgttataggaaggttattaaaatagtaataacaagtcagccgctttgagtaagagttttgtgctcttactatatcatctaccgcctcatatacttgttgtgtggacacaatctccttatttacatctgtgcaattaagatagaaccatagaaatatagttggaatgat

SEQ ID NO: 4950 - DNA, 1294 bp, Zea mays
  misc_feature (1)..(100): optimal_loci_268260_G1, chr8:7743810..7745103, Cluster 30
caaacatgattaaaagccatcgatgaaatccatccaaggagatctcaaaccttgtctagcccctcttcgttcaacactctcacttgtggaagttggtcaagagccgaagcagcaaccactatgattaacaaggacatgaaaaactatcatggaggaaggaaggcaagaggaggaagttgatcaaagagagaaggaggaaagggaaaaaagatctccaagtttgcatgaaaaaggtaaaaatatcgtgcagaagcctattttaaacctttctctcccccacacagttcatagtgaagaacccaaagcatcgcactaccaacatgaaaaggcgagtcatgcaacatgatagatgtacaaatgaaaactatccagccactatggtcatcacacccaagtgttccaataggtcaaatctgtcatgcgtacttaggactcaagccctagttcaaaatccatccagtattaccaaataaatctctccacttaaagattagtagtgattcactttcttccatgtaatgattggattctgagcctaaggtacaccatatcatttcataaggaggacagacacaaaaacatgattctaccaacacttcaacttctaggttcaaggcaacaatgtctttcaactagccccacacatggaacaacgacacggtctagagatagaacacaactaatagcaaaatcttggtatgaattaactctatcgtgatgggccacttattcctagcctagttcaatcccccttatgcttaatttccactaggacctggttatcacagtgtttgtcgatgcccctgatgatgagatatgcagtcccaactaccagtccaacagtggacctaggggcctttttcagtgtatggggaaggacataccacccaatgctaccaaaaacacattcaacgatcatggtataggaagctattgagggtcccgactactaggattatcactctcggggcatcatgccctaggatcacccctagtcctatctagggtagggattaacattgggtaacttgatattgggggcactaaaaaagaataatagctacaccaagtcccgttaagtaataagcaacctagggcacactaggtcttaggactctacatggcctagtgcctccgaacgtccctagctagaagattataatctttgaggggcctcgtgtctcgaggcactactaaaggaactaagccatgaagcctctcatgctctgggatgctactaaaggagttaaggtgtctagggtgattcgtcccctaggacacttaacaacattta

SEQ ID NO: 4951 - DNA, 1113 bp, Zea mays
  misc_feature (1)..(100): optimal_loci_269942_G1, chr8:16774996..16776108, Cluster 30
tatcttaatgtctataacaagtaaacgtaatgttaaatgtcctaaaggacgcacatttggaattgtcactgaaattgtgtcaatgtccttaaaggatgtatgtttggaatcacagttgcaagtggtattattctatgtgagccgtcccactccagatggagatacattaactatgccaagatttaccaatactactagctaggaattccaatcactctggtctagccacctatattctcttgacctttgtttgtcaatcgttgagttgttttatgcatgtgtggagatatagagttgcaaatacgacaaacttatggcggcctctgtttgtatctatccacaaccaatctaacatgcatgtataataataattcctcctatacatattgtacaatcctttgctaattgtatattatcgattaggtgcatgagttagatgtacgtatatatatactactccaatgacgtacaagagcgaagctatataccctatatctgggaaggagccatgcgacgaagacaaataatttccctactaataatgcaaaatgcaacttgcctggacaaatcatgcatatatgcggctgtgacgtacgcacgtgaattaatagtccgccattctgcagcctgctggcctgggctgctcaagtgcatgcatgcatggtctggttgttgctgtaatgcatataaaattagccattgatctctgacggcagtggtactaaaccattattagcagacagattagtaggtgcattggatgctcaacatgtccactagctagctagctcgacagcgaatggctgacatatgcgtcgtcctttggtctcatgctgctgctgctgctgcatgctactgttgggcatattgcagacatcacaaaagcttactagctttgggtgtggtagttggatttgcttaattaaatatctgctgcatttgtctagctaccaaatgctgagaacgtacgacgaccattttctgcacgaaaaaaacagtttaggaccacgatcattgcaacagtttagctgttgaggctgcgaagttgtgctggtattagctgcattttgattctacttgttctcttcttgtctcatttagtttgttattcta

SEQ ID NO: 4952 - DNA, 1232 bp, Zea mays
  misc_feature (1)..(100): optimal_loci_270586_G1, chr8:20674363..20675594, Cluster 30
gtgcctgctacgcaccactgtgatcctggccgactgacggaaagtagtgcagggtcaatggattttaacaccagttttttttttttaccactgtgaggcctataaagaatgaaggacaggcaatttttttttacccttggagtacagcctatattcctatctgaaacaaaccattcatccaggaatatgcattcgtgcatgaatgttactagcactttggcattaaaaacatccgtgtgtgattttatagaatccgctattttagcaccgaggctgcgtagattcatgaatctgggaaccgatgcatggtccacgaccacgacctcaacctgccaacttttaagtacaccgcgacaggacctgccatgcatgcagagaagatggtagtgcacgggtgaccagaacttggccagtcgataacacttgcttgcccggctgccagtaatacctaatataaaaattatttataatccaaaagtacctaatcaattataactctccacttcgcattatacacaatatataaattaatttgttgccacgaatcacccgcccaatccattccagtctccaaccacggcgcctgtcgactgtgtattgctctcagagtctcgtgcagtcgccttccatcaaatccagatctgtggtccgtccctttctcggaactgcacccgaaaccaaaaacaggccgtcgtcgctcgccagcctgtcgcgtcgcgtcgcgtcgtatcggaaatacatctatggaagctttcactgcttacctactctactgtctactccgtggtgcagctaccagcggaatatgttatgtgtgcagcctagctacttcttgcacgacgtactagtcttcacttgaacggatatatgtttttcctacgttttttttctcaaatattcaaccgcctactcattctatccctcgtcgtctcttctattttaaacttatctatataaattatatattctgaaatattttacacgattatatatataatccactagagacaatataattgtaaccaggcctttttcatatcatatttatcatctattactattttacctattgaaaaacaatgtcgtgcacgaagcccctgccacccgccacgtctggcagagaactattacttgtgctactaccatagcctctatggaaacagacagggctatgtgttgaggcgtagcattcactaaattcgatcccttaaaaaaatattctctttccttta

SEQ ID NO: 4953 - DNA, 1360 bp, Zea mays
  misc_feature (1)..(100): optimal_loci_282499_G1, chr8:101771408..101772767, Cluster 30
ggaggagtgttcatggagacagatcgagcgggccgctaacgccgcacggcaatcacgtttctttttttaaagcaaaccagcggcgtcagccagcaaaatactactagctgattaggtgaggtggcgagccagggggtggtgataccgtcgtctctccaccaacttccagctactaccaacaacctgccgcccccgtcccgtccggattccgatccttccactaccaccaccacccccgatcgagctggttcgaaacaagccattgattgtgcccatctatcctagtagtagccagcttaggtcatagatcagctacattaatctcgatcggttgggaagctagagctatagaatgtaccagacggcagaagcaaaggtaggtaggagtaggtacgtagcccccgactagatgtgtgtgagctactgagatgaacgctcatctgatgaatctaactaatcacgaggtactacactactactactaccgccaaactgggtggggggcaaattaacgtgcggtgcgttgcatgttgacaactgcgagtgttcatgcacgttcagagaaaaaaccaataaattagtgctcttttagtctcaagttcataagggtttataaataatccaatcatatccccatatagatccactatagctatactattctacgattaatgtgacagtatttgttacaaaatacgtaaatattagtgttgttgttgttgtttcacatagttagttaaattttgggtgactatgcgtttccgattttgtatcagttactctaccgatgtatcaaattctaattcattctatatcaaaaggttttaaaagtatcatcttaaaatgcttccggttagatatagttttcgcttggttatatctccctacgataggacaaattagaacttttaagtttaataatctactagtagagtaaacaataaaataatttataacattttttaataacttttagtacattgaatcctagctaaaattccgaggctgattgatctttctcgatcggatatacatttgttttaagacggaagtagcagtagaggtcttttctcgcaggtagggaagcgttgtgagtcgacatcaccaacaaattcttgttccaggtaattaataagatccacggcatgtgcccgatctctaggggaacgcctcgcgcacgaagcaaatttgagcacgctgcgcgtccccaaactgcgacctgcagccagctgccagccatatataactgcaggtgctcggttcgttcgtacagtactgaatgaaatgatgaaccgagcagggacaaagtgccacgatcgaatggcgatatgattattttcataatcatcaattgttcata

SEQ ID NO: 4954 - DNA, 1133 bp, Zea mays
  misc_feature (1)..(100): optimal_loci_282620_G1, chr8:102452216..102453348, Cluster 30
ccgtagggacccagaggacaggagatggccctgagcgtcaagtgctattaagtgctttgagggatagactatcccaagaacccaaaaggccttagggacttagatttctcatgaatttcctatggcacaagggcctagagacttagattattctagccaaggatgccatatggcattaaggccctgggccttgaagagttgaagtgcctcaagccccgatggccccaagttctcttaatggcttcatacaggattttgtggtatatttattcctttggggtatcctaatatcaagttaccgggtgtcaagccattgccctagctaggaccatggaatgtacccacgatatgaggccttgagagcggtggtgccaataggtgggatttctggtagctttctataccataatccttaaacatgtcttggtggtaggagacagtatagccttccccaaacactgacaactatctgttatgaagtagtaacataagcaagactgagttgccttctttaaagtgagccaccttcgtagttgggatgactaggggtggtcttaacatgagagttttatttgcatttagctatatagacatttttgatgacatgccaatatttttatgaggaaagagaagaagtgagtttcacgggaatgaactctagtaggacaattatcaactctacatgagtcatcatactaattgtctatgatacaatagaacaaaactttccattaagagagagagagagatgagctcaatccaggttttatttcattgtatgtaacatgacaatcttgaaaacaatgccatgaaactttttattgagactcctcaagtcattctctatggagagtttcattaaatttttataaaaaatagaatgcaacaacaatcacactcaatgcatagttttattcttttattttatagacatttaattatatgacccatcttgaattgataactgagttaagagagtttcatctacacaattttttccatcttaaaaatattgccacatcattgaaaatgcttatgtcgttacttattaaatacaaacgaaactcttgtgaaactccattgagaatgccctaaatttcgatttgtattcctaaagctaatagttagctcct

SEQ ID NO: 4955 - DNA, 1159 bp, Zea mays
  misc_feature (1)..(100): optimal_loci_282945_G1, chr8:104269278..104270436, Cluster 30
tttagtatcataacttgatattcaatttgctatatgattgtagtatataaattatataatattaaacatataatttaataattccttatttgtcatatagctatgaaaattattatttcaaacactttatattgtcataacatcgggttcaccaaaatgagaaattgtattttatatggttcttattaaacactaatttattatagtaaaaatagattacttcaatatcttgtgaattgataagcaatgtcttgattaattctatcataataattctagtgatttgattattattcaaatgtgaagaatgcatgtggaaccattcagaaattacagatcatatacatgtaaatgttaatttgttttagttctttagtaccaattaaacataattgttatatggaaaatgctaatgatgtagtttatttataagttgttgttgtatcgttttttatgcaagattttatacttactaataatatgcaggtcatgactcctgaaaacaaagatgccacgccatctaaattaaacgtttgatgaggacacttgatgaggacgtgaaggctaaattaagtgtgatatacaagcattatatagacagtaaaagaaacgagtccttttgttttgtgtttgttggtttaaattattcctgaggtacttcacaaagtcgacctgaatattgctccacatgtttgtgtttgggttttgttgctttgtgtatatggatctttggctttattctagtgcaaataatgtaaagctaagttattctatggagtttaacattgataattaaacactagaattttaaacatgcatattttttattaggcatgtgaatttttacgccaaacgcttgcatttgatttgatttactctgagaaaactaggtcttcactttatgtaccgcagctagtctggttgcaccaaggtatactcgatacctgttgagcgtagaagttgaaaaggcttatatagcataacaaaaattcctcatgttttttgcacttagcaagctccgatatagtgctgatcgcccgaagatcctcaatatagatgatttctactattcaaaaattaaaggtgaattcagcagtaggccaatgcaagtcccaagtaagtggtcaatagcctgcaggacttttctgttcgacgcgca

SEQ ID NO: 4956 - DNA, 1392 bp, Zea mays
  misc_feature (1)..(100): optimal_loci_2877_G1, chr1:14811335..14812726, Cluster 30
ttttataatagagcgtcgactcagtcaagttattttaaggtttaacctaatttatatgaaattttagtacttataaataaaatgagtattactaaattctccattacaaaaaatactttgtagtagaagcattacatattgttaaatagatatttgatactttcaattttttttaaatcaaactttagaaaggtgtactgctaccactcttctgctactactagataaggtcttctgttccggtggacacttgtctagttgtcctgcaggaggattcccatctttctacagatgccgccgatccaagcgcccgccccctcccgtcgctttcttcccacggccgttcctttctcgcggtcggtactccacgagggcaagaaaaatattacataccaggggcaggagggaccgggggaacgaagaaaaaaggaccgaccagcgcggcctcgacgtgacccgcgcggctcgatcggacggtgcagactcactgacaggcgggtcacgccgcgcgtgtcaggatatgctgcgcccgcatccgcatgcatgggtgtgtcccgttcctcccctgaggcgttacacgtgtcgtaggtagggctggtatgagggagtccgataatcttctttttattgaaacggagtgtgctttgttgttgtttgtctcatatcatcgacagtgtctgtccttgactcctttgtcttctttattaaatactaggtatacatcgttacaagtctcatcaattggacatgaaacataaaacaacatagcaacgaagacgaatggacttaggcccctttgacgcggatttttttttctcgtttcctctgtttttcctgtaaaaataagcgattcctataaaatttctgttccattgttgtgaaatcaccatattccaaagaaagtttttttttttacagttggacatgaaagaataaactagacgaaaaatcaggttgacgtttttttgctcctttaccactaggtatagatgaagactagtctcatcagtcctgtgactgaagatatcttctacgtttttttttcttcgttatttaaagaaatctgggtccaggcccagcgccaaaaggttcatcgtcagcttttgacacgttgaaataaaaaaggtagtccttgcgatacattatgtttgatgtacgcgctagctaaatccgccgaccaaagttgatattgcttataataaaaataattaaacaagagagacacggcatagcactagttaagctgacacatgcctgtctgaccataaagccaataatcgtgtcacgttgattttaaactgccgatccagtccaataattttgagggttgttgaggaagtcgatctccacgatagggagctcaaggcgacaatatatagccgttattttccg

SEQ ID NO: 4957 - DNA, 1101 bp, Zea mays
  misc_feature (1)..(100): optimal_loci_287841_G1, chr8:130505529..130506629, Cluster 30
acttttaacaacagtctaggcttcgaccccagtagggtattccgagtagagttcgtcaaacaacaagtgattggaagagattgcagcggtgcccaattttaatctgaagaagttggtgagcctttgtgcgaggtcatggagatgtcgtcgacaaccagacgttggatttgattgtggtgtagtctgatggagcatctggcatggaagtagtgagtgcaagcgtctccctgcttcagagctttggactttgccctctggcgccagtaggtagcatggtctaggacagcagaggacatgcatgattgtaaaaaagttaaggttctgtctagggtatgttcggtagagctggctgaagggctcttcaatacactaaaaatgtggttctcctggatactctaggatgaattctgaaagaagcaattttcagactaaaaatgaatctctgtaattctcatacatacaacgactgtgtatagtaaatccactgaacagtaagtcaagagatgatgctttttttcacacaccaagaattattatttttagaacataaacatatatgcatgtatgtatataggtgggtatataagcatttatgcttttggttgtggaaaaggagggagtggagaagatgcagcctagcaacccgaccaggcggcccttttcctcccctgtgcagtccaccttctcctttggctcggtccaatccattcctcccagatgaaaatatgtttcatggaggataacaatgaatcaaccatttgcataggctagggatgaaaatgactcatattgaggttaacaaattcatatgcttaccatttctccaatgaaaagggaaaaaaaacaaagcgaaacaccaaatattggtttaattaccttggtggggaacagctaagacctctactgcggctacgatgcatgtatcgacaaatttcagcaagtttttcctacctttgtcgtttatgctctcatttcttagcaatctcaatagttgtgtactttttaactgtaaaaaaacaacaaaagattagtatgctgagactactaagctcaataaagatctaatatgcagatccaccgacggaagtaggagttgggttg

SEQ ID NO: 4958 - DNA, 1006 bp, Zea mays
  misc_feature (1)..(100): optimal_loci_292046_G1, chr8:152893610..152894615, Cluster 30
tgatgttctggcgagaaaaaagttgacacaagaggcttttataagaaaagttgaaacaagatggttgccaattgtttctatgcatggataatagaagttaaaaacacaaatctatgaggtgcatttgagatgttaaataatgtatggtagcttttagaatcttcagcacctgttagactgatacttatgtcttaagcataccaccaacctggaaataaggtgcattggtagttcaagaaactgacaagttttgccatgaaaaacatgtaaaaaattaagttcaatggctataatagaatttgtaacgaaagaactcttaggtattgtttggttcacgaattgaaacataatggtaacgctaatgatttacactcgaatgacagcggtaataagtatgaataggccggtatcagtttacagtgtggtatttgatgaaggggacctgcaaaaatgcaaattaccaaacattttattaactgtttgaatttggaggtgctatttgtaggaactgaaacctctatagaccttagttattgaagtcttgaagccgactaacttttatgtgccttcagcttcaagactactacttctttcagtcatttgttttggtgcatctttatttaccctcaaaccattttgataaatgtctctttcagcatatataccaataaaatatgaggttgaactatcaattgtgttttcactataaggacaatccatgtggtgacgtgttggttaccgttgtatttgtaccgttgaatccaccatcttgttctcaggagtgaatctttgatcaacacaattggcagtgtcatggtctcagggtttgggtaacttcgtgctatgcttttgaacctactttatggctagagctattatggatttagggtactataaagcctgtaaaattaccatagtttgaactaagtcttttttatctactggagtacaacctttgcgtctagaaatatttggtgccatggtagtaataagatatatagaatta

SEQ ID NO: 4959 - DNA, 1213 bp, Zea mays
  misc_feature (1)..(100): optimal_loci_292063_G1, chr8:152968655..152969867, Cluster 30
tcctagaggatctaattgattatttgtatggtgtctgtacactgtatactttgataattgttgtggacctacggtttaatatattgtatattgatatagtgatttgaaatgaaatgccctgctgtaaaattctggctctgccgctgacctgcaactgatccaaacaaagattataccgagagactttgacgtgctgaatgatatggctaactaagataatatgaatgatgcgcgtggcaaggctcagacaaacttgtgtctgatattggcaggcggtggctgctcttgctgtagctatagcagtcaagtttctttcatctagtgtgacaaagtccatgaagcctaccaatgcaagagaaatttttagagggttggtaagtctaacacactaccagactacctgctgctgcacgggttggtagggccagtaagtccaacacaaaaccgtctcctgcctggctgtgctgataatggtatggatgtggagataaccaatactttgcgaggtatctctttttattctattattattattattatcgctgatggagtctgtttttgtttcacccatttggaatcagcatgtaaaagtacgagtacatgctaattaggtgctgcctaaaagttgagagagagagagagagagagagagagaggtaccctggcattttatttatggagaagtacgtttcagattgttgggacagcctatattattacgcatgtgatgtgcttttctgtatcggcgatttatttatctagccttactaagttgcagcatctgtcagcgtatagcttgacaagtctttgtgtggaagattatgaatagagctcatatcagttcattacttatgacgtacggaaacatgagttcatggttcatctggtccataatgtgctgttatcgtctgaaaaaaatataattactcattgaatacatgatatttcgtttacttgttctcatactgtgaaaaaatgataaaatactttacattaagataatcttgtcaacccgtagccgtagacaatggacacgatgagtgtaaacaaccaaacggcgactggctcttgtaccagctcagactgacttccaggccattcgaccaaccggcgcctgactttcagggccaggccttgttgcaggtgaatacaggcagagcagcttccaggcaggttagtacggcaggcaaaggttccatccaaagtagcccta

SEQ ID NO: 4960 - DNA, 1026 bp, Zea mays
  misc_feature (1)..(100): optimal_loci_292506_G1, chr8:155535786..155536811, Cluster 30
cattcaacttctcaataccagaccaaatgcccatatccatttggaatatgtttcctatagctggtccaaataatttagaataatactgggtagcatgttctagaatgttttcattcccaactattttcctatcactatcttccaggaaaactatattatttttcctccttctcccgtttgcaatacgatggaaaaaatcattattaccatcccatgcaacagccaattttcatgggacctttgcttccaaaacatttcttcgtcatctagcatcagaaagttttctctcaatagggaacacctcaactcaagctgatgtgcgtctaagtcatcaagctcctctttctcttccaacaaattaagctcaaatgatatttggtctctcctctttttttcatccctttcatattccaatcctagcctttaagatattgcttgcaatgcttcaacttctgctggattttgtccaaattacttttggctctacatggtttattctagatttcctcagtaatatttttgaactcaggatgagataaccatccaatctcgaaatggaaggataactgagtatggttcaccattttctcagattcaataatcaaaggattatgatcagataaacttctaggaagtttttaaattttcacaaaaggaaagatattctcccagcttctactcatcaaggccctgtccaatttaaccatggtagggacttcctgattgttagaccaagcatatccacctccagccatatggatctccattagttggtgtttatgaatcaattcattaaagggtccagaataattatgcaaacatgatctttattcttctcatatgagaatcttataatgttgaagtcgccctcgcaatgtaaggctcattgttgttttcacagaactcgtcaagctcttttaaaaaaagatctttgaatctctcgtgaactggaccataaaccaccattaaattccatttacataaaagagatttgtccccgtaagtaacttgcaatgtgtgtgaaag

SEQ ID NO: 4961 - DNA, 1194 bp, Zea mays
  misc_feature (1)..(100): optimal_loci_292896_G1, chr8:157742025..157743218, Cluster 30
ttatacgtaaacaggttcatatctccacgggaaacaccaattaagatgtttaagagacgataattatgtacgtatagcaacctcaaattctcgatgtcgttttatagtgacaagtacgagagtccacaccatcgaatacaatgtacttgattagtcgttgtaacctcacatcctttttataatgtttgtgggtacgtaggtctacaacccatgcatatcaacaatgtttgttatgccaacatgcaccatgcaatgttagccgtcgacctcgtcatatcatccttcgcagtaagtgtggtagactagagctttatctcatttgtctgacacgccacgtcagtttggttagaagagcaagtgctgcccgaggctgtgacataaggaatgtaagggtttgcaaggccacaggtcctgcttgatctgaggcttggccctaagggcgaaggtcccctagaatgccaagataagcccacttcagatctatcttctgttgatgaggttttcaaggatgctttgccaaaatttaacaatatgccttctctcggtgccgacagtggctcactggccctccataggccaaggtgtctacatgtgggaccaatattgccacaaacacctgatatggcagacctgtcgtgatgtttatgcttcttatgttgtcggtgcctggggtgacgtaacaaccaacaaaccctggctaagtagtggcgcacaggggatggcagagtaagtcgtggaagcgacgacccactgtggcagaagtggtagataccatggtttagccactcttagggtgatgcttctaggcttttgttgttgtatgcattgctccgcaaagaggccagctgtcagacaccacgtcaacctgacttgtagttcaagcatcatgcatagccatatcgcacgattctcgaaatacaagagtcgcacgatgtttcagatgctatgtccaataaaagcaagagatagatagagaagggcgtctttaatctcaagcatcatgttccatcttcttatcctccaatactccacactacattaccctatgtaagctcgtaacctaataataatgtgtattacgacagtaaatatattatacattttaaacttagaaaactggtaaaaaatcttaaataggcgagttatattgtttaggggagccagatcgagagaatggttggagacaacatgttt

SEQ ID NO: 4962 - DNA, 1138 bp, Zea mays
  misc_feature (1)..(100): optimal_loci_293703_G1, chr8:161529052..161530189, Cluster 30
agagagctagctggtctcgattgttccacggatcgggacgaccacgccgacgatggcctaattgaattgcgcgcgtacgtagtttgtagttgtactaccgagtagtagtatagattatgggacgaagcgacatttcaaagccactagctactaccatcgatctgatgagtctctctgactgtgtgtgggtggccgccactgaactaaaaggttcagcattcatcatatagatatagtcgtgtcaacaaaagctagcatcatctcagtctcagtagttttagttaccagggcaggagtacgtacttttcccagttggaaaccttatggttactagctacatcattaattatatagctgtttgttgagccacctgacctgctgatacatgcatgttaataactattatactcatcctggccttgcctgcagtgtggtccggaccattcaactaattaatgatgatgcagatgtctcgctactcccttcctgtgtctacttcacctcttgctgatgtccaataactagtacagcgtgcatgatatccaataattgttgggttttcttcaattttcgtacggtccgtcccacgggaacattactagttattagggcgccacctcctcgtagatctgtgagtacggcttctatatgctataccacacgagatcatctatcatcctagattacttcatgcattattgacttcgtctacatatctatttggttgccggtacgacggagacacggttattgcataaacagatacagaacaatctattttaaagtaatttgacaatatcggctcgtacactgaaaaggtttgggagaagctggcgcgcagcgagccaatataatccctccgatagtgtatgaaaagttttaaaaaagtagtagaacatatagcgtgcttttgtttgtttgcttatttgtttgggccaggaataaacttcaaatgacagattccatttgaaacctgaacatgtagcgtgtaagactgtcaggctgcgctctgcgcaggttcttaccagccaaacgaccgcgaattcgatctgattcctctcacacgatctctcttccgtcgaaggtgaacaaggtcgaccaatgaatagtgcacctaatgaatcaattttatgaaact

SEQ ID NO: 4963 - DNA, 1322 bp, Zea mays
  misc_feature (1)..(100): optimal_loci_293837_G1, chr8:161897471..161898792, Cluster 30
ttggaatcaccaggagggggaggactgcacagtgtggatataggactagggtgcatgctgttggagacggaggcggtggcagtccgcagcattggcactgtgggccgaggttgaggagcccctcaatgtccagcgctgccaggaggccattatggcctgcctgcagcacaagatggctaatgtcaaaatgaagctctgccaaatcctccgctttgtctacgagaagatggtgcttgacggtgcttggcaccaccgagatctagtagttccctcttctttgcacagcgtgcacatctgctggtgtgactccaggcaagggccccctgagtatcggctgcagttactctaccttggcatcacgaaacccaagtctgtggtgatcacgttggttgtgatgtgactccaaccttgagttcactgccacgagcccatggtagggagtactaccacgatgataagccggaggaagaggatgtagttatgcttattgactgcttcttgccttgtctatttttctagacatagaaagcagcagggagatgtgctttcataggcgagggctagcattgcctgatttagcaccattaggagcaaaagtaatggagtggtaaatttgaaagtctcgtacttgccatggtatcttacagatgttgattgatggtatttctgaaagcgattatcttttgatgctccggaaccaattttccttagttggaaataaaatatttaactatccagattttctttggcagaatacaactaggccaagaatgataagtaagtttgactgtgattacttttcacttatgtccgtgtatagaagctagtaatggagccagataacttaatgtgtgtaaaagcataatgtttgcaccataaaacattagctatttttaatattatttcttgtcatttttgttgcctgtaacttttctatggtttttatttaatatgccataaatattgctaagttgttacgatagcatctgatgaggtgtttgtttcctgtcagtttttttttcatatttgcttcgtaagtttgctaacacttgctaatgccataacagagggcgcaaatggaatcctcttaggcagaggttagatagttatgactacacagttgaacagcacgtggttggttccctgttgtttacaccaatcctacttcttatacctacaacttctgtattctatgtattcttctctatcttgacaacaacggttatctgggtgtgtgtgatgctggaaattgtcattgctctaatccaatccactccttatgctgagttaactctatgggtgatgaggaggcacagatttcc

SEQ ID NO: 4964 - DNA, 1306 bp, Zea mays
  misc_feature (1)..(100): optimal_loci_294168_G1, chr8:163897444..163898749, Cluster 30
tagaattattagaaaatgatacagattaaatccaaacgaatagtctactacactatgtaaatagtactacttctaatgcaaaacaatgtttcgcagaactatatacacaatatgcttagtagtatataggccaagtatataggccaagtgatggcaacgggttgagtatggtgcatttaaatgaatacctaacttacaacatattagttattgggtagaattttgtacccgtacttacattaaaaaagttatatccatatttgcacctgtcgggtaaatattcgtgagtatcctatgagtataagcattttatatggtaatatataaaattttatacctgtatcatatccacgagtaaaattttatacttgtatgtatactcgcaagtagaactacatacgcatacctgcacccgtcgaatacgatacaggtagtatccataccagtagatacgattgccatcccgcgcggtacatgctgcaattttcccctattcctacgttttctcccgtgaaaactgtgaactgcatgtaatttctatacacttccaataggatacccgcgtccctaaagtcatctcaattttgatgtgttaagtagggtcacaccaccatgtatatatagacaatgaaaaaatatgtataaccctctgacttttaaaggataatctatctcgttctctcacctttaaaactgattgtttaacaccccagcttcacaaaactagacaaataaccacatgtgcagttttagttgatgattttaatgacatgacactgaattaagtggtctaaatttcatcatcaaaccctatgaatagtagcgcatcttaccaatgagacgagtctcgtgatctgtgaaaacagattaaagagttctagggtgtctctgactagtctgacaacgagcgttagaccatataatgcagttatgttagggttttctctataggatcgttgaaccctatggatagtgataatgtcataccaatgagttggtttgaggacctatgttgagtgactagagagttcaactggcatcagtctggtctggtggtttctcacaatagttctaatacaataagtacacaattgtcgttatgactcattggatcatgtgatttggtccgacgggtgagtgacgaatggttcgacgatcatgattttttgtcaataattattgtaacaactaattgtccagttaagggctataaatatccccaccaactgatctatattggtactcttgtctaatttaattgtcgaagcaatacatattgagtgtgaaaaaaggtcattgcctattg

SEQ ID NO: 4965 - DNA, 1014 bp, Zea mays
  misc_feature (1)..(100): optimal_loci_294176_G1, chr8:163915963..163916976, Cluster 30
accaacacaaatatcacgcgttaactgaacagatggtgtatcctatttggctcgacaatgttagatgcttataagttgttttggttttttggtatatcaattttaccgtgtatttagatataatgtacacaaagatacatagcaaattctatgtatagagatgaaatgacttatgatttggaacaaagcgagtatatagttatcttcaatcgttgcccaataatatctactcacgtgatcaaagctatgtattctatcttcttgaataaatagattccatgactaataatttgtccacgaataaatcaatacgtaggaggctgaatagtctaccaacttatttgttatcctccaagtctctccaaatttactataccccctccctcttttccaccaccactgcgccaaaattccctaatttaggtttagtttttgtaattggattgggtgtagtaaatgctataattagcatgcaatttgaatagtccacaactactttagttaatgaaaagtagtataaacttttttctatcatactattctattctaaacatgctagaaatctatttgtagatagagagggcttatgtatctagaaaaggtagaacgacttataaattaaaatgaagtaagttgaaaatattcattaaatcatacatgtttatgagatcttcaaatgttttacattagaaatataccatatatcttcaatgtttccaattagataattcaaaagttattttgtactagttttgaggtttgaccaacattttcttaaacatcatctttatttatgtagtgtttcattagcatttgaccgaaatagggatctactccctctatttcaagtttaagatattttaggttttctagatatatatcttttgttataaggttagatatacactatacctagatatatagttaaagaaatgtgttgggcactcaggatcggggtgcccaaagaaagaccaagagactcctcaagaacgacccatcgaccaagtccctgct

SEQ ID NO: 4966 - DNA, 1227 bp, Zea mays
  misc_feature (1)..(100): optimal_loci_294684_G1, chr8:166564209..166565435, Cluster 30
tagaattttgtatttaatttttgggtgtacttgcgtcctcctagaaataatctagcctcaccactgccgttttgtccatgttgactgacagtcctgtgtcgccatttcgtttttgacacacggttagatactagaactaacgcaaggagcgtataaagaactaaaggtaaattttaggctaaacaggtaagtttaaagctccaagggcaagtcagattttttagaggcatggaaggagttttctccaattgcctggatgaagggactgaatgagggtcacttgggctttagtggatttctatatttgtctgttgtttgggctaggccattccagtcccagcatgtccacggctcttctccagtcttcccgcttctgagaatttgggcattgcatcatcggctcggccttcccgctgtttagctcactttgatttcagtcatcgtaacaggaatgttcagatcgtgtctccaaggtttcgggttgcggtgccactgttgcattctcttctattgcaccactgcattgatagattttgttgtggacttattcgactattatcaggtctgaggctggaggcctgggacctggattcgtgtgaccaagttcccccgcggcgactactttcagattgtatgcgcctttaaacaacgaaatattttatatgtcccatgtcacttagtaaattgcatacacaactttacttttccattttccaccattccaagacatgtacacggttggcttcattttttaaattccgcatgttgcagatttcttcgatgcttcgaatcatcacaaatcccttctgacgagctgcaccttctaccataccaggtacggctacccagatttacaaagtgcactggaatttaatatgctcttttgaataataagttccatgctaaaaaaacaaaaaacaaatgaaaccaccattcatgtttcgttacagaacatgtgtatatctatgtctgttgttgtgcacacgtttgcatacaaaatatggccacacactaaagtacataaatttttaatgcacagaatacacgttcttaaatacaaagacgcacgacgtagtaatctatacattcaaaaacatttgcacacatgcatgactggtggcatggtgccacgtacaaattgccatctgcataaaaaaaagcaaataactaacctacagtaaaacagtttatgtatgcatgttattatgttaaaaaaatacagtaaac

SEQ ID NO: 4967 - DNA, 1022 bp, Zea mays
  misc_feature (1)..(100): optimal_loci_298733_G1, chr9:8185153..8186174, Cluster 30
taggtactgtccgtaacagagtcagcggtggagtggccgaacgggtggggctccaacccggcctcgaccgcttctgattccatggagcccagcccggtagatcacgtatgttggagatcatggcctctcaaatcacattcttagagcccgcttctgatacatagatcatgacctctcaaatcacgtatgttggatccatggaaaaaaaatcaatgacctcacatgtcacaaatgggttgtgccagaagcgcacggtaggagcacttagagaggtcattctatttgttattttatggactaaaagttactaaactttagtttagaaggtgtgaaccaaacactcccttagccgagcaatagcgaaaaataaattgatgagggagtgaaaagtgtggtttttttgctaaaatttgagagttaaacatcttttgcaatttgtcggtgcagtttggattgtatccgcattgcttaaagatttcacaatctcgcgatatttctcatatgttcgaggtttggctcagagaatatgtcctttaaatggtatcttgacctttaaaaagttataagtgtgcacattcttagggagtcttaagcttatcatgtgtgtagtggttttattaaaagaaaatagagtcctcgatgaaaagcagcatgtttcaactttaagaatttaatgattggtatcatatacacgggtatcaagttcaaattggtatcatatatattggcatcaagatcacttaatatctcttacatgctttctccatgcattgtatatattaaaatcatgtttgttttaatttacccttctactattgataagttttacttttatgctaatatcaatagaatatcattttcatcatatgtattaatgtatatagggggagcttaattacaatataaaagtcattttttgtgaccaatctcctatgaaagaactttcatattataaagggcggaataaagttttaaaagtggcaaaatggatataggatcacaaaatttgcccattcctagtg

SEQ ID NO: 4968 - DNA, 1008 bp, Zea mays
  misc_feature (1)..(100): optimal_loci_29890_G1, chr1:183085045..183086052, Cluster 30
ttccaaataatccacacagtgtacatcacgatccctgcaatataatagtgctctgaagatcattcggtctattctgtagagtttcaatccaccagtcaattttttttttgtgacgtggaccattttaagctcactcaagtccaaccgtaaaacctgaatccgcactcaaaaataacaactttaaaaagttgaaggacacaaaacattagcttgagccatgttttatctctgcgaacgtacatctctactagagaccgagccagcataagtcgccgcaaagcacacacgcttctcgcaatttacatgtgcattgccacgaccatgagagacagaacagcagggacagtttagaaagtgagcctagcttaactggtttgatgggaggtgatgtctgtcacccaactacttaggttcaagtcccatcgatcttagcataaatctaggtgcctatttctacttaattatcttcttgatgatgattacaataaagaaaaaccatatggttctttgtaggcctctctcttgggggtgggggacgatattgatagatgttgattcttcagtcaatgcaagcacactcaatgaagtggccgtatatatatttcctgcatgccgtcaaacgttagtgtcgccttcccaagaaaacaaataaactataattattggcgctccatgatatatctagctaggatcatattggtgttaaaaaattacttggattcgaaatctatccagatttgccaatgcaagcgcacgtactactgccgccgtagtggaaggcaacttttttcacaagattgatgacaccatatacatatgtgagacgctaattaccgatggttggagattagtcatcgatcgcttccatctcgatccatatacatatgtgcaatgtcgcttcgctttgtcagagagagacagccatgtggcttcactatccacatgattggttgattggtcggtggcgtccagacccacggcgtcgcgttgaccgcactgagctcgtgt

SEQ ID NO: 4969 - DNA, 1110 bp, Zea mays
  misc_feature (1)..(100): optimal_loci_299630_G1, chr9:11458477..11459586, Cluster 30
cgacgtcacctcgaccccaacataatatacacaggagcacgtatattattaggatcgtaggcccacggcaaaaggataaggatgaggagcagggaggagggtttgagtgctgctcaatcaactgttgtagtggttgatggggttagctagcttgtcaccttttagaccactcgtcctaccgtgccttcagctccaataggactacatgaacaagctcaaaagttgctttcattgtgtgccagatgtctaatggtgggcgttcgtttgccaagacaaaacaggatagtgtaagtggaaaatactatttctttttttttaaaaaaaaattaagcgttatggtggcgtgtagcattttttttgggtgcaactctagtgactatttctatcttgcactgtagagttggtagcaaatatcctttttttttcttttgccccccaagctctctcgccttctgttttgacgcttgtttggtgtatccaacttcgaaactggcatcatcctaataaatgcaaaaaaaaaacatacagttatatgccaagttgccaaccgatgcagggaattactgcctgcttgtcttgccgtttcgccgcgtaaagaatcgcttccaaaaagtaaacgcatctagaacggcgccattcctgctgaactcgcttcgttcccttggcaccacgtgagagtgagagtctagacgtgtacgaatgaaaagtctgcaggtgtgttgcgctcatgtggttcgaattgattcgcaacgcaagatgatggttgcttcatattttgctcaaaatacgtacatgctctctctctctctaactcattgtccctgcaaaagtaccatcgggaagttttttcctttctttctgaatcttttttccagagggggcctaataccagcaggtagactcaccctcacccatgattccatgaacagtacacaaatgcacaccctatcttgtactacctccctcccatatacactagtggacatgttgcttattaccgctgaaaacaaagatttagcacttcaaaaaaattgtcgtttttttaagatcttaaggttacctgatcggattttcatttggcttctgcggtagtagtttattccaaacgtt

SEQ ID NO: 4970 - DNA, 1009 bp, Zea mays
  misc_feature (1)..(100): optimal_loci_300039_G1, chr9:13762956..13763964, Cluster 30
taacagcttatgcaagcaaatcaaacatagacaaactgcacgcgcgtacacctccactaacaattgattttagggtggttgatttataagcatgtgatagggcatttgagggtaagttgcaaacatgcgagattgatcaatgaccagttcccagcgaagacttttggttgatttttttttccaacgtcttattttgagaatctggactgtaagaaaacgttacgtgcggaagaagacggaggagtctatagtgtttaggatataagaagcgacgttgttttatacgattttaactaaagctacgattcgtttagctaccaaaagctgattattttaagctgattattttaactagtagatcatgttatgtgtttctttcgatgctcagtcagccatgtcactgcgggcgtctgttctccgcatcgcttgtcctggtgctgctgttttattacttattagtacatctctcttccggtttcaaaggttagcaaacctcgggttccttcatctccttgtttatcaattcgtccccttgttgaatttcctcttttttttttttgcaagctcgtgtcgtcgtatctggaagttgcagggaatagatgcacggtgaagggcggtccatcttggcacctaacacatgcgatgcgccggttgctgccaagtcacaagctgatgactgtattccatgtagtcacgtcagtccatcatcaccggcagcattttcgcgtggagggaaaaagatacgtttggtttcgctagctgactaaattttagttcttgccataccagatatttggtttaaactttatagctcctatcatattgaaagccgtcctaataggcattcaaaaactcgacgtggccgttaaactttagtccttagaaccaaacacctcctaaaccaatttctggcctttgtagtagcttcgtttctgagctttcaccgttagaagcagcacccctagaattagcctcgctcgattgctcctagtaggatttcatggaactt

SEQ ID NO: 4971 - DNA, 1019 bp, Zea mays
  misc_feature (1)..(100): optimal_loci_302154_G1, chr9:26957871..26958889, Cluster 30
  modified_base (685)..(685): a, c, g, or t
  misc_feature (685)..(784): n is a, c, g, or t
  modified_base (686)..(686): a, c, g, or t
  modified_base (687)..(687): a, c, g, or t
  modified_base (688)..(688): a, c, g, or t
  modified_base (689)..(689): a, c, g, or t
  modified_base (690)..(690): a, c, g, or t
  modified_base (691)..(691): a, c, g, or t
  modified_base (692)..(692): a, c, g, or t
  modified_base (693)..(693): a, c, g, or t
  modified_base (694)..(694): a, c, g, or t
  modified_base (695)..(695): a, c, g, or t
  modified_base (696)..(696): a, c, g, or t
  modified_base (697)..(697): a, c, g, or t
  modified_base (698)..(698): a, c, g, or t
  modified_base (699)..(699): a, c, g, or t
  modified_base (700)..(700): a, c, g, or t
  modified_base (701)..(701): a, c, g, or t
  modified_base (702)..(702): a, c, g, or t
  modified_base (703)..(703): a, c, g, or t
  modified_base (704)..(704): a, c, g, or t
  modified_base (705)..(705): a, c, g, or t
  modified_base (706)..(706): a, c, g, or t
  modified_base (707)..(707): a, c, g, or t
  modified_base (708)..(708): a, c, g, or t
  modified_base (709)..(709): a, c, g, or t
  modified_base (710)..(710): a, c, g, or t
  modified_base (711)..(711): a, c, g, or t
  modified_base (712)..(712): a, c, g, or t
  modified_base (713)..(713): a, c, g, or t
  modified_base (714)..(714): a, c, g, or t
  modified_base (715)..(715): a, c, g, or t
  modified_base (716)..(716): a, c, g, or t
  modified_base (717)..(717): a, c, g, or t
  modified_base (718)..(718): a, c, g, or t
  modified_base (719)..(719): a, c, g, or t
  modified_base (720)..(720): a, c, g, or t
  modified_base (721)..(721): a, c, g, or t
  modified_base (722)..(722): a, c, g, or t
  modified_base (723)..(723): a, c, g, or t
  modified_base (724)..(724): a, c, g, or t
  modified_base (725)..(725): a, c, g, or t
  modified_base (726)..(726): a, c, g, or t
  modified_base (727)..(727): a, c, g, or t
  modified_base (728)..(728): a, c, g, or t
  modified_base (729)..(729): a, c, g, or t
  modified_base (730)..(730): a, c, g, or t
  modified_base (731)..(731): a, c, g, or t
  modified_base (732)..(732): a, c, g, or t
  modified_base (733)..(733): a, c, g, or t
  modified_base (734)..(734): a, c, g, or t
  modified_base (735)..(735): a, c, g, or t
  modified_base (736)..(736): a, c, g, or t
  modified_base (737)..(737): a, c, g, or t
  modified_base (738)..(738): a, c, g, or t
  modified_base (739)..(739): a, c, g, or t
  modified_base (740)..(740): a, c, g, or t
  modified_base (741)..(741): a, c, g, or t
  modified_base (742)..(742): a, c, g, or t
  modified_base (743)..(743): a, c, g, or t
  modified_base (744)..(744): a, c, g, or t
  modified_base (745)..(745): a, c, g, or t
  modified_base (746)..(746): a, c, g, or t
  modified_base (747)..(747): a, c, g, or t
  modified_base (748)..(748): a, c, g, or t
  modified_base (749)..(749): a, c, g, or t
  modified_base (750)..(750): a, c, g, or t
  modified_base (751)..(751): a, c, g, or t
  modified_base (752)..(752): a, c, g, or t
  modified_base (753)..(753): a, c, g, or t
  modified_base (754)..(754): a, c, g, or t
  modified_base (755)..(755): a, c, g, or t
  modified_base (756)..(756): a, c, g, or t
  modified_base (757)..(757): a, c, g, or t
  modified_base (758)..(758): a, c, g, or t
  modified_base (759)..(759): a, c, g, or t
  modified_base (760)..(760): a, c, g, or t
  modified_base (761)..(761): a, c, g, or t
  modified_base (762)..(762): a, c, g, or t
  modified_base (763)..(763): a, c, g, or t
  modified_base (764)..(764): a, c, g, or t
  modified_base (765)..(765): a, c, g, or t
  modified_base (766)..(766): a, c, g, or t
  modified_base (767)..(767): a, c, g, or t
  modified_base (768)..(768): a, c, g, or t
  modified_base (769)..(769): a, c, g, or t
  modified_base (770)..(770): a, c, g, or t
  modified_base (771)..(771): a, c, g, or t
  modified_base (772)..(772): a, c, g, or t
  modified_base (773)..(773): a, c, g, or t
  modified_base (774)..(774): a, c, g, or t
  modified_base (775)..(775): a, c, g, or t
  modified_base (776)..(776): a, c, g, or t
  modified_base (777)..(777): a, c, g, or t
  modified_base (778)..(778): a, c, g, or t
  modified_base (779)..(779): a, c, g, or t
  modified_base (780)..(780): a, c, g, or t
  modified_base (781)..(781): a, c, g, or t
  modified_base (782)..(782): a, c, g, or t
  modified_base (783)..(783): a, c, g, or t
  modified_base (784)..(784): a, c, g, or t
agatctagagattcgtcatcatcaggttattagttactaataattattaggcccccgagagtgctcactgctcacccgaatgtagcatttaggcaaatccaacccagcacagccaagttcagtttcttccacatctccctggatacaaaacagatcccaacaatcgatttccaattctctcgtttaagaactgaactaaaagctaggcagcacacgatgacgatgtgcagtaggaatcaatcaatcgaggttggcagctagcacctagatcgatctccctgcttgcggctacagctgattcatggagacagcaaaaaggcattcatctgtctgagtgactagtgctgcatcagatggccatgcatgcattatccattagcactggaattagtggtagccaggcacgtcaacaagcccctctaaatcctctccctgttcatcatagaattagaagcaagtagctagggtctagcccgaaaggacaaagaaagagatcaaatcgctttgaaatttcgcggttccagtccaatctgaacgcaccaggggtcaatggagatgcagactgcatgcaggctgtctattggttgaggggatacccgctctcttgtctccgataaaatcaattttaaatgctatctcttcgctccttattccaaactccatatttgaatatacataccaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactggtcctcgggctatagctagcttagctgctgctagttccttcttttcgtcctagactagatagaagagacgccgcagccgcggaggcgacggtggactacgagcacgaagcagctagcaatgcacgcccacggcaaaaaagggtgggtgtggactgtggagattatatattgactcagctcgaaggaggagaaaagtgtacgcggcgtacgtatataagaattactctatt

SEQ ID NO: 4972 - DNA, 1040 bp, Zea mays
  misc_feature (1)..(100): optimal_loci_302339_G1, chr9:28402467..28403506, Cluster 30
cacagaaacagcacttaaatcataatgctgtttagttgactaaggaaattgttgttcacgcaacaaacatgactttgcgatccatgtcacaacttgtttataaaatcatcatagggcatttgaataacctgagaacagcttcattccctttgcgaacaacttccttgctaattgcaccattggcaacctaatagaaaagtgagttaaacaaaagaataaaaaggcattacccaattgtcaaatatatgaaggaaaatctctcacagcaataaaataaggtagcagatcgccagtggacttggagattacagcaaaatacttctgatgtttctgcataacctgtagttgcaattctgattaaaaaaatgcagcacactacaatggattattttttctaaacaagattacatgttagcagcttataagtttagtcattgaactgtcaagaattgaagaaaagttagcttctaggcatccacaataaaaggctgtacataccgtaatcagtacatctttaggaagttctaagaaggaatcatcatatcgaccaaggatgggcacaggtgcctccacaagattgacaacctgcataatgtggtttgaaataacttaggatgaattacactttctgccaatgaaaattaagataaaaataaaaaaatggaagacatctacctcctgcagcaagctatcaggcgcaatgaaatcgccaccaacaccttgagccaatacagtagaggcatgtaagactttttccttccgctcctgcagtggaatattttatggaacattattacattaacatctagagtgctggagcacttgaaaaattacgaataaatccacctttttcctgcttcatgcaggatactaaatttgaccaagaccaaaagttcaaacctatattttaatgacaaatattgcttgagatttgatgttaagaaacctccaaatcaaacattatttagttagggcagatccagtgttggaggctcctacatgagtttggtctggacaaaggataaaccgaggcaagccta

SEQ ID NO: 4973 - DNA, 1390 bp, Zea mays
  misc_feature (1)..(100): optimal_loci_303348_G1, chr9:33729390..33730779, Cluster 30
gtcaaaaattatggctcatatgtgatccgtgaattattgtcggtcaaaaattatgacctgtactcgcctgttaaattagtcaaattagattaggtcggattttttttggacaagtcagattagattggtcgggttaagtgactcatgattagatctagggaagagggcctcgcgtccctccattgggtggcggctgagtgccgtccttacatccaactataggtgacttccatgtgaaaaatttaaaaatataactggttcataccgtccagtgaaaaggcgctagacacatatttttgtaatagtttagtttcaatatatggttttaaagttttttaaatgtaaaaatgaaaaggatacggcaattgtgcaatcagtatgtgagcgcggcccaacttgcttctaacactgcagcccaaaccccaacacatgtacggtaccagcacctgcttgggagagttctttagcattatagaactcccaacactgcgttttactggaatgaagctctgaaggcgtcgatctctaaaataggactgttgtggtcgttctattcgcccttttggaagtgaggtctgaatctggcggaggtgatggtgaggtatccctttcctctgctttgtcatcctatctccggcgagaccgtccctgcctgggacgggcggccggctcccaccagcccgaacatggtgttcgttgtcgttgactccaggtctgcgccgtcttcgccgcgggccctgggatctgttgcccctgccctccctgtgcggttcgaactcaattgcactagtctgcgtgtttcagtaaggacgtgcaggtgtttgtatgttgcttatacagttatactcacttattggttgagccaaaaatacttcactttcatgcggctcaaccagtttgtatgaattctgaaaagtgaccatcttgagcatgttatggaaactaacagcctcttgcttatgcaaacttcatcgagagactggtcaattgaactaaacaggtaagtaaactgaatgtggtctgtaactgtgaaccaatggagcagcaccacaaatatactacagaatgtggccatccaaccacaaatcaggttctgtacgggacgtgttctcctgaagcaccaattctttggcaagaaacatggcccaaggtcagccaaccacttaacagatacatgaaactgtactgaaaccaattgttatgtgttcaactcactgcttgatagtaatacattgcaggcttctactgacaaactgaaatctcatgtctgtggaacttcccagcaaactgaataaataaaatagaccgacaaaaactgggcacaaaaacagacttgtaggacaaacacactaccagctgtttccattacattgaatactccaaaccattg

SEQ ID NO: 4974 - DNA, 1008 bp, Zea mays
  misc_feature (1)..(100): optimal_loci_307208_G1, chr9:59843915..59844922, Cluster 30
taatactgatgcagtgactttatgtgtcccataaacacaaaatggaccccgccactccccaagtcctacatcaagatgacaatagagatctgatctttgaattcctatagaaaactccaccaaatattgtatttcataattgtgataggtttaatttttttgtacaagaatgaaatggttaaaaaaacttcttcataaacttatgtgggaccgggataaagatttttctcccgcatgaggcatagatggaaagacattttgacggggaataattctctattgacattctagatcccacatgtctccactcaacacatagatcacatcttcccatgctcacgtcttgatcaagggcacaacaatcttatggttgtgatccattacacaccttatgaataaatacatggagcatgaatcggtaggtgaaccgacgtttgtcatagcctcctcttccttacaaagtcataaggctcgatcttcttgtaagcatggttagtggaaggaaggttgtcaccgctacctcaccgtctttgaatcgagagttatcatactaatggcatcatccttcaattctgaaagtataatatattagtttctatgtatctagtggctagagttatgggtataagatcctagatcatctaagagtgatatcaaagcatgaatgttgcctagacattaaccatacatgtgcaaaatcctttggttttagggatgaatccgagaaaacccctaaaaggctaggatccgtccattagatagcaaaacccacaaaaggcttggatccaaaagagtttcaaaaatcttaaatttagtcaacaacaatagttaggagtgataaaacaaaattgatatacacaaaaaaattaactcctaaaatggtagtgacatcttcttcccaaggctggatgcaacgggaggtggtatcaatcgcaggggaaagtcgataccgacttgtctaattctaatagtggttggttcggctagtcggttggtgggtctatcaac

SEQ ID NO: 4975 - DNA, 1101 bp, Zea mays
  misc_feature (1)..(100): optimal_loci_30777_G1, chr1:189484672..189485772, Cluster 30
  modified_base (962)..(962): a, c, g, or t
  misc_feature (962)..(1061): n is a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
  modified_base (998)..(998): a, c, g, or t
  modified_base (999)..(999): a, c, g, or t
  modified_base (1000)..(1000): a, c, g, or t
  modified_base (1001)..(1001): a, c, g, or t
  modified_base (1002)..(1002): a, c, g, or t
  modified_base (1003)..(1003): a, c, g, or t
  modified_base (1004)..(1004): a, c, g, or t
  modified_base (1005)..(1005): a, c, g, or t
  modified_base (1006)..(1006): a, c, g, or t
  modified_base (1007)..(1007): a, c, g, or t
  modified_base (1008)..(1008): a, c, g, or t
  modified_base (1009)..(1009): a, c, g, or t
  modified_base (1010)..(1010): a, c, g, or t
  modified_base (1011)..(1011): a, c, g, or t
  modified_base (1012)..(1012): a, c, g, or t
  modified_base (1013)..(1013): a, c, g, or t
  modified_base (1014)..(1014): a, c, g, or t
  modified_base (1015)..(1015): a, c, g, or t
  modified_base (1016)..(1016): a, c, g, or t
  modified_base (1017)..(1017): a, c, g, or t
  modified_base (1018)..(1018): a, c, g, or t
  modified_base (1019)..(1019): a, c, g, or t
  modified_base (1020)..(1020): a, c, g, or t
  modified_base (1021)..(1021): a, c, g, or t
  modified_base (1022)..(1022): a, c, g, or t
  modified_base (1023)..(1023): a, c, g, or t
  modified_base (1024)..(1024): a, c, g, or t
  modified_base (1025)..(1025): a, c, g, or t
  modified_base (1026)..(1026): a, c, g, or t
  modified_base (1027)..(1027): a, c, g, or t
  modified_base (1028)..(1028): a, c, g, or t
  modified_base (1029)..(1029): a, c, g, or t
  modified_base (1030)..(1030): a, c, g, or t
  modified_base (1031)..(1031): a, c, g, or t
  modified_base (1032)..(1032): a, c, g, or t
  modified_base (1033)..(1033): a, c, g, or t
  modified_base (1034)..(1034): a, c, g, or t
  modified_base (1035)..(1035): a, c, g, or t
  modified_base (1036)..(1036): a, c, g, or t
  modified_base (1037)..(1037): a, c, g, or t
  modified_base (1038)..(1038): a, c, g, or t
  modified_base (1039)..(1039): a, c, g, or t
  modified_base (1040)..(1040): a, c, g, or t
  modified_base (1041)..(1041): a, c, g, or t
  modified_base (1042)..(1042): a, c, g, or t
  modified_base (1043)..(1043): a, c, g, or t
  modified_base (1044)..(1044): a, c, g, or t
  modified_base (1045)..(1045): a, c, g, or t
  modified_base (1046)..(1046): a, c, g, or t
  modified_base (1047)..(1047): a, c, g, or t
  modified_base (1048)..(1048): a, c, g, or t
  modified_base (1049)..(1049): a, c, g, or t
  modified_base (1050)..(1050): a, c, g, or t
  modified_base (1051)..(1051): a, c, g, or t
  modified_base (1052)..(1052): a, c, g, or t
  modified_base (1053)..(1053): a, c, g, or t
  modified_base (1054)..(1054): a, c, g, or t
  modified_base (1055)..(1055): a, c, g, or t
  modified_base (1056)..(1056): a, c, g, or t
  modified_base (1057)..(1057): a, c, g, or t
  modified_base (1058)..(1058): a, c, g, or t
  modified_base (1059)..(1059): a, c, g, or t
  modified_base (1060)..(1060): a, c, g, or t
  modified_base (1061)..(1061): a, c, g, or t
atcggtcatcgctgtgctgagcagagatcgacgttgatacgcggctgcagctttctcagcgaatgcgtagagatgacccacacatgtcctgaagttccatggattgtccccgggattctcgcccatcgctaatcatcgagggttgcggctgacacagttcgtgcactgggggcgaccggggcatgatacgaaggattttttgccttggacccgaccacaaatccaaatcttcctggggcgtgggctgctccttttcttcgctaaaacgtttaagcaaaacacttgtctgtgctcattaaattttgactctgcggtgtacaattattacaatcttggctcttttcgacccacggcttccgattccgtcatttcctgctcggtcggtcatcagcataagtcataaatttttgatagctgagttagttatcgctatgatccgcacaacaatacaagggcagtgttttttattgctgaacgagactcgctcgcgcttatgccctgcttgaggaaacttagcaattcgcgcattgtgcgttccccggatccaggagaaatgaagacgacttgtcaatgcaggtgagcagccggaattccaacttgtctgccaccgagtattgcaaaaaagacagttgccaacacagaagccattcaacagttctgatttttctgcacctaaccttggggcaataacggcttatgctacccttatattcagaatcggctcatccttatggcatgtaccctgcgggattataacaatgaagccgggcatagaattcagcgcctcttagttttagacggactactgacggatatcttgtaagcttgcccatactattcgaatgcgccgcccttttacagtttgcatcgtagcttatcagacttgttcgtttctgacggattccgggggagaaggtgctatgagggggctggaatcatcggaggacacaaatgaacaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatcctttagttctatctagaatcagcttgattcgtt

SEQ ID NO: 4976 - DNA, 1356 bp, Zea mays
  misc_feature (1)..(100): optimal_loci_311494_G1, chr9:86534936..86536291, Cluster 30
ccagcagataagactgaaaacttcagtcaatagatacgagaagttactattgggggagcgcctttaatcgatggtctttatagttttggattatttctaaatctgttgtaggactcacaatataagcttcagattaaataccttcgtaagggatgagacgatagcttcatcagaataaagcagtcggagcagtgaacaagaaggtgaaagaaggctcgagtgacgtatatagtacgtctctaatggggaaataatataatgtcctcgatcgatctcgtagaacatgagtgtagagtttaatacacaaatgtaatttcatgtgaagttatacgtagtgttgcccctataactagaggtacaatactcatacatgcagacaccctttttaggaagtaactagtgttttaatcctcgagtcgctctgtgtccaaagccacagtaagtaagcatcattccgaaggtagctttgtaattatatgtaaggaaaggcaagatagcaaatgaacaaagcatatatggaatgaattgtttgatattatattctcatatcctgcttcattatgtatttatgctcatttaatcttcttccctcagattgatacatcattataagtgggtcaatgagagaagaaccgtattactttaattgtgtttccctattttggttcttcagggaaaaatcttaataggtgaccaacagttacaatcaggtcctcaaaaacataattgacaatctcctacaatcagattctcaaaaacataattgacaatctcctcgcctacttcacatagacctattccgatggtgtcaaatttactatgaaaccagagacactaccaaaagaggtcaatctctccacaccgttggaggaacgcactgccactctccattaagaaatgaactacatcatcctccaagacatggtgaggcagtcagaggtcctactcaactcttaggagggagttgtcgtgggagtggctaaataattttggctgataactacaccgcccttgtgctcacttttgggtcatatcagggtgagaataaattcaataatcggccaatggagccaatgcaggttagttcccctgagggcaccagggtggatatttctcgtctaccgcactgacatgccacatgaggccttcgacatacattctaaaggcttcgtgtgcagactgtgctacagaccgctaagagaagggaacactccccttagcagccaacacataccaccctagacaagggcaatgctaacgagcaggagctgctcgagtggcagataaaattcggcaatggtctggctcttagcagtcagggcccatttttttggaggcaccaacaccgttagcatg

SEQ ID NO: 4977 - DNA, 1335 bp, Zea mays
  misc_feature (1)..(100): optimal_loci_313549_G1, chr9:98899117..98900451, Cluster 30
gaaaaagagaaaaattattgttaaaaagttacaactatttgctcagtcctatataaaactcaactgtgggacatcgacagagcatctgataccatcaaaagttagtgagactgtgagtgttacaaaggggagaatcacccccctttgtggaggcatataattggcatcaataatagccaaatttgtttcattgtagctgacaagcacttctacatgactggcaattacttccaagtcccttcctttttatgtaatgacacatctacagtcatgccagtcaaatttgcatgtttctccttcagtgcatcttctgatactgacggatatgagtgctcatatgctgtaaaaccaatcaggacatgcttcttggcaaaattgttaagctatttggcggattcaaggctttctgtaaagcattgcagttccttgtttcagttcatactgtaactgcaaacagtgcagatcatatgtaatgtaccgagtgttgatcacttaacagacctgccagaaaggtaccagttagttgaagagaagcgcgaacagagagtcgaagagaagcgtgaatccaagcaatacaccaaagccaatccagtatcacttggcttttcgaaatattccatgggacttgaggataagcacaccacgtggttcagtcgagcctggaaggatcttctgccaaatttgtcccaagaactcgttcaccgagacagcattttgcgcatacatcatcggagaggtccagtatcccccaaatccaccatttgttcatgtcttctggaagctaatgaaaggaaggggcaactagcagcaaaagcttcaaaatgagttcaaaaccatggaacaggatgacggtttttgacctctataaagagcaaatccacctaaaagcataacaattaaaattgcaaatgatccaaagacatatgcagcaaacatgtttcttactgctcctgcagtgaaccggaagagcgaagctgccatctgattagctgctaagaaaagcagatactgcttgaaaagcctaaggatagtgaaactctgtcggtttgtcataaaaacgagtaagaataccaaatacaagttattaaatacttagggacacgattattggaacccatctgattacatctggatcaaatctaatggcataatcagttatgaaaatgaacccaccaacctcaagaaatgtgatggggatcttgagaattcatgatggtacagtgcaagtccaaacaggatagaagagaatggagtggcttaaaaatggtgagtaagctccgagaagccattgaatacgaatatgagcgttgtaaagaagagtgcacactgttaagt

SEQ ID NO: 4978 - DNA, 1033 bp, Zea mays
  misc_feature (1)..(100): optimal_loci_314268_G1, chr9:102344239..102345271, Cluster 30
agtagagtaagcatggaactatacatggctccttgttttcttgttactttccaaaatggactggcgctaataatctagcaaaaacagtatgcttccaataaaaataattcttataattgttttgaagtacaaagttatgcttgcaaacaataaaattgtactatcttgtgagcaccagctagatttgcttctaccaaaggaaagctgaaaatgatacggatggtgtatctagggtctggaaagattctggtaaaccctccattatattatcattctcgaaagtcccactaaaagaaagcaaaagatcgtgcattaattatgccatgctagttttttcaaataacgaaattctaaattgataaaggagagtccgttgcagctttttattgtacctgtcttttttttcactcgttctttcaatttccattttcccgagctcctacatgcaaacatactgtagtgcgtgggtgtataaactttgaggagtactggtgccaacctacctacttattattatataaacaacatgagagacaagcaagcatccaaggaatcaaatgcaagtaggtcatgacatggttctctctttgaggaacagattaagaagccatgcatgcatgcaaagatcccaaggaaatggagagagaaaagaattcaagaagaagatgggacctgccaaaagggaatgatcttttcacagagaagaacagaggagaggcagggaacacggccaggagagagaggagggattaaggccggggcaggagcaagctggccaccaaaaggggtggcctggttttgagaaatcccatgattttgtttgaggggacaggagacagggattagggttggcattgatgcatgggatcatgccactgccatgccctcccaaagacagcttaccagcatatctggggcatagcacagaaaacaagaacccagacccccttctccctgggcaggagaggagacacacctactttttttcctgccaagggcacattagaaaaacactagtaggtgtcttagcatg

SEQ ID NO: 4979 - DNA, 1083 bp, Zea mays
  misc_feature (1)..(100): optimal_loci_31481_G1, chr1:193491124..193492206, Cluster 30
gcataatagcaaaaaaaactagcttagtcggtctcaaaaatcggtttagccacttttacaacacttggtctaagttgactatcaacacaaaaagatttataatcattagaaactttatacaattcatgccaagaaatcaaacatgtccatacaaattatgtttattatatttataaattgttttcacatcaatatatacggaaattagatagagacaaaggccaaaaattcatggggtttcgattggcacatgtggctgatgaacacaccttgtcctcttgccccctcctcattcacctcgcgccccttgcctccatcctcgttcaccccgcgccccacctcccccacccataaaactcccagatccactccaccttggaccagatcaacacaacaaggatccttcatccaacaaatgccaatgtctaatgattgaagatcttactacgtggttatccattgtaaagtttagtggtcttcgatacaaaacggaagtcgatgataaacatgacataacgatttagaccgctgaataatgtagtaccctacatcctatatattgaattttttaatatgaactagtacaagagtatccctggctctttttatatagtctagaggacttctactcctagttggctatgatagtagagtcctaatcctattacaaagattgtatttccataatcaactaggtcggtttacttgacgtggaagccaaacctccttgttccatgtattcctagcagtctataggttggcccatctccttgttgggtagtcagtcctatgaggaatccttagggtcttggtccatcaaacctccaagctcaacatggttcaaatttaaagtttacggaatcttcaaattattgctaagtagaatcaattagcatctgagtaccaacttgagagaagtcatgtaactctttgaatgatctttctaatgatgttgagccatctcatcttgtttatgcttgctatacttattgatttgagtttatctctcattcaatcttgttgctaactttctttttgcacatattattgctagccaccaaaaataagaatgtccgaattata

SEQ ID NO: 4980 - DNA, 1030 bp, Zea mays
  misc_feature (1)..(100): optimal_loci_314844_G1, chr9:105186625..105187654, Cluster 30
agtctaattgttcctttatgtttgttgcactgctttgagcaaatcatctcactagttggtatatgtgtttctcgtgtgagtattgacctttgtttttcagaggactatcagggttagttgagatcgaagtcatgattgtttttgaacaaaaaaaaattattgtctctcatttaccccctttagtcctctagtttggtctttcaacatagctatcctagtaaatcaaaatactaaaaacttgactttgataccaaatataagcaaaaatagttcgctaaaacttaaagaattgtgatagctagcacaaattgatttaaccagaataaccatcttttatgtgcggagcataaagaaataatcgttcatgtgctaaacagcgcaaactcacgttgcgccatgcttgcttcttgcacctttgaatttgtttatgtctctccctctctgccttctacctgtttctgttcttttgatgatgaaaaaggtaatctgttttatggtgtattttgattcacagctaatccacgaaacactctgataagcactgccgccttctatatatctctctctctgttgtcataccaaacggtgctatattctgaccgagtaactcatatttgcatacatacaatttcatcttgtgcaataaacaacagccaacgcctatagtcatgaattaaagtcttgttaaagcaagcaacagcgctcttgtgttttacaccatgccatgcatgcgtgacgcacacatgcatgttcatgtaaagcatgtcgattgatgttgctacttgcctacttgcatgtctaacatacgaagttacaattatcaccacctgtaccgttcgagccacatatcagttaacccattaatttagagctgcttagataataattactttatcttatattatagaacattttaatttcttgatatatagatttttactacgtttaaatatacattgtacctagatatttagtaaaaatatcttgtactctaagtagaagggaagaaatacatcctgttcgctggtta

SEQ ID NO: 4981 - DNA, 1012 bp, Zea mays
  misc_feature (1)..(100): optimal_loci_315280_G1, chr9:107626730..107627741, Cluster 30
aataattagtcaaaggataaaatatctcagaccgagggagcagttggtaagatttaagcacaatatcacggttcatgacttacaatatatatgatagcagaacagagctttcagagtttcataccaaaatgtaaggacgaagccacaaatttcctgtgtgttatactactattccttaacccttttgaccaaaatgcttaaaaggacaacaaaactaaatcgaagttgcaggcgtcaggagattaaggccggtcatctcgttagtgtcccagtgtaaattttttttacagcaatcagaacatggagaataaagtgagatgagctccacatgggatgaaggacaagcacactccaaaacctaagcagccaactctagctagccttcaagattctcactgggattgcacacatttgtagactaattaactagtctgcgaggggcctaaaaactactacttaattcgctccttttgataagattgctggagggtgtctgttgcatgaagacgcaacacacagggtccagtccagattattacctctctaagcagttgaccagtcaaaaaatgaggcagtgtgtgcatcaaactacacgtacggacagttggtccttgtttcacctttgccccgcattggaccaaaccatcttgctcacacaactatcgatgaactggaaaccacgccagctgcttcacgcatggctgccgttttttcctttctgtgcctgtcgtccccttcccctctcactgtctcacacacagatcctagcatatctctctcttagttaactagacacaacagctctttccatggacacagagacgagcaggacaacccattgactagctacattgcattcttcgaacagttgtttccagaggtaaagtacggagagctgaagaaaaggaaatttactggcaagtgtaagaagtgaatcagattatactagtaattctccaccgcccaataccaatgtgcgctacaacttgcaatgctgcaaagaattaattag

SEQ ID NO: 4982 - DNA, 1263 bp, Zea mays
  misc_feature (1)..(100): optimal_loci_31611_G1, chr1:194459328..194460590, Cluster 30
ttattcattttctgttctgccttatggaatcatttgtaaaattgtattcgcaaattgctagtatcaggacttggaatctgaacattatatagtaaattcatatgttaaatatataggtttttaattaaggactagtgtactttgtgtgatctctcacagtatactattcttgctttccctccagtttcctgagaatggccagccagctgaaggctcgttatctgacctgctaattatgatggatcaatggtaatgaaacatgtgaactttacgaaacaaccattggttctcatcgaaaatgatctatgctgtcttaatttctacctaattatccaagtaactaaaattcaggtctatggaagaaaatctgaatgggctgagcatggctgagatagcaggcttggaggaagcattgacagtcgctctggcagttatcagggtgatattgtgactctagatacatagttcttttgatctcataccagcctaggggaactatatgaatttgcagcattagcctacattctagagaaatgttcatacttgacacatgagatttctgagagcattttaattcttttgcagaacaagctggcgatgaaggtgactgggtgcgctgggcctaaacctgaagcacacacgctctttcagcggcggtaagaaggaagtaacaaaactgtattatactagcatctagctctggttctacaaatattggtaattctccagtactgcagtacatgaacatataaggccatatattcaaagaggtgatggtttcttactgtcatgtaccgcgtgtttaattcatactggtgactggaaagaggaggaggcagctctctaaagtcacaactctgaacgtatggcttttaattgtctagcagaccagcagtgcctaagcttggtcgtggctttcttgatcacaaagagaaagctctctgaggaataaggagggggggcctcgtagacaggcgttgtgtaactggttctgatggcactacagtatataatttctctcaaacatttccaccactctactgtatgcacagggtgtcattattcctcagcttctgtatgaaaaggtttggttttacccatatagtatgataataacactgtgaacagaggctgtctagtattggtagaagatgcatgaacatatagctccggtgcaactgcactagggtctacatgacgctgaacggtgggtggactgtgtctagcggttcactcatatggtcacctaaagtactgttttgt

SEQ ID NO: 4983 - DNA, 1002 bp, Zea mays
  misc_feature (1)..(100): optimal_loci_319479_G1, chr9:130823425..130824426, Cluster 30
gaccccagcaactgacctacctacgggcatgcctatgtggaccaacaaaaaaaaaagcgttctgttctcccaaaccggacactcgtgtgacgacatgatgtattttctgtcccattccttctgattttaaaatctccatatatagagttcattcagaattcgttggaagtttaatttctcttacttaagttttgagaaaaatacattagcatataaaaatttccatcaaaaaatattttgcgtgaagagcttaattaatagactagtttggtggctggtgtgtaaatgtacgttggtgtttttttatccctattgatttagccaaattaacaaatgatggagttactaataaatagtatttcccaaggttgaaaatagtgggctatatagagctatagtctttcggaggaggaggatctaaagctatgatatttcaattttagacgatatctcagctataactgctatagcctgatttaactccgctaaatgtcatagatttagcgcttaatagcgtgctctattactatttttcatggtggaccaaaaaaattaataaatgtaataaagaagatgaggaatcattgatattaatgaatgtaatgagataacttcgtcacttttgattgttcccacatctccgctttccaggtgatcgtcgttggcttttctatttgtggaaaaaattctggccatatgtattcttttacggtgaagcgctgcagcaagaagtgaaggctgggtggtggctgacgctttggctactgtaattattattaattgcaattaatgaagcacttgaatcaaaaaatcacacggggggcacatgtgtcaagaagcttgtattgctagtttgtcttacaatgcatggccagaacgatcaattgatacggatggagggagtaactagtttccggtacgaaccgtgtgtactactgtaggatcatttttcaaagggatggcaaaagctttgtcgtagtttttattagagcaaaaaaaaaa

SEQ ID NO: 4984 - DNA, 1084 bp, Zea mays
  misc_feature (1)..(100): optimal_loci_32914_G1, chr1:201953122..201954205, Cluster 30
gaaaaatagaacaaacagagttggatgtaaggagtaatataggacaatatataatcaaaattccccccaagctaccaaggtgttaggatacccaagacatccactttatagtgttctctaagtgtttcactaaaacctcacctaaatagtgaccataacttatgtgtaagggaactcaaaattagttataactaatgtataagggaaaatcatatgttagggctataaaacacttgacattttcttaccatgtatagctgtactaacataaagcacaaatattaatatcaatctaatacctcaaattttataagctggaccatctaaaacacttagaaaaaactttactttccttttaacaagagacgtcaacaagagcattgaatactagaaatgaacaatatatagaacacatatatgtatggagtcacaaccaaggatagtgataaaaaacacttatatataagtcacatcatcatgtgtatcattactaggaaatagatttgtgcttgataatgggataaagcattgcacatatcccctaaactagcattacaaggtttgatagatttaaggaatagacacataggacatgaaaatcaacaccttctaggatcctagtacatggatcccaatatatgttgtataccctttcaggacattggactaagagaaaatttttatgtcttccagagaaaacatattgctttggccaaatttcataagcaaggcacatgcattcaaaatagagggtacggatcccacaacatattcaagaagtataaatgcttgaatccacacatcaaattcaacttctccatgaaaaacatatacccaacctgctatagctatatgtaaatctatatctacaactaacaatatcgaaagtggtgggagtcgcttctagaagcatcttcgatgtgtttgaagtctatctgtattgaccatcgtccgtgatgaggtctaagacacaagatggcgtaggcatgtataccaagcaccacaatctacctaggggatatgttgtgctagatcatatcgctagagctcgttcggttcgcaatctagctagaggatacgttgc

SEQ ID NO: 4985 - DNA, 1248 bp, Zea mays
  misc_feature (1)..(100): optimal_loci_337903_G1, chr10:81823675..81824922, Cluster 30
gtcgtcgatggatcagtcgtgttcagacaccttgttgttcctatagctctcgttgtctatagtagctactactagctgctgctaggatcggagggtttgcactgccgaatgctggagcactgttcactgtgccctactgctgctgctctgctagctggcctggctaacgtcgttgcacctaacaattaattaatgctcattcgatcgagaaatatggagccccaaatcaatggattactataatagctttcgtcaaaaaaaattgtgtgctatctcgctcgttgttcttgcattggttggacaaggaatcaaattacagggtgatcgagcgctagctctgtacatgcgcatgtgcacacaaacatgcatgccgcgttgcattgtgtatgtgtgtttgtgtgctggtggcgatcgatcgatgtgacttgccgcagggaacattcttcttgggcgtggtaggtaggtggtggtgcaacaagggccgcgcgaccaacaacaacttgcactggtcgatctccacgacgacaaattaatttcatgcttgggttctaaggaaccatgcatgcatatgcgaattcaaacgcatgcattgcattgcatgcatgggtacctgcatgatgcatgcatatatagaggcagcatatatgcatgtgtaacagttggaggatcggttttatattagtagtacatgatgcatggatcgatcgatcaagttgtgcatatacatatagtatattgattattaaaaccggcgcatctgcagtactacgactcttgttgattagtgtttaagcaagaggtatgccgttcctaattaagcaagcaagagagtataccacgaccactacatgcatgcatgcctgtgttgccgctttgctaagccatctcgtttagcgctaattaatcaaagtgcatgcgcatatgttttgttatcttctctaataagccagtttccaataataatataatacaccaagagctgttatatatatgcatggtgtgatatatatagatgttaataattaattagttatgtgttcatgcatgcgcaacaataatggttacaccgacagttcttgagaggaggcaaaatcacatgtacatgtactagtgttggtgggcatgcgcagcagcttgttcctaccactgaaagaatattttatatatgcatatccatagttcgtacgagtgcactctgagtgcttgcacttgcatcgttatacatgattgttaccaaagtttaggact

SEQ ID NO: 4986 - DNA, 1336 bp, Zea mays
  misc_feature (1)..(100): optimal_loci_34027_G1, chr1:207513113..207514448, Cluster 30
aatatctcattattctcggtgatgttctcaatttagatctattcttgcaactggactggtttagagtggctcaaccgcccctggtagcggttgaactggtaatatgaatttagtttgaagtttttggtgaagagcactgcagggaggtccagtgcatagagatacatgagcatgtaagaagcagaagccacgagttcaaccaattactccctgaagacaccaagagccaaacacatgtagaggtgatctccaaagatgcagtcctgcaacctgatgaacagcaagggctcaaaagcataacaaaaaaaatagaagatcatgtcagatcatattccagcaaagacgagcaacaagctgagaatataagaaagatagagggagatccgatcaaaatgtatcaatgtgaatctgatagaattacagaaaacgttatcaaactatatacatgcaatgctaaccattcttttgacattggtgaaacccctcatgaatgtttgagcctcaagaggtgcgtaatgagctctaaggatcgtgcactggctagaagtaaaagctgcagggctacctttatggtgattccaaatatttggtttgatgtttttgagaatactagccggacaccacctgatgaaatctttaggtatgctcccagaaggcttgataaggtcaggagaagcctgtatgacgacaatggtgattgcgaaaataaagacttcaaaacctctccggtgattcctagaaacaatgattaccaaaataaagttttcattgacatgagcaccagtgatgaagtggctaaggaattgagcactggcaaccaagaacaagaaactcctgtcaatggcattagttgtgtcacagaggtgaaagagaatacagaagatcgccaatgtctacttgaagagttacaagtacaagtaattatggtaagagtggattcttcgtaggttttccttccgttcatgatatacctccaggatcactcacagttttgtttaaaatgtactagaaactaggcaccaacatcctgctgtttactctgctatgtttcttactatgcatgcctacaatggaaacatgagaaatataattgactgaccagctcaaagattgtaattcgtagatgtttttttttctgcctaacgtattgattggtttgtctgacaaagctggtttttcataacttcgtttgtttaattcaagcagcaggtcgatagagatgagaagacaccctccacaaaaaactagtagagacgttagtgtagattcagcactgagccccttcaaatctccttctcatccgacagttgattttgagaagaaacagcaacaggtt

SEQ ID NO: 4987 - DNA, 1006 bp, Zea mays
  misc_feature (1)..(100): optimal_loci_342226_G1, chr10:106080986..106081991, Cluster 30
gttgctacctcaagatgaatagaatcagcaatagatatctctgaacattataatatgcactattcttagaacgcagagaaaaccaaagcaaaacaggttaattcaatattgggatgaatcatgacgtaatgcacttttcatggctataccatatacctggacaggcacgaggcaggagagcttcatcagcaccttttgataaaagaaggatcttaccagtctccccttcctttaccactacagacattcttttgcgatcagaagtgaattccaaaatgtccaacaactcataccaaaacttagacccattgaaacaaatctctgaagaaacaaaagggaattcaatcaaacagcttaatggaattgtaataatctcatcacaaaccgatgaacattcactaaccagctgtaatggtgtctttactgatgagcatcatattcagctttgctgcagcgttaactaaagcttcctcatcttgggattgtgctttgtatgacacagtaccatcattgctgaaagtatgaaaattttataaataacagcttaataccatgcagagtaacgaaaagaaactgtgacttgccttttgatagggaccactgtattgcaaagagccataaccaacagaaatttgatgacatcaggatcattacttgagaccgcatttacaagtctgacatctaagttgagagaattgtcagtggacgaaaaacagctttgcttctgcaacagtttgggcggcacatttagagcacaagttatttactaataagtaataaagcaataacaatatcaagaatggtaactcaaaatccatgaccgctgcatgttgtgaccaggctggagaaacaattgatcatttactcatgtgtatttgctcaacaagtatggtatatcctcttccagaaagtaggctttcaggattgacccctcaactggaaaatttttccttcaatgattggtgggccaaaacaaatgaaatagcagatggtcaagtctagaaag

SEQ ID NO: 4988 - DNA, 1011 bp, Zea mays
  misc_feature (1)..(100): optimal_loci_34244_G1, chr1:208593038..208594048, Cluster 30
cccctaatagttaaatttatttaaatagaatagaattcaatatttatacaacgaacaaggcctcaaggagttgggacctaacaccggtctgaatcattcgttattcctcgtcgagtccaacttttgaaggctcgacggggttagagaaaagggccacgaaaagccaagcaaaacccatccatttttctctcattcacacgggcatcatagattagttagttcggcagaaacccaacaatcattgagcagagcaagcaaagcagcacggcaacgagcaccacatgatcatgattgatgattgtagctccggaacgtcctctgtttgttcaatatgccagtattttattttcagagaatatccccattaccagcgatttattcggtggttaagcttgatcagtttattcaaatgggcctatgtaattatgcggagtctacaatgacgagaagaaacaacgaagaattaaacaagcaagcacggaactgttcaccgcctcatgttaacacattaagagtgacatgtaatgttcaaactcttctaaaaaaacagaggaaaggtaaaactaataaaagacgatagactatgtactcatgagccatatccgatggcagatcaaactgctgacgctgtagaaagtcagtatcatactgactcttctgtgaagtgagaagtactcacaacgcattactcctatggcatgtacatcagcccaaaacgattacacatgtattcaaacactcttttatttcagaacaaacaaaaaaaaacaatgttcttttcctctacacgaaggaatatctaattagcaaagacgtacttgcgcccttttttcgtccaataaaacagacatgtgcctatgttacttgcaaggtaaaaaggaaaaaaggagggaagaaataatgcagataccaagtagttgtaactctacagcaatactgaatagaaacctcaagtcctagctctgtaataataatgcaactggaagggttgttggccagggagacaactag

SEQ ID NO: 4989 - DNA, 1112 bp, Zea mays
  misc_feature (1)..(100): optimal_loci_343300_G1, chr10:112308207..112309318, Cluster 30
tctttgagctttgtttgctgcttactacagatctttgctccttcgatttctagaagccctttgctccttagagattttctcgttgcttattgtagatctttgctctctaggtttctttagaaacatttttgcttcttagagatttattaactgattattgcaaatctttgcttcttagtttttagaagacatttgctccttagagctttgtgaaggtagagttgtttcttgactttgagatgaaggtgacacataggctcctgaggatttttttcattctttgtgaaaatatatatgcttgcctttaatgtttctgataggcaagcatcatttttcgttgcaacgaatgttgttgctacctatatagtttttcgatatttgaatatatttttggtatactctttgacgcttcatgttgatagtctttggggaacaattctcatttttatttaaagagaattacaatagattctaccttattaaaaaacactcgccctgtgaaggtttcccctgagtgcaaaaggagtgcatctcattaaaaattgatttaaagttaaaaattgggtggtatcttcataatgcttcaatggttcaagtgtgatcaagttttttgtcattcatgttttctagatgaacagatcctagcgtgtttgttcttgtgataaattatggcccttccaatttttgttagaacttgctgacatagtcttcatttctttttcttttttaaacaaagtcttcaggtgataatttctttgattttattttcttattgtaccattattttgcctcttttttatagtttcttggattttgaatggcttgcattctttaatatgtgtttgccttgtgcacatacgttatgcatttaagcaattatctatatatttcttgattgtaaagcaaatcatttataactttgtaatctcttgcatggtgtttcattctgacttgatatgtctcatcttaggttcataatgttcaaaagataacccatgattggtgctcttcaaactttgcatcagattatgagtatttcctttggtgtttgttgtttttgcttgatcacaatatgatttaggaattagaagaaaatatctagagatagactt

SEQ ID NO: 4990 - DNA, 1172 bp, Zea mays
  misc_feature (1)..(100): optimal_loci_346775_G1, chr10:131894204..131895375, Cluster 30
agataaattagttggttggtttcataatttcttagatagagaagagattattataattattatattaattagatatagggagaaaggtagacagggccacaaagatattatgagaaattgaaaagtagctaagagaataccttagtttttttaacgttgcagatataaaaatgtagacacccacgacacacacgtaaacctggggatgtttgcttctgattaaagttagttgtttagattgtcgcaatgatgtggtctttacttttaaaccaaatccatcaatcatgcaagttctttttagaggaacattttggtttatattctagagattgttgcagaaacaaaatgctcaacacgagattcttagagtatatcaatctttagagatagtgactatggagatctttgtaagacatggttagaggtcagatgttaaattagaggacacttgattgtgattatatgttctttttaaggttgtttcttttttatggggtgtgtttggtcatttttcgatctctatctatggtcatatgtaggagataaaaaaagggtggaacattttttgtttccatgtaaaaaaacaaaccgatcacaccacagaaaccctaaccagctgacaaacattcaattggcttgccgtttttttggttgacactcacgctgccaggttattttgtactatgtagtttctcttttctatgatcatcactttgtactgatcttctttctttttaaggataaggaaatacgtatttcacatgtagtataaaaacatttgttgacattattatgtttcaaaaatactttcacagtgtattgtttacatttaaaaattaaggtacgtatgacctgaaaaatactagtcaaattattgtttttaaaacgaagacgttgcctgaaaatatattagtaaaatacccgtagtgtattattagagactgcgacgatctcttgttcaacttatattcagtacgtacgattagctagggattgtacccggctacatgtgcaatgagaaatgaagacttgtcgttcaacgaactgtataaaaatcctagcactactggtatgtgaatcggcacttgcagccatggctcgtacgattcccgtcgctgtccgggtacacagttgaaaagttggcaaataatagcggcacgtacagcggctag

SEQ ID NO: 4991 - DNA, 1084 bp, Zea mays
  misc_feature (1)..(100): optimal_loci_347362_G1, chr10:134589491..134590574, Cluster 30
ttcttgtattagtatctattttaaagcacccaaaacaaatgttctcggccggaagccttgttctctagtagtgtgtgaaatgggctcatgctcatcccatgtattgcctaaatacgtatggactaacagttgtgtattcactactaaaggatcaaatataacgacgaaagccaagtggatgggaggcaataaaaatatttgaaataagcaatgttggcttgattcccgaaaaatgagcccaaaccccaaagacaccaaaagctcgcaaaaaatccaaaatcaagaacacttcagtcgattgatggctaaatgtcttaacaagttcctgaaaagactgtcaaactagcaaaacaaatggaaagcaaaatagactttggtaagtctgagaagaagcaaattcgagactcctctaaacagtgcgatagtgttgttctcttggttgatagtaccacaaactagcagtgtcactagcaggtagtgccactctatcaaaatttgcataatgagatggaacattatgaacaccttaacaagggtgatttcgaggtgttcccaaaatataaactaaggaagatcaaatcgaaaaacactaaaatgaattagggtttatacaaaaaatccaaattgtggtaacttaagcacgagatgaatcggcgcttaccaactgttagtagtgattctaggagtgttacctatgtctcttaacaacccaacccctccccccacacatactcagattcaagaattcattcaaaatttcaaacaaaaaagcttcggagagaaaacccatgaaaatgaattcaaatcattcaaattgggatagaaaattaactaggagaaaccgtgtggttagggccacgcttcccaattcacaacaacgtaggtccaacaattcgaaagcacctaagcatatcctgacaaatcaaaatagagagcaagattcaaaataaaagatagagagatggtttgttagttcggtccttcctttttatttatatgttaattgtatacatgtcacttaaattttacaaaattagatgattagttcattttgttgccatggagcggcatagaaatgaaccag

SEQ ID NO: 4992 - DNA, 1032 bp, Zea mays
  misc_feature (1)..(100): optimal_loci_347368_G1, chr10:134614549..134615580, Cluster 30
atatatatatatacacacacactggttttagtcagagcaaggcatatgtagacgaatcaaactatatgctcttcatatcatcaaagaccaataataaaaccaatacatacatatagtaagctttttttaggtggctccaaattcgagagagaaattatttggattggctaaaaaataaataatcaaccttaactcccacagcatgctgcaagtataggctcttgctcctccatcctagaatgtgctggagcacggctcctcgtgaagcaccaactttcttctatcgatctcctgtgttctcactttgccacataggattttagtgacataaagccatcttattatacttgctctcagtatcaattatagcttggtgttggagatgtgtatgctgcacatgtttgctgatgacgatgtttgtagctagctctgaattactttagtttgttttcctgagaacatagagaggtatcacatggttatttagcacagtaatcaaaacagaagggccactactcagagcatgcatgcgcggtttgttttcttttggaaacagaactcaaaatatatagattactggcgacacttttctatcacttgccaaacttgtgcggagtttattaatttcccgcggggtaaattattggtgctgagttgtcctctgcgtgatgtaggaggaagcagtttatcaacagcgtcaagctcaataggatatctattattacaagtttagcacgtgcagcagccaccatcactccattttttctcattgatttcgacatgtccattacgcaagagagcgacgctatagatcatcccatgatcccacgacggatgtgaattccccatccagtgccaaattttctgctgcgagataaatattcgtgtatgtcaagtatcgctccttgtggggcctgcggattggcccaacgggcctggtaccttctatcatcagagatggacgctgggagacacagcttcatgtacaaaatagatactacaacacggtttttctaaatttaaaacacacct

SEQ ID NO: 4993 - DNA, 1035 bp, Zea mays
  misc_feature (1)..(100): optimal_loci_349019_G1, chr10:143382169..143383203, Cluster 30
aactgtttttttttgcccctgaagaatcgttttctcgagttctcgtggcttatccatccttttatctgtttctcactttctctgttcttggaagacgctaatttcagctcagttctctgcaaatttctctgtaataaagtttatatagctatgtagttagaatcacactaaacactgttaactttagcaaatttcttagaatatgttaatcacgcattcacacacccgtgctactaaactgctattggtagctaacaaaccatttggtggttcacggcactggtcatttcaattcctcgcactagttcagttgtaagtgagatctcatgagctcgaaaatctcaatccttggatgtttacagacaacatgccattgttcacttttaatttaattttagtgttctgcagggatcagatatgagcaataataatcttgaggcagtgacactccttataatcttccttcgaatctccagagcttgtgagtcatttagttatgtttatatgtgtacttaactattcccatttatgttttaaaaatatttttgggggtcttacttacctgctatttagaaatcttgttgtaaataacttcatgtgggacagtaccttactccatcttccccttactgacttgtaagttcatccttaccacctactctatttacaagtttacgttcttaaaccaacatttagcaatctttgcagaaatgtcaaaaacaaccaattcaccggttgagtacctgataaactaaaggggatcgataatctccaataagtacctttactgcaacagttgtggtgacttttatttgacacactatgttttgtataaaaccggctcagggcttttttaaatcctagatccgccaccgtccgcaagggtgaagcagctgtccttcctaaggttatgccctttgttcctagttcttctctgctttagtttattatgtatgtctaaaggtatttctttttcaaatttagttgtcatcagctgtttgaggatttgttaaactgctggtcaaatttcttagc

SEQ ID NO: 4994 - DNA, 1126 bp, Zea mays
  misc_feature (1)..(100): optimal_loci_349021_G1, chr10:143383745..143384870, Cluster 30
gtttatcagtactgggaccgtccactgcccaaggtaatggtcctggtgttgtgcattggcgtggaggaggaacagcgatggtagttcacgttccttttttaccttttagcagagcaaaaaggtaaaaattctgcaagcacttctttagttaaatgtggaataagcatcctttcatattctttaagggagctgtatatatgcttacaatctgagcacagcgatgtgaaatatttgcactttgactgaggtactaaaactgaagtgtcatagcatcaaggggagacactagctaaacaaacctgttgtttgcttatgtaaaatatcatgcttgttttgtatctattggtagttcataatattatcttatatagaaaatgccaaagtttgtattgcaggtccaccgtttcatgattttcatttaccgacctcctcccaacaaaatgaagatcggttcagtctggcatgatttctctagcagaatgccttgtgcatatatatagcgaccttattttgtgatcgtagcgacgtagcatgctgaagatccaagctccttttcgagaaaaggtctggtctggacatccaagcagagagtcttgtacacatggttgactatttcagaggcacactcaggtgcacccgtgtttgtacatggagcgcctgattggctaattggatgagcgtcgcgtggctttacgctgcagctgctcgtgcagtctctgccttgtgtatataggaaccaaacactgtcatgcgtcataaagattaaagagctgttttgtatgaaatacatgctcagatgtgatacctggtgacgaaatctcagacatcgagttggcattgctaaggaatgaagccatattatattactcagcaagtcagcaggcatgcttatcctgccgagatgagtggcattccatggccatatcactataatagcacttataaaaattaatcttgctatgataattactaaacaatggtataatatgctaatatttcttgatttttactaatattgaattagaaaaatggatgaactcgtttttcttgacaggtagcgtatgagagaatattttttctgtcaaagatatttacattcaattcatctacgaattaaataccgcta

SEQ ID NO: 4995 - DNA, 1271 bp, Zea mays
  misc_feature (1)..(100): optimal_loci_38141_G1, chr1:228742913..228744183, Cluster 30
tatcctcaaaccactaggagctttcattaaatcaaagtgtgagggttacaatttatggtaaatattcctactaggcttaatctatacacccaagataatcagtaaattaagacttgtcatttttaaactgatgtaaatgttcattaaattgataataggagctatgattacattattaaccataggattttgactaagtgacttcagtgggttagggtgattcgtattataccctactgaagcttggttcactattttttcataatcggtccatgaattttgatctaaattaggagcaaaagtggtcattgggatatatgtgctaactctacctaaattggccttatctattttgattgacaaagaggccaatttaactttttagctaccacataaacccttgattctcataatagttataagacatgccatattgaagtttcttaagagcagattcttcaactgatagacaatataatttggttattttatgtcatagccacattaaaaagttgtaatattgttattaataacaattgtatgaccttgtaacatcttagaatagttagcatggatagtacaaggatcaattacctcttcatcaacctttacactaggtgtagtggatgtataaacaacaacattaccgaagtcaagctcacaaaattgagtcactttattccgttgatgtttggtacaactctataagaaagccttcaaattgatatcaagcttgccttgaattttatgatgaagctcatcaggaagctcttcaaatgatgttgagtggttgatgttcttaggattgaatggatcgatgtgaccatccccatctttagatctatcactgcctagcatgttgctagtaggttggatctagatagtcttcttcttcttccctaatgatcttgtcaaaaagtgtgttgacattggaagagatacagatcccacaccagcaagggctagcatgcccgcaggcaacacaaaaccttaaacatagtgggccgataaaatcgatctagagactgatctagccgatgttatcatattctttgctgatagacacttgaacgcctgtaaggctacctagaacagagctaaatctcattgggagatgtgataaatagcaagatagaatagaaaaagaataaatggtagtaaatgtatttttgatcgattggatattggacacatcaattgcttatgatccaaaacacattctccaagtttcccacattaaaaaccaattcaaaaacaaattggtttagatc

SEQ ID NO: 4996 - DNA, 1100 bp, Zea mays
  misc_feature (1)..(100): optimal_loci_42549_G1, chr1:251107923..251109022, Cluster 30
ctattttaggacggagatagtatataattattattgttagatagatcttaaatacatttatgtaaaaaattcttatttaaaataaaatgattgctaatatttttttgtaaatctaactaaatttaaaaagatttgatcaatacgttttcatagcgacaggcagaggaagtacctgtccgggacagctcacagctgcgagcgagcccttggcagacaatcagagccttatacggttcaatcaatcggccgcactgatgggcgctcggggtgcaccacttggcacgcagcggagacaacacacgctctgttctgttgccccgtctgacgaatcatgctacgagagtgactgaatcgaaaacaccgggcttcactctccagcgaagctctaggaaatgattgtgccaaaatgattgctagacagctaagggcgtgactaatcagtcttgtaaatgtacgagatggacgtggttaaggctaaattagtgtaataatatttcatttggcatctatgtaacatatcttaacggttaacgcgcatgttactgtgtgttgtcccagtgctttgtcgtcatctaaagttctaacccgctcaacaaaacatcatcaggcacatgatccgtacagacggtttgccgcagtttttattaagagagggagaaaaaaaaacaaatcaggtgttggctctgttttcgaatggaagtgactatgctgaaaaaaaccacacaagtgcgtcttttattgacattccaatttgatggaaaatatgcatcacatcatcatcatcatcgtgtactcagtgtttccagcaatggccaggaaatatcagttaaatacagtgcacgaaaacatgggctgaagaacagctttgcttcgggtcactgttgattgtatcatggtggagacttttgtgcgcatcgaagttaccatagcttccaatcgagcatcatatttcttttgtcctttcttgtgagatgaaatcattgatccatccttcaatcaggaagaagaatgaatagtaaaatacgtccttcacttcacaatgatactcgattcgtcaataaacaatagtcgtgcttaagaccatgactccacacacacac

SEQ ID NO: 4997 - DNA, 1105 bp, Zea mays
  misc_feature (1)..(100): optimal_loci_42894_G1, chr1:252790785..252791889, Cluster 30
caacctactaatccataaatcaattgtattacagaagctaaagtacatgtgcaagctaaacgctcctcaaactcacctcaataatttattaaaattgttttatgataaaactgaaaaatcgaagctgaaattcaaagccttcctaaacaagtcctaagttggttactcctcattttccttcttgttttccggaagaacaaagaaacatcatccagctcagctttcaatcatgcagctacttttcctggataagaaccaaggcgtgccgcaaccaaaaacgtgtcgcgggcatgggcgcaccgcgtgcagcgtgacctccggagcattttttccaataatttttaactatttcaaaaaaatattaaaaaacttttctagagctaacatatttagctatgttgatctgtcaaaccattattaccacactatctcatctaacatggtcacgcagcatggtcttccttgccacgccacggactctagggagaaacagatcccacaatgtaccatatttactccttactttttttgttccccgtttcttctctctcccaacaagcgctagtagccttcttcgaccacatcattcacgggacaagaagtcggtccctcaagcttcaccgactaagtctgtggtcagcgaatcgtgtatatggttgtgcgcacggatacatactcatttctatccctaataaagataatggggatccgaaagatcaatatctcaaaaaaaaatcattagaagactcattgatgatcagactatacaagagtccaacacacaatatagaagaagcacagatgaagacacacaaaggaacaaaaataaatagaacactcagcgacaacatacgtgtttagagaagcaccggatagaagtgttactatggtgaagaaagagctacttagatagagtacactgtacacctgacacacatatgcaccagaggtcacactagaaggggcagtggatacagaactccgagaagtctgcagtgtattttggagatccacaaggcatcagatgtttcttgtgtgccatcggataccccactcgacagggtactcaaagagcttgcacaataagctgagaaaagccctaaca

SEQ ID NO: 4998 - DNA, 1093 bp, Zea mays
  misc_feature (1)..(100): optimal_loci_44776_G1, chr1:262937616..262938708, Cluster 30
aagtactaatacactaattttttatgtatttgagaaaattgattttctttagtggcacaaaatctctccaagagagaaaagaatctgaactgtgtcagtactccagtcaaggccataccggctgctaataaggaacggcaacatttctgattttctgcacgcggacagcgcagagcggaagagattaaaaaaaaaaacccatttctaaacacttgagtactgcatttggctacgcatgcacctttgtgcgctcttgttccacgtgtaaactcacgccacagcttgatcgttactcaactcaacgctcatataatcgaggatttgtttgcccttattcaggagccacataagaaaaaacagcaacaagaaaagctcgtatagagtgagtggaataaacatacattcagcgtttttctgaagtttttgaaccattgaagttcagtataaaagtagctatttctaaataccatgcaaattgacaacagagggagtaatgtctcgtcagataacaacggcggcggttgcttcagggagacaagacaagcagggaggcagaggcacagtggattattgtcgcatactcgcatagataatcctattttatctgatcgaacacaggctaggtagccaagaagagtttttgtgtctatcttttttaagcgaacgaaaataccgaggaggctactactacagtatatatgtttggagttcgttcggatcggagttagaaaagaagatggtaataagatctaagaagctcaatcttgcacttattatttgcttagcagctagctaatttccagacaaacgagcaatgcaacacgcgttggtggacgtaaaacagaaacgatttgaactgatcttaaatgaatataaatgacatcaaacggtttggcgtcgttggctatatatttctttaaccgaaatgtgtttgtccacgtatagtaaaagacgtatatatatgataaattcgcgaattttgataactgttctactctttctaaacataacaaattaatggtaagaatctgcacctctataaacacatgaaatgtgtctaagaatggtttggtcactccttagatttggctac

SEQ ID NO: 4999 - DNA, 1291 bp, Zea mays
  misc_feature (1)..(100): optimal_loci_44932_G1, chr1:263606719..263608009, Cluster 30
gacaaacgtttgtaaaaactatatcgttgggtctgtacctgagcaggggaagtgatcgtagcaatatcgttgttgttggcttatatatatgtacgtgaccatcagtgatctgattttccgatattataattcaatatttcgtttttagagagcgcttttaaattttgttttgaggaaggcattcaagttatgatgaatccatcttataaaaggtcagtgactttgaacccatgtgattcctactagcaaattaaatgactagttagtatgccatgtgtgtgcatactttagttcttgcatagagtagtgtagagtttcttttttcaatagcgctacccattttaactttgatgaacacacaacctattattttgagctacaatataatataaattattgatcatgtataaaagctctagtttttatttctctataattagtctccttatttttttatgtggcatgagacagaatgatttttatataccaatttcaatttttgatgagcagatgtatttggtacctatgagcctattattttttaagccatagtattattgcccatgaatgctccaatttcatgtataactgttaatttaataaaaacatactattcttctgtctaatacttgtgcattttattatcatcttacttcaactacaatgcaaaagacttggctacaataagctgaaagactccaagatctaaggattctaatacgagctagcagctttcatcatgttggagatgttgagtgaaaaataatctttctcacttgaacggttgaaggacaagaaagactatgattgagaaactactataaaatgtacaataaagtaatatttgtaatacatataatataaaacttaataaatttatgatgtatatacatttttattgtaacatatacactagtttaacatttgtaatataattcctgatggatttattatatacgtgagtctagtaaccatatgaaatataatgtaaaaaaggatcacacaaaaataataaagtgaaaacaaaacaactagcatgagaacccatatatcaagcaatctaattatcaaaatgattgaaaagttgcgaattaaaatgagtagaagtgcgttatatatcaaccgtaaagcacgaagatcgcatgcttatccgatccttaataatccaagagcttccttgaacattttggtgaaaagttaccggaataatagaagaagtggtcgtatcctactatccttgaataagtgcactcaggataggagagaggagaccgtgagttttgtactccct

SEQ ID NO: 5000 - DNA, 1175 bp, Zea mays
  misc_feature (1)..(100): optimal_loci_45163_G1, chr1:265010149..265011323, Cluster 30
acacatagggagaagagagatgtctcataagtagagataatgtgagttgtgagtgaagagaatataaaggatgcttgtttcttatatagacacaagagaaactcgtttcactgaacctggacggcttgtggtgcgttgatggtcatcaattcatcaacagttataagtaacgtctcatttatcagttactccttacattagcacttactcctttcttattacccaattaaactatgtaacgacaaaacattcatctcattgcagcaaatcacattcaatcatattgtcagttcatctatgtcgccacacaacatgcccacgacctcgccaaggcgagcgagtgtgcgtgtgacatgacagtttttttccaacttcacaaaatgtgtaacaatctatttttaagttggtaaaaaaattcttctgcttttaacatgggactaaattatcttatttcttgacattattatggaccacaaaaaatcaattgaattaaatagactagcacacttaaattggacaacataacctatcatccatgaacctccctcatcctactttgcccaaccactgattccattcattgtggctgatacatagaggaagaagcagcctcccgaccgtcaagcggaggtttggtggcgatggaaaacattagaccctctttggtatggcttctccaaggcctcttcgaaaaaaatcaacaggagtcgggagccagaaaaagatgcttctaccgactcctcatgtttttctcttcgttgggcccagacgcagtaggatctacaggaggagctacactttcaaccaaataggatgctttttctagagctctccctgaaaataagaatgaagatgatttctaggagaagtcagagccaaaactagagttggaagagaaagagtcctaccaaaagggcctcaacttgaaggtcacgcgatggtgctatagcaatgttgtggattagatgctacattgattatcaacacaagaaatttttaggtggaattgatggacaatagtgtgtctgtccacttccactaatgcgtagacaattctaatagtttagtagtatagagacaaatatgaaattagtgtcaggttgaaaattatgatggtcatataaccaatagattaattagtagaagataaaattattggaggttggctgtatgat

SEQ ID NO: 5001 - DNA, 1058 bp, Zea mays
  misc_feature (1)..(100): optimal_loci_45300_G1, chr1:265750233..265751290, Cluster 30
tatggaaccaaacaatagatgggcaaagaatataggatgattgtgactgttgacagtgagattatagtgttgatttatatacttcacttcctatttaacactttctttccgggtgtccagaacagacgacaaatcctccatctatatttctcaaaaaccatatgaatgtaacctgcaatttcacaaataaaaaaacaatggtgatgcgtgggaaagcccacctattgtctttatgtcgtagtccttcattggccacctcttcgctaccataacaaggaactgcagttgacgtgtgaccgcgacagcaggccctagcagtaatagtaactgttgtgcacgtaaattgtacatcgattaaaatccaccccacgccatgaaacatctcaaaggtcacatgttgtaccgcaaggcttaggataaacagtgtgtgcacatgtatctagtcttgtcattctgaagtagtagtactttgaattttaaaaaaaaattaaaaacgaccaaagaagttgtatctatgcaacaaggcatattcgtacgtaccacacatcaatatcaatacgtacattgagcagcgcacagtgccgaagaactgtgcgttctgcagccagcctatacacgagcgtgataccagctgcgcctgcacacacccccacttgaatgcagtatatatagcgcggaccaccgaaggaaacaactcaatctgcagaagaacggagaaatacatagttttatgttacacaaaccgacaacaatgtcaaattattacctatacatgaataatatgctggcacaagatgtatatttcttcatttcgttgttgagaagcacaaatgatttatcagtagattattagtactccgatccctttcaaatgttagtagtggaaaagatctaaaaggataaaacgatatggcataaacaaaaaacaagcagctgctagctagtgcttagtacactctttcactaagcgaaatatcatcggtgccatatgttataaacaaaaaacaatgattcagaaggtctactatatatcatgatacaagcaacgcctagcagtc

SEQ ID NO: 5002 - DNA, 1065 bp, Zea mays
  misc_feature (1)..(100): optimal_loci_47530_G1, chr1:278620163..278621227, Cluster 30
cttagtcctaaatagattttaaacataaacaataaagcaacgtagcttaaaaatgaaaccataataatggagaataggtttgtatagatgaaaatgcaacatgcagcccgatgatcaaacatcctgacgccccgccggcccgccccgacacgcacctttctttcccgtggaccgagagcaatgattcccacgtctctctactatgttccaatattgccagcaaaacctgcgcgctatgcattcgtagtggagctgctgccatttgggtcgcaatggtatctcaattctcaactgctcgactatacgactagctgtactacacagacggaacaaggtaatgcattcaacaactccaaagtttatgaattgcttttcatgtgtgtggacccttgaaaacgatataagcaaatctgtctagtaaaataattatatacaacaccggaaattactagtgagaaatgtaatttcgtaactgtcttcatgtgcgggcacgacccataatgtacttttccataattagagagaagtacatgagagacacgagcgacatcatagcaagtacgatagttgcttttcttttttctttttccttttttcgttttgaaagtgacgacgggctgctttgcataggcatatgccacgaattttaccacaagaggttatatatactaacaatataattgttggtcacagctctgtcctaacaaaattaaacatgattggtttattttactagacaattcatgatcacgagtcccgtaataattaccaaatgcacaattctctacgcatgccattgcatcaagccttcaagggtttcaaaatcacctatcaagcatgtctttgcaccactaacaagatcatcggcatcgcacaactttgattccttttcttgaaacagttgcatcaacgttcatttttgagtgtctggttggttgtctatgacccatccaggcttataggatgcaaaaaaacatgccgattttgaactttttgatgaagtagtcaaacatgacacacaacttgttccacaagtgcttgatttccggataaaaaactagctta

SEQ ID NO: 5003 - DNA, 1021 bp, Zea mays
  misc_feature (1)..(100): optimal_loci_47683_G1, chr1:279181565..279182585, Cluster 30
aagtcatattggatctaatatcggatccaataatatgtgactcgtgaacccgcaattgctagatatgaatcagggttaataaaccgagttttaccccaaatccatctaatcaccgaaaacggtaccatctcgctttcaacggttttcgaatttactgacatgtttctattttaaattttaaaatggttttcgtgttaacgggtcaagaaacacggttttcggtatttcttggtgaagtttggtgtacatgttttcagatttttaaaatgcgaactttcgttttctcgatcgaaatttatttttcctcgacgaaattcgttgtttgacccaaaaaaattgataattaaaaatatgaaacataccaaattactcacgaaaatatatagtttttatcataacttttaccttgttttttaaattttgagtggaaataaaaaaccggcccaagaatccggttctcaatcagttttgtaaaccctgagatgaatgtgaccgttccaaagacgattacgattttaaatttatattaactaaatttaaataaaaacatttaagatttatgcctttaaataattttataattaatctaacatgcaacctgatcaattgtgctacgcagcattgtggctatagttgatgcagccctccacaggattctaatacacatgcatatattttcgggccaccaacagtcacagcagggggaaatagcagtcgagctgagccatactagtggtatcataaatgttagtgttttatagatttgattaaaatttaaattgtttgagctttgatggacaatattaaaaaaaataaaaatgagattataattctttttatgcagaggggctatatgacaaatgatttttaggaacctaaaatgatatattatatacataatatatacattagagacaattataacttatgatatgttaattggcatataggtataaaaccattaatgtgagtctatatatacgaaaaggctcacgcgtcaggatcgaatgattgatcctac

SEQ ID NO: 5004 - DNA, 1363 bp, Zea mays
  misc_feature (1)..(100): optimal_loci_52483_G1, chr2:3878376..3879738, Cluster 30
gggtttgcttctgtttttcaagtgatgactagtttttgtagttaggggttgtgtgtacattattgattgttgttgggtaatcacaacttatttgttttaattcctttttacacatatgccaacacagaaaaactgtagattcatgagaagcgggttttcataagatctattatttatttatatataatatgaaaaagggtgcatgatatatataccatactttcaagttactgttaccacatgtttctaacattttaatgcatggttgcccacaattttttattttgcatatatatatgtaacagctatctagtagtataaaaacaatatgcaaacaatttctagcagatatatatgtgatacaaagtaccagtacagtaatagagtcacaaaataatgtcaaaacacttgtctacaaatatatatagtgaattaaattggcatctgttttttggtctcgtagaaccgattataaccccctacacaggaggaactttttgagcggatgtagagaacagggagctttccggaccacctttgagcaatcattaattatgggtaaaattgttttcgatccggatgagaaacatgtggccttaaacaacttttgcatctaataaaaggattaaaggaagcatggtgtttttaacgattcatatgccacttttgcatctagtttttgagcaaaaaaaaatggaataccttgcatcaagtacttgcgtagctcgtcagaactaaccatgcatgacgtgcaatctctgctcaagtactacttgcgtagctcgacagaactttaggtccttcccttttctttcgttttactgtctggttttaaagatgtttccttgatctgaaacgaaactcttcaatttcacttgcctttgttgcgcatgaattaatttttgttctacgtgaatgatgaatttgttttatgtagagatctctgacaataggtcgtacgaattcctacactccaattaaaattctttttgcccaaaacgtagtagagatctatatatacgactatacgctacagaataatgtttgcaagaaagagtggatccacacccttccgaaactgagaaatgcaagcacgggtgtaccgtggggttttctttttgaaagatgcaagtacgtacaagtatgcgtcgggccctatatagcatctccaactctactttttatttatcaaatcaaaaaataatagaaggttctttactttttgatgctagatataaaaataataattcaacatgatctcagctcaagtctattttacggaggtccatctttttctttagctacatctaccaaaatgtgtagggagctctttaattttgtccgagaaatattttcccacaat

SEQ ID NO: 5005 - DNA, 1083 bp, Zea mays
  misc_feature (1)..(100): optimal_loci_52560_G1, chr2:4255817..4256899, Cluster 30
aagagataaaaaaattctatccattttctttgtttaccactttctaactaatttaggcctattttggaacgcatgaatttcacagtatttttatagaaatcatttcattttcaaaggaaaactacaagaaatggaaaaaattactcacgtcctctgtctcaccttatattatatattccaaatttacaatccatactcatataaatcagaacaattcgcgcctagagatggtgaataaaatattcaattccaatatattttgagtaatgacctacgtcacgtatgcgaagccgactcatgacccacgctaatacaagttcgaacaactcacatccagcgatacaaccgagtacaattgttatacatattgtgtttcgttgtaacacacaagcacattttctagtagctaataaaatcaaaagttcaacacaaaaaatacaggttcattgttatgtgaacaagatgcaacacattgcatgatgataaaacttaaggtgaggtttaagggtaaatacatttaaaaaaacccatataggcgcaatcaaacgatgaaaacacacatagagtaatcaataaaatcatcacaatgggattgagattatatagtaccaaaattggtgttgtgttagaaatgaatgcacatagtaaagataactagttttgattagttatacatatgaatccatataactttcagtaatacttatatgacgtaagattctataggccaagctgaaaaacgagttagccggctagagcatctccttcaacagagatctccaatgtttccagtaaagtgatacgaggtggccaaataatattattatttcatagattattagagatactgtaatagatcaccaataatctcttccaacgtacatcatcacgtgggacctatgtatcagactataattgatttattcattctctttttttttcctttcctttctctacactacatcgcagcatcagagccatgcatcctgcctcgtcccttcccttgccgccttcgtgcctgactcaagccatcaatcacaacgctagtctctatccccatgacatatatcacagctatcgatc

SEQ ID NO: 5006 - DNA, 1195 bp, Zea mays
  misc_feature (1)..(100): optimal_loci_5278_G1, chr1:27087332..27088526, Cluster 30
tgtgcaggcgtcaaggtgtgcaacttgtgttttatccaatacaaatgataggatacgggtctatcgagccattgtcaacagaaacaagagtcatgtgtccgtccgccccacccgggaggtgggtcttccactagtgtcatggtaaagattgcatcgagacgaagcaaagtcgtgaagagctcgtgactctcgaatgcatagatcttgagttagatcattttatccttgggttaagtggtttaaccaagatatataaatataagcgtgagttgaaaatgtgtaattgattagataggaggatgcccaaccagcccatctcttcaattttcattttctagcgcaagagtctagttgtagtagttttgatctttcatttagttttaactgttgagatccgagagtgattgctctgctctgtaaggttttctctataagtttcagatctggttggtgttgaaattaagtaatttttcctctgaattgaatatgagttcctttactaatgtttgattcattttttctctctggtttccctctcttcacttttttatggatttgtgttccaatatttttgggttgctttggttggatggatacgggtcaagacctttgaaaatcatccctatggaaatagtttggtagattactcgcgagcacgcagcttcatatcttttgaagcaatttttttaaaaaaaaactcatttttgagttcttcgagatgttgatgctctgatgatatcattccaacactcctagtgcaaagtttgaaatcaattggaattgatttgaataagtttggatcattggattaaattttctaacgtgcagtttgtcaataccgtatgatccggtgtgaatttctattgatccaatacgaatactctaggattttgagcttatctttttatgagatattctatatggtgctgtgagtgtgtgattcaaaatttttatgggtttttatactgtttaatgatgttttaagcttgctgaaaaccgttggactgaattctcagggaggtccgatattcatatcgaaggatccgatattgcaccctgagcaggttcattttactctgcattttgtaaggcctttttgtggttctttcccttcccaatttcaatctttttcgctatgttctctaagctttttagtgcatctagccatcaattagcatatcgatgggttttggac

SEQ ID NO: 5007 - DNA, 1098 bp, Zea mays
  misc_feature (1)..(100): optimal_loci_53540_G1, chr2:9438225..9439322, Cluster 30
tttcctctggttattcttctatctacctcccgaaagaaagatagggcaggatggatgatgtcctgacgaagaatgtcggcggacaaggccaacagtaatcagtgaaggccacctccccccctggcccctgcggcaatcatttcgaccagagtgttttctgattttatgtcccctagaaagcagtgaaccaggaatcggctgtgcaatgagccatcacttcagtcagttttcctcttcctcagttgtcaccatggaggataatgcatttctctcctctagccttcttctcttccctccacccctattttgttagtttttttccttctttttcttcagaatctttttcattactactgctactacccacacccatctgctcggtgcaaaacgaagtaattagccgtttagagaggcatgtattagtcggtatgcgcatcccaatggacgctatttaagcagcgtcaacaaatatttgaaacacttaaattaaacatggtttatttttaattcgaatatattccctttagaaatacttttttttcttaaacattgtttgtttttaattccttgaatgagaatccatcaatatttttttcgagctatacatttttttaagattatggaaaccaaattgttcccgcatttttgcaatctcttgcatacggccatacaaatcaaaacatgacaaacatcttccttctgacaatcacaataataaagcatcaacaaatgaagctccttctattctagcattagacttctggcttgcaagctatacatgagcatgaattatggcattctcctaatttccattgcataatttgttctacacttgagttattaagcataaagcgtatacatctgtcttcaattgctaatctcgtctatgcagcattgataagctttcttactggatccaagtggttatagaatcagtgcactagcagtctacgaccagatcatacatttgtcatttgcacttacaaatccatcgtgtctgtcaactatgagcagagccagagcttggttgctgtcaaacagcatcgaccggctcgttgtcttctccacgcatcacaccttccaccttcttcaaccaat

SEQ ID NO: 5008 - DNA, 1138 bp, Zea mays
  misc_feature (1)..(100): optimal_loci_5385_G1, chr1:27632759..27633896, Cluster 30
gtctttactacggccatggtcttcgtcgctgttacattgactgcgaggggacgacgtataaaaggacgcgtgacgaagaagaaatatccgcgccgccgaggtcccctcgatgcgtaaccgagaaactcttccgggcactcaaccgatatggtcattaattcatagcgacatgtaaccaactgtaataactctaaagtggcgatttcttcatgctacaacataatcttatgacgaaatggtcaaaggcgaaggacgccgccggtaagtgaaagagacggggaagggtcaacacgaacagatggacgctactcaatattatttgctgtctctggctctatcgcgccataaatcgtgaaagaaacggcgttagactgtctttagtagaaatggtaaaataaggggcgcaaaactacgtaatgaagtttaaaataagagatgaaatgagagataagacaggggatccgctgctgaagataacgtcagtcagctgctcaagatagcgtcagtcgcgaacgacagtgactcattagctaacaaaataaagtaatatcaacaaataaatgtagtaaaagaaacatggtagtctgtatgagaacactgatgacgtactaattgcaaaatggtgtggcagtttggatcttgaatgaatgaatgccgattttctctgtccgtgacttcgtctcatactcacatgttccattaacattccagacgttgactgttacggaatagggacgcaatcgaggcgagggtcgtgaagacattatgtacatattttagagtatgcacgctttgcaaagatagctcactaacacatcgatcctaatcattaacgtatcaaaagaacttgtgtatacatcatatatgtaaggatcacgcttctctaacatttttttacttgagttaaatcctaattacaggttcaacttcaccgaatggctagtaggtgataaagaattttacaccatagtttagtttctaaccctatattagcatggcaatttctgaagtagattgctcaaataaaaatgcaaaatcttgatgtttttccctagatttcaaaaaactcagcactctttactaattctcattaaagcacctgcacaagggtgtccccctagtccatgcaataaccaag

SEQ ID NO: 5009 - DNA, 1004 bp, Zea mays
  misc_feature (1)..(100): optimal_loci_54534_G1, chr2:14880540..14881543, Cluster 30
tcggctaggacttgattattaattttatttaaacatatcccgtgtgcgctagcaattagtactattgtagctatgattacgtttttatttatatatggtcggtacgttctactcaaggccgcacaatgttttgggacgtcgtaatactcaatattttcatttctaagtgcaagcagttctaggaatcttaacgcagcttaagcaggagtggaaaacgtgcgtcatgtcccttgaactaccgtttggattcaattatggccaactttggtgctaatccatgctttgattaaacctagatttgctgatcaaagaaatcctcgtggatcaattaattctttgtggtgttgtgcattttcaattatttctggcagcgtggaattaagtcgtagatttttttttgctccttccagtgcgtttaaaagattcctacaggtgaaacacagtgtaaccatcaatataaagagtcgcatagatcgacaatatatgatagatataataaagaggaatgctatttttactgacttgattagaagtgtcattttcttaaaataattgtaggtaaaaaattcttacattggggcgtagaaattgtgacacaatgggataaaatgaataccaatttaggacggggtaagtatctatttagagagacatcatgtttgaagaggcacctatttctcaacacctcttgatcaaatcttaatttgagatcatcacaataaaaaatatgcagctgaaatttctcagaaaatccaatagggaaagtttgtggagtacactgatatgctatttgaactcctaaacccaatgggaaaatgagaaaaatgctaggtcatatgtatgtcattgctcaatttacgcttatataggtacccttttatgaaagggaaaccttaaacgagtttaacgagcaataaatgttatttgtaaagcgccatgtctttggtatcccattaaaaaacctctatgggacaaattggagatacgtcgtcctcaaaccttcc

SEQ ID NO: 5010 - DNA, 1000 bp, Zea mays
  misc_feature (1)..(100): optimal_loci_54899_G1, chr2:16866058..16867057, Cluster 30
aggaaggtgacgcccgacgcacctatattgtgcaagtctagttttattctcgttgggaagcataacgctgtctatgttcgaggcaaggcatcctgaaaaatgcgttaacctttccttactgcacaatttttagttcttcattcaaatgcgagattgacgtatatgttactggttgttgtcttgtcctgcagaactcgttaacttttccttagcgtacagattttattctgattttcagtcaaacgcgagattgatgatgtacctgttaatgttttttttgtgtttcgtccagtgtttacaattactagtgatcaggcttgttttgcatatagaatgcgtacacattcccaagctttgtttctgatttcgagattgatgtacctgttgacgtaactgaattaactgcttgtgcggatgttgattcatggataccaagctggcagtagttatttaatctaacggttcttactctgagattcaaactgaatgctgtgatgctctccatattacaaaccgtggattacgcaaaatgcattaaggatgatgcgggattgaactgttttggaattgttgttagcatcttaaagtatggtgcattctggttactgttgaaatgcttggattattgttggctgttaacgctgcacaactgtagcacgtttttgtctaccattcccgttgctgtaagaaaaatatggaatataggaattgaatactcctgttatttcttgctcagtaaatcaactgtgtcagggaatttttcttgacgctgtaattctagttttttttccttcttattattgtagatgtagttcatgttcaaggtaaggcatacttaatattttgttgaactgcatggtacacgttttatgaagcttggaatttgtaatacgttgcttcttgcattagcaggcagtgtttgagcttgacatttggcttgatctgattattcttcattacggatatattgcattggcattaagctcatttagttcgaagg

SEQ ID NO: 5011 - DNA, 1147 bp, Zea mays
  misc_feature (1)..(100): optimal_loci_55050_G1, chr2:17551154..17552300, Cluster 30
ggttggccggcgggtcacaaaaatgttagcagttgggtccgaatcgaagcctgcactagaatgtcttttgagttctaatggaagtcatctggagtcagattactcttttgcctgaaacactagaaatcgagaccaagggcaaggagatctcaatgacaagactattcttagatccacaactccaaaccattaagtccgcgtaccttgaagaatacgattctcttttgaagacctagacaaagtacacagtggcattcaagagcgtcacatcttagaacaagaccaggcatttcagattgctacatcttgacttgttcattttaagaaaaaattaaaaataaaacattctggtacttaaaatcttaaacccttagaaatggtcatgacctgtaccattctgtctaatttcttcaatagacttgtactttctgtctaatttattttataagtaactttagtttgatatatgcttctcgcttgacagatactataaggctactaagaaacatgagtgaaattgcacaagtaatagtagcaacttcatgagacatcaaagtatcttcttcagatgcctgcatttttttgttgttgcgtagatgatcttgatttcaatgttagatatactgtctctacagatactgccttcataatctgaaagcacatgtaaactctgacgctccgctaattgcgagtggagtaagccaaatctgtaccaaagctagctagttattttgaaaataccaaatctgtaccaaatctgaaagtacatgtaaactctgacagctccacaacgcaacgcccaccaccatcagttcctgggctggccaactcctttccgcgcctgagttttgtggcgcgttgtgttaatacggggtatcaacgattccagcatgtgtagaagtgaattttttttctttaaaaaaaagaagaaagaagaaagaagaaagaagaaattttgtccggtaatgggcctaatggacctgcctggctgctacgcatgggccgacaaagcctaaaaaatcggcatttgtatccaccctttatttttttgacgttaaaaggagagagggttacaaattccacacgcacgagctcatcacgtagtcttcggtcattgcaggcgtatgaaaaagtagttcgtatcgta

SEQ ID NO: 5012 - DNA, 1067 bp, Zea mays
  misc_feature (1)..(100): optimal_loci_55527_G1, chr2:20105996..20107062, Cluster 30
ttatcctggaccctactctcatatgtaacagagaggacgttttttcacgaaaggtatgggaatcaatcaaatttactcacataaagggtttagacgagagagtcatcggtgttgcgcgaccttcgtcgcatccgtccctcacattggtgtgatgttgatgatggagctagtaagcagtatctctctgaaaccttgctccgttgaaaacgtgcacaagttggagcgaattaggttttcgtttgtacatctgcttggtgatgttgtatgcaacgttctacgagctttatcgaccctccgacctcttcgattcgttaatgatgatagaagcaaacttcgttaagttgtaattaacgatgagatccttcttgagtttagatctaatctactgtatgggcatgatgccttttgttatatgtgatgtattcgtagtttatttagcagttgctttatgaacgaagttaatattcaatgatgttaagcatatggatttttagtagcatatataagaaagcaaatttgattttttttataaaaaaaatagttagagtatagctttcaataaggtcctcgaaaagtaccattcatgcgaatatacagctaacttaaacataggtttttcctttaaaaaaacatttccgttttgttagtcgaagattaaaactaaggaacatttatttgttcattgtaccattgtactggtttcttcacaaaagattgtacgtacgcattgacatcctaattataagtactcgacgggctcagtctcgccaaccatccctcttggtcctgaaaaagaaaggttccgcgcgcagcaacaggtcgttctgacccggtgaaggctgaacgttcggcttctgatgatccgtcgatcttattcgccttgatgcagtttgccgctgttaaactagttagaagacgaagtcagtcttcttctggacaatagaatagaataagccatccgaatacattatttccgaaccgatcaataataacgcgcgcgatactatcgtcgtcacaataatagtgcaactggagatgagcgaggagagcaacaacgcatctgttta

SEQ ID NO: 5013 - DNA, 1306 bp, Zea mays
  misc_feature (1)..(100): optimal_loci_55608_G1, chr2:20567830..20569135, Cluster 30
taaaaaatattactacacatataattaaacatgttgactactgtggtgtagactgtttatgtaattgtgataactaagacctataatatattattattaaaaaaactttttgaatgaaatatgcaataaacaccatagtttgaacctacacatggataaaaaaattacgataattggtatgaacaaaaattgagagccaaaatatagattcattctgttgtaaaaagaatacaacaaaagctgaataaattaaactaaggtttcaaaaatttacaaaggcgcaatgcaaatggtggaagaacacataaagaaaatggtaaatttatcataatcatgtatagattatagagtatatatctagatccaaatggacattgtgttaataaagagagagttagagcaaagataataaatcttgattagttgtaactgatgataagttatttattaattttaatacttatgtaacatagaattgtagaccgtgctgggacatgactagtggtcataattttactagtgcttgaccctaaacatagtgatgcatatatgtgcagagctgggtaagagtaatcccaataataataaattaaccaagttgcaaaagtcatgctataaaacagttgtctcttatttatcaatttctattattaattttacctatgtttcaccttctctgtcttaatccttctcatatttatttaatttatataggtttaccgttacacatgcttctgtattcagctttgttgcttgtatgagagccaagctctcatctcttctgttctcaacattagcatttgtttgactataagccaattattatacttgtaatcggcagctaagctccatggcggctaagctcgattagcttctgtaaattcaattaagacatgtattgaccacggcatatatgggctagcggtcaaaactttactagttgttgaccccagatatagctgaaaattatgtttgaatttgaacgtgccttagttgatagacagatatggagcagaaaagattgtggcggcttcttctctttaattaatttactcattttggtgatgtttgtgcagcaatttcataatagattaaattgtttatagctattatccaagttacacgagtcaagctataaaatagtggtttctatttatctacatttttatgtcgatatttttcgtgtcttatcttttctcttctaatcgtcctctgttttttgaaagaacggcaagagaattgccgaaatattattagaagggaaagaaagcaaaagacaatatctctactacttacccgcgcacag

SEQ ID NO: 5014 - DNA, 1083 bp, Zea mays
  misc_feature (1)..(100): optimal_loci_56725_G1, chr2:26877962..26879044, Cluster 30
gatgtctagaggggggatagactctatttaaactttctacaaactcacaaacactgggaaaaggtgttaatataagagaattaagcgataaaccaaataagcaactagaggctatactaaacaactaagaagctagctataagaacaactaaactacacaactaacaagagagctagcattaacaagtaaagacaactagagagctagagataataagcaacaacacaagcacatgatataacttaaaattgcaagtgttgaaagagtgaaccagtgagggtgtttgggagaaggtctatggtagaaggtccatattaaccaaaatcattattgaaatattttcaggaaagggacccaattcaaggtttaggtacaaagagaaaaaaagcttcggatcaagaagtaaccccaaagttactgtctaatctacgaagttggttgctaaaaagccaaagtaagtgaagaactatcaaacatggcgaaactatgaagcatagctgaaggaaaaatgaagtcctagtgcattcgaagttgccttcaggaaaggaagcagaacataaagttagggagaagaaaagacgtgtatgccacgtctttgttataaaaatacacaattttattctcttaagtatcatataatataaattacattcttgtaattccataaaaatgtatatttgtttgaacttataaataggtgaacaatttcgtggctatagagttcaactgttccataacccaacacttgtaatagctttcccaataaaacttttgaaggtaacaacaaaaagttttgatgtatttcatcactataaattttcatttcataacgatcaaagcaaaactttgttgttaatagaattaaatgcaacttgctgactctacaaagtatgcctcacctcacgccatagtatatttgaatttgatattgatagcattatctcgttgagttgattaaatgtttccctaaccatccttcaactcttcggtaccttcaaaggagagaaggacataaatcaatactcatgttgtcctattgtgtttcttcttgaaatcttgataggtccacaacagaggacaat

SEQ ID NO: 5015 - DNA, 1099 bp, Zea mays
  misc_feature (1)..(100): optimal_loci_58498_G1, chr2:37421561..37422659, Cluster 30
cattgttgagatccacagtacaaaagatcaatattatgcctatgtttacgttcttataatcatccctatgtaagaaccaaatctttagtgaataaataaagcaatcattcatcataaatctgagaatcacggtgtgatgttgaatcctttttatttttctctcccgaaccctcttctatttgatttcaggtgatttcatcttttggagtttttggggctgttgtgcttggttttcacgttttataattgtaatcggttctaattaatttacctccccgcgttggttttttcgtccttcattgatttgcggttgctttcctcacaattgcttggacggcagtagtaaataagcggacttctctatcaaacgatagggattggattccttcgaagttcctacgaaagtacttcgaccaaaacgagcccttaataactagtataagtagactagattctaatttacaagggaaaaatatattttttctcaaaagatcgtacaaataaaaatatgtttaatagccaaggtttttgtgagcaaagaacagcttcaatacatccgcttttaacctgaaggaactgcatgcgagaaagaaagaaagagaaaaaaaaggctcactgctttgagaacgaggaccagcacttccggtggctagcggtaaaagtggtgctttcaaaaaggacacgggaatgcaacagacagtacctttcaagcgcgttgtactcgcactccttctttccgtcctaaaaaataatacagtataaatctatgtagctctatttttattttttgttagtttttgtttttttattaacattaaactatcaatatgtatagcacaaactatgcatacgataaaataactattagcaatatttttacgtaaagtggatgaactttagaatagtttggtctacgacggttatttggtaatcccgatgtttttagggcatcgttgtgctatcgcgttgcggttatgcgctagcttttggagtctagttttgacgaggaagtatggaaagttggcgccagacgccaggccggggctctgacggagacatcccttttgccccgtttagccgcgctacgccatgggccatg

SEQ ID NO: 5016 - DNA, 1019 bp, Zea mays
  misc_feature (1)..(100): optimal_loci_59237_G1, chr2:41738652..41739670, Cluster 30
tgttgtatatgtgaaaagcttgtttagattttagcaattaagtgacaatatttgtgaactaatatattttgtgagatgaaatgtgataattggtccacaaaagtagaacataaggccatgatgatgaagattgcgatgatcgtgattgtgcaaaagatcgagaagtgaaaagataaagacgaaggatgacacataaagcaaaggtataatgataaggatttgtctttcatcgtccgtgtggtgatcagtggagaggaaaaactagattgataggaaacatagtcatgctataaagagagtgaaatttggttgctaatgtgattgtctagtgctaaagtattggtcatcccgtgaaagatctattggagttagccaatttaaaaggttcgagaagaaaacttgatggaggatttttacccacactggagtctctgatgataattggagttgggtcttcgaatcctagagcgctgaatcggctcgacccaatcatccatcgaaatcctccggtaaccaccaatgatcaggtcatcggaggttagagcattgacctaacatagttgaaaacaatggcatagaccctaacttctagtgccactagagagcagacattgaagcttagactttgatagttagcaaagtttagaaagcatgtgggaatttcaaaaaggccactatcaaagttgtttgttgatcccaccgaattgctacatcgaaggaagagacgatgtttgtgtgtgagggtggggtggcagtgtattcactagaactatctggtgagcaccgaatagcaagcaccaaaggttcgagcatacaatgtgtagttctaacatagtgccatcaaccattgaagaagttgtggtggtggactctagtgacctactagattctcctataacaccaaaaaagttgccccaagcttccaatgactagtgtcatgagagggcctatgaagtgtgtggccaagaaaattagaactcttcaacttgttgacacacacaagagttcaagaaacacct

SEQ ID NO: 5017 - DNA, 1014 bp, Zea mays
  misc_feature (1)..(100): optimal_loci_625_G1, chr1:3358192..3359205, Cluster 30
acccctaattcagttacactaatttacaccataacaacattcatctttttttgtttctctacgcacaggcggtcctgtttaaaccaagatcttttgtgagatgatgaagagcattgcattttgtgttagaaccaaatataatataaatatgatagtcaagatctgcatctagttagcactaaacattacttggctacatttgtcgaaagtaaatcttttccacttgaactagaatattcaccttatatttaaaatatattattgggaaactagtttttcttaatgtgtatcctggtgtcattcttatgttgttaatttatacaaaactatagataatgatcaaagttaaaaaaaggtttgaatgagtgttaggacaaaactatataggtgattaccacgtgtttggatcatctagacctaaatattaagtggagtaagtttagtttagtcggtgttgtttaattagatcttggactgaaagtgaagtagttctcttgcaaaagggctcatgtgtttcttttaacccatattggtccatatttgttaagcactaaactcatggctagttcggttttaggacctacaaattagttcacttttacttcatctatttgggtactaagctgtgcttccagttgggttataggaactggggtatccaaataggcttgcccttaaactggggtgtcggggttaacctcacagtatgaaaccaagagaggagaaatggagaatagagtaggaacttcaatatagaataccttctgcagagtggagaacgagtgttacccactaggtgagtatgccaagctgtgcatggcccacatcttccaggccttcagaacaccttctgcagagtggagaccgagagttatccactaggtgagtatgccaagctgtgcatggcccacatcttccaggcctttagaccagtaaaggcccaataggcaaaaagggaccactgtccaaagacgaaaccagagaaggccttcacagtcgttttttaacgaaccc

SEQ ID NO: 5018 - DNA, 1002 bp, Zea mays
  misc_feature (1)..(100): optimal_loci_62533_G1, chr2:59728024..59729025, Cluster 30
aaataagaaccatccattatagtagtctccagctggaatgccaaccataatggataagcggctaagggcaactccacgtctccatcaaccttaatcggagttcaaatgatacaagtgccaatcttccaaacaaggaaacaactgagaatctaataatcaccattaaactctggtgacacacatacgtaagctagtaaatggaatccccaaacttcttgcgctactcctgtactccacagtaattcatcattctagggaaatatcagtgccttatcctggacaaggtccttgaacaacctcttcgtggtaatatgatagaaacacaaaaagtactaaacaaagtcaataatatttcatttagctagtggctgagcaacgagccaaacatcaacaaagaactgagaggagaaagaacaagagcttgtttggattccctcccttaaactttagagctctaaaattattttagctccgttttaaggtcaaaagctctaacgtgaggttggctaaaatttagagctaactttagacaacacatgtctaaaaactttagctctaaagtatagagaaggagatccaaacaggtcctgttaatatacaccttgcatcttacaatcaaaagaaacatggggcatctataaggagattgtattgatgcaagccaaataatcagcctgacctgatgatcttgctgttgtacctgcaaagctccagttaaccaggatcaaacagcatagaggcataaagcagcacagcaaggggggctgccgcagcccacctgaaagtagcagttctgatcataagaaaacagacgaagctaacatggctcttctggaaacgcaagagatcgttaagaaaacacatgaagaagggaaaaaatgtctcagggaaagcatactcaaaagaatctacacaccaatgagcacacgaactagaatctctaagaaccaagaaggtaagctaatttaccacagattttggaaagtcggaagcatgatacct

SEQ ID NO: 5019 - DNA, 1151 bp, Zea mays
  misc_feature (1)..(100): optimal_loci_64279_G1, chr2:70724847..70725997, Cluster 30
tctagtgatataaaagggattaggatatacattttctttaatctttctatgctactgaccatgacatggaagagtttgatcgagtggcatagagaagattaagacatttgcgttgacaaataaggcgtacttgcaaaattgcattggcatgcagcgaattttctctagaagaaaagaggagcactactcgccggtgtaggaggaagatgggaggcgtggcaaccgtcgttctcacggttggaggtgaggattgatcaaggatgaggtttggaggggaatgaagacacgacgggtgagaaagaatatgcggcgtgtaaaatcttggataggtaacgacacacaccacatgcatgaacagattccactggcaggtttgtaatatatattcctaggcttcggttcaaaaccatgccgaattcatttattgcaagtatttggatccatgcatgcagtataaacccaagtacctccatatccagtcagtcctaaaaaaatgtgtatatataccatggacacgccagcatgaagaacagggatatgcaatacttgctggcttttccctggattctccgcctttggcacattcggaaataatagagatcgtgacaaagtagatgccacgtttgggtgccaaagatgccgctgttttgttgagagcttcctttgggcagaaagacatccaacttgaggagttgctcctatcggtctgcgcatgcgctccccctttattctctgcctacaaggacatcaatcttatctatatatatatatgcagcttctttctgcgtgcacgtccaaatatattactcttgaaggaaatgattagttcgacaagtgatatggatcggatcaagaactaacggggtgacacttgttggttaaacggactctacgtacttctaaattggagtataaaacaaaccaggtgatggacataatgttaggagcaaggtttttaaataaccgaatatagcggtctatatatctcaatatatccttttagcagtgaaaggttatgttatttagcccgatatattccaaaatattctgctttatcgccatttatctggatatttgcaagtttaagaaatatggggatacactccgtatcccgatatttaaaacaccggttaagagactataattcgatt

SEQ ID NO: 5020 - DNA, 1261 bp, Zea mays
  misc_feature (1)..(100): optimal_loci_66070_G1, chr2:82637181..82638441, Cluster 30
taagaagcattaacttgtttgattcaagggccacagtatctttatgaaagaaaaggcaggtgaatgtagtatatataataaaaaaaaccaggagaagaaaagagccggcgacatgcaaggaatcgtgtgtgctttacacgaggaaaggagagcaaaccgtgctgcccaggacatggaacacgcaaggaattattgtgcatgctttacaaaatggaaggggcaacctgtggtagccgccttctggtacattctcaatcttgtctgcgcacctctggtaggtctccttgaattttgtgggattcaagttcagcttcttctgctgttcttatccgactaaatttgtccatcccacataaatgtagaataactcaataacatttatagatatggtgtgtgcatgtaggttgtcgcaacagaaattctcaactgatggatggattagattaatgattgcgctgttgctgttcttgcttggtcttctacggaggaagtcatcatggtggtcatgcgggtactgctcttttgctttctccattaatgttcaagataaaagttacatggttttctacttcaatttctatctagccaattctggtgggacttaatatgtgggtgaaaattagattatatgtaacatctgtgaagctgcaaggtgaagtgcagaaactttagcaatccgaattaattgtttcatgcaacggttgaaggtatcagacaaataggatgtttataggatggagttctagccggtcgtatttaaaagattgaagcaaaccaggacaaacatcacaagtacaaaagcaattttagatctacatagcatgaacatgatggttctttcacattctttgaacttagcacagttctcggaatagcttacaatgtacgacaaagcttgcctgtaccaataaaaaatgtgagagacttgacttcctctaaagcaaccttagccatctcaaactcataagccatggaagcaaacttattttacacattaataagttttttcacacaagcaactcattgatcacactaagtttcatcaacaaatatggactggattttagcaggtcaagtccttttatggtattttcaaatttcaacttgcaataagatccaataaagccgaacaactctttgtcgtattgataaaatatgaaaacctatgtactctgttggtcactcaagctaagtagcaggtccttacacataccttcatgaattacatcatttgccatttttccacctttgaggtgttcag

SEQ ID NO: 5021 - DNA, 1039 bp, Zea mays
  misc_feature (1)..(100): optimal_loci_76729_G1, chr2:151687911..151688949, Cluster 30
ctaattaggtgaatggttaaaatgcagcatatgcattgcatgccatatatcagaccttataaagcctttgagatgaggtttatcccactcaaattgatgggctgatacatgcatgagtttcactttttactatagttgttcacttgagttgtatatatggtggcatcgatgccgacaaactaaactcccacactcatcagttaaccacctacaagcaacaacagtcacatatatagtagggatataaacctctgccttctactgttattagaagcttcctttacttgtttgacaagcttagagtgttgtcatgattccaacctttagtaatctaatgtgtgtggaaaaccatgccctaaacaatccacttatatatgtcggccgtcggctagcttgaggaaacaaatgtttcagtacgttgttgtagcactaagctccgaaacacagatcaaagtctgcaatcctttttctttaaatattaatctgaagttgatcattaattcactaactaaggactaatggcgcccttggaaattcatcaattattatggccgctgtcaacatggactagcaatacatcgtccctttatatgtctaaacaatctcagtgaatttgcagagaagaccaatcgtgagcttctgaaagcgacttatatgacatcatatgtatatataagctgtataatcacgtcaatgttttgagtttatatattacccaacgtcaggacccatgcttggagtgacgctgttggggttacatgagcttgtttgcgtcagtatgctgcatgatataggagtatatgatagtctaaactttttagtctcaatggggcatgcgcatgcatgaccagaataaatatgtccaggcagagtttgattagacatgcatgtgctaattcgatatgttagacactcctagttcatagtatatataagggcggcacttagatcattcatttggtcaggcatgctatcttgtgttgttattatttgtagaataacacaattgggcacttacattgagcctctcgatatataa

SEQ ID NO: 5022 - DNA, 1374 bp, Zea mays
  misc_feature (1)..(100): optimal_loci_7969_G1, chr1:41374531..41375904, Cluster 30
cagtcgcttccctgacctttggcctcgcctgttttacgagggtcgagggtacagcccagggatgtgcgtctccaaactcccaaagataaaatagctgctgtcgtgttcgatggacaaatcgcatctcagtaatatactcctatttttgcatccaaatcaccgcttcttaacagaggtttcacacggtttcaatactttgaaaacgagtttgatatcatttctcttgaatactatgctatgcgatctaaaattataaatgtcttactattaaatatatatgaaactgtcataaaattatcagtgagagtacccgagtccagctctgcagcgtggtcgcgtggagacagtcttaacgaggatggggccgagccggcctgatgggccgtctactcgtttatattgctccatctcctgtcattggtgggccatattcttgcgcacgaacgtttgggccgaaatcgtttactgaaaaaccttgtctgcttgcgttacagtgtgctgactgctgactgatctgtcgtgtgcgtgcacatttggtagatttatgaacagtctgaagcacacaatcaaaatcgttttgcactcgtgtatacggtcagtggtagatcttgtatatgatcatataaaatactgttttgcagctatatgattgtgtaaaacatttaagctgttcaagacatccttaacactgtatcttcaggaatgacagcggcatgaccgcatgagatgatttgaatgcgagaaagggcaagacaaacaaacagtatactgatatatcgactcctgaacccgcagagacggttagaataaccctacaggctacaggtgacgttcaccccatatcaaatatttgaatatcaaatactaaatggggtcttatacgttcaccccatatcaaatatttgaatatcaaatactaaatggggtcttattgtgtatactctgcaaattattgggttgaagatattctatcatccgaaacaacctattcttttctagaattcttttttctctcaaccttcaagagacctctctttaagatttgaggtaatcataagcaaaatattgatttttctaccattgtatttgaaagattgtttaataggtttagacaccagaattaagaaatagtgaaaggtgatctaggtggccagaaactttcttttagccagctcgctttgtgaaagcaagaatgcaatgctcgttttggggagggattacactgtgcatgtttagttcattatcatgttggaaatgatgagggagcaaatagaagtgaagtgtacatatatgaattgaaaagttcagattttgtgtggatgcatattatgttgctgaaatagaaggcagtctctagcagtggagcaactttca

SEQ ID NO: 5023 - DNA, 1249 bp, Zea mays
  misc_feature (1)..(100): optimal_loci_81774_G1, chr2:180531111..180532359, Cluster 30
gcttagcaaaaaaacaagaaaagtgtcaagtgttactttgtactatttttgagattattcaacatttttattaccactttgtgagatctgtttggaatattgtgccttttgtatttggaattcaaccatccactagcattgctaatatatttggttattggctaaatggcttgtctctttagttcagaagccaaatttgttagggtcagttgcactgtgctatgttgggttctatgtttgaaaaaaaatgatatagtctttattctttaacaacaccaagtctgttatatattgtaggtaatttttaggaggacatagtagattttacagtggtctctgcactctgctacacaagaaagagtaataactagcgttcaaatatggatgcacaaacttaaaaataatgaccatcgcggtcttcaaaaagttcgagtggagctttaggaactaaattgagtcctaattcattttccaagctggtagtcgtttggcttagatgggttgaactttgttgcttttatttccttctcttggatataagagtttaaatttcatcgctttgaattatatttgacttttagttgtgtgccatctacggatggtagatgctgaaattttagttccattatctaaaaaaggttattcttaaacagccatggatatttggctattcatataagtcttcaggactaccagtctaccaccacgaccagatgttcagtgaggtggaaattttggtgctccaaagttaattacacgataatgatttagggtccttgcaattatttgatatatttaacttaaaatccttttcttgcggaagtggtcattatagtagttcctctcacgtgtcctattcgaaattgattatggctccgacttcgttttttggttgattaattaagatgcacaattcatgatggcaagcaataatcaaatggcttttcgccctttcccaaccccgagttaaattaatgtcacatttttcgttggaacctaataactgtgcttgtgtattattgataacgaaaaaactaaggaccactagtatgatctttgataataataaagtgagctgagtatcagatagttgaaagccccatgttggcgaggtttaaagcgatatgtttagttttggtagctgagacaaccagtagattaatctttaccctagtgacattgctctaatttatttgacaaaacgtttgagagttagtagagttagtatgcttgcgaatagacgagagta

SEQ ID NO: 5024 - DNA, 1075 bp, Zea mays
  misc_feature (1)..(100): optimal_loci_81803_G1, chr2:180666182..180667256, Cluster 30
acttatcaataacttaatagcatatatcaagtataatgaaataaaatatttataaaaaaatacttacattaaaacaaccacatacgtagaagcaatgggcacatatatctagatgcctcgattaaaacatgtggcatggcttaccatagtcatagttaggcatgggtagctcaagagagccaagtgcatccttgcaatacctgtctgagtatgaatcttacgacgaccctattttggtcatttctactccgctacatgtcatgtatctatactaaaccaaagggttctaagaaaatgagtcattttgccttataccataatataagcattttaaactattgtagacatattacaaataactaactaattgcaaactctaaatattagaaataaaaaaaatctacaatgaacaaacaaatttaacctacattaaatctaaacataataaccaacattataacacaatcataaaacacgtgcacaaacacatacacatacaaatcaaggaccgaaactaagcacctatttgtaataaacataatcaatctatgtaaacaacttggcttatacaccaaaatcaaaattgatttccccatatatacctagaaaactatgttataaaatatacctaacatagactaaatcagtgtgtataaattgaagaggtgagaaaggataccttgttcgaaaaaaatccacagatcaaactaatccaagcttctaaggttgattcagcatattggagaagcttggaaggtttgagagagggagagatgtgaaataaatgaggccctcctaatccatgaactggctgaggctgtttaaactggagtttagttttagggatcttaacactgaccttagtgtcactcgatgtcacgtcataaatacaatggcgtccatactatttatatttataatataatacttggccgccatgatttatagtgttgatgctatagtcacaatgtcaaaccctggagtctaaacatgataataatttcactaaaaatgtgaacatgaatttttttttaaaaaaacacaatacaaatgaaatctgcatgttttaaagatg

SEQ ID NO: 5025 - DNA, 1395 bp, Zea mays
  misc_feature (1)..(100): optimal_loci_81882_G1, chr2:181176157..181177551, Cluster 30
aaataaatatttaaatacctatttatatgactgtagaaaaatacggacaactggctggtaaaatataagtgtagaagagaaaagctgacgtgagtttgtcccggccgtttttaaattttagtctacagttttatacggctttatacactatactgagcacgacctgacactatatggctatgtgctgaggctaccgcctctattatgtttagaagaacagaggcgagaggtgatatgacgctgacatagattagatgatgatgacagtcggacattgaagccatggaaagtgcttgcttcgcaacaactctaccgccaaaaaaagggactatagactaatctgacggccagagctggggcaggcaggtactactctgtaggcaattaggcagcgacgctttgtcctaaggatgtttttagcgcttaaaagggcaagtgagaaatggcgctgctctgttcggcctcgtaccgccggcactgtgcgtgatgggatggtatatggggagggaggcgatgctttttgtcgcgctgggcgggggctccaaaggctgccggccgccattgacgctgaaaagggcttgcccggccgtgacaagcaaaatcatgcagtggtagctcgtgatggcaatagcggcctaggcatggcgctctgacagcgcaggcacaagcagggtgaaaaagatgtgtgtgttttaaaaaaatttcgagctgctttggtgatcttttctttcctgcccaattcccaaagaacgcaatcgatggtgcacctgcgttgcttaaacaaacacatgatttcctcgaacgcatgatacccaccacattgtggtgccacacctctttttggttctttctacagagtcgtcaattataacatatacaggttatatatctgctgatggccggctctctgcattctgcagtgctacctcataatttacataattattattattattatggtttgcccataaaaatgaaccaatgttttttgtcccttccgttgagtcatcaatacgctcaaccgaaatagtgcacgtcttcgcacaacgttatctacagactagtgtacaagaatagagggaggtcgtaatctaaagacatgttgatgctagataatgtctcttggttcaggtcacaagatatataataccatacatcgtcttactgtatagtaaattaataatagcagtggcaaagatgttatacgcgcttagatatcaactgggcataatgattatttagctctcccatctattttagtcagtaagagttctagactaagtggtcaatagatcacctctagctatttcttgaatcgatagcgaacgttcgattcaaatccaaaccctttctacgttgctctgcccctccctttcatagctcaagcatacatat

SEQ ID NO: 5026 - DNA, 1316 bp, Zea mays
  misc_feature (1)..(100): optimal_loci_83029_G1, chr2:187356423..187357738, Cluster 30
  modified_base (898)..(898): a, c, g, or t
  misc_feature (898)..(997): n is a, c, g, or t
  modified_base (899)..(899): a, c, g, or t
  modified_base (900)..(900): a, c, g, or t
  modified_base (901)..(901): a, c, g, or t
  modified_base (902)..(902): a, c, g, or t
  modified_base (903)..(903): a, c, g, or t
  modified_base (904)..(904): a, c, g, or t
  modified_base (905)..(905): a, c, g, or t
  modified_base (906)..(906): a, c, g, or t
  modified_base (907)..(907): a, c, g, or t
  modified_base (908)..(908): a, c, g, or t
  modified_base (909)..(909): a, c, g, or t
  modified_base (910)..(910): a, c, g, or t
  modified_base (911)..(911): a, c, g, or t
  modified_base (912)..(912): a, c, g, or t
  modified_base (913)..(913): a, c, g, or t
  modified_base (914)..(914): a, c, g, or t
  modified_base (915)..(915): a, c, g, or t
  modified_base (916)..(916): a, c, g, or t
  modified_base (917)..(917): a, c, g, or t
  modified_base (918)..(918): a, c, g, or t
  modified_base (919)..(919): a, c, g, or t
  modified_base (920)..(920): a, c, g, or t
  modified_base (921)..(921): a, c, g, or t
  modified_base (922)..(922): a, c, g, or t
  modified_base (923)..(923): a, c, g, or t
  modified_base (924)..(924): a, c, g, or t
  modified_base (925)..(925): a, c, g, or t
  modified_base (926)..(926): a, c, g, or t
  modified_base (927)..(927): a, c, g, or t
  modified_base (928)..(928): a, c, g, or t
  modified_base (929)..(929): a, c, g, or t
  modified_base (930)..(930): a, c, g, or t
  modified_base (931)..(931): a, c, g, or t
  modified_base (932)..(932): a, c, g, or t
  modified_base (933)..(933): a, c, g, or t
  modified_base (934)..(934): a, c, g, or t
  modified_base (935)..(935): a, c, g, or t
  modified_base (936)..(936): a, c, g, or t
  modified_base (937)..(937): a, c, g, or t
  modified_base (938)..(938): a, c, g, or t
  modified_base (939)..(939): a, c, g, or t
  modified_base (940)..(940): a, c, g, or t
  modified_base (941)..(941): a, c, g, or t
  modified_base (942)..(942): a, c, g, or t
  modified_base (943)..(943): a, c, g, or t
  modified_base (944)..(944): a, c, g, or t
  modified_base (945)..(945): a, c, g, or t
  modified_base (946)..(946): a, c, g, or t
  modified_base (947)..(947): a, c, g, or t
  modified_base (948)..(948): a, c, g, or t
  modified_base (949)..(949): a, c, g, or t
  modified_base (950)..(950): a, c, g, or t
  modified_base (951)..(951): a, c, g, or t
  modified_base (952)..(952): a, c, g, or t
  modified_base (953)..(953): a, c, g, or t
  modified_base (954)..(954): a, c, g, or t
  modified_base (955)..(955): a, c, g, or t
  modified_base (956)..(956): a, c, g, or t
  modified_base (957)..(957): a, c, g, or t
  modified_base (958)..(958): a, c, g, or t
  modified_base (959)..(959): a, c, g, or t
  modified_base (960)..(960): a, c, g, or t
  modified_base (961)..(961): a, c, g, or t
  modified_base (962)..(962): a, c, g, or t
  modified_base (963)..(963): a, c, g, or t
  modified_base (964)..(964): a, c, g, or t
  modified_base (965)..(965): a, c, g, or t
  modified_base (966)..(966): a, c, g, or t
  modified_base (967)..(967): a, c, g, or t
  modified_base (968)..(968): a, c, g, or t
  modified_base (969)..(969): a, c, g, or t
  modified_base (970)..(970): a, c, g, or t
  modified_base (971)..(971): a, c, g, or t
  modified_base (972)..(972): a, c, g, or t
  modified_base (973)..(973): a, c, g, or t
  modified_base (974)..(974): a, c, g, or t
  modified_base (975)..(975): a, c, g, or t
  modified_base (976)..(976): a, c, g, or t
  modified_base (977)..(977): a, c, g, or t
  modified_base (978)..(978): a, c, g, or t
  modified_base (979)..(979): a, c, g, or t
  modified_base (980)..(980): a, c, g, or t
  modified_base (981)..(981): a, c, g, or t
  modified_base (982)..(982): a, c, g, or t
  modified_base (983)..(983): a, c, g, or t
  modified_base (984)..(984): a, c, g, or t
  modified_base (985)..(985): a, c, g, or t
  modified_base (986)..(986): a, c, g, or t
  modified_base (987)..(987): a, c, g, or t
  modified_base (988)..(988): a, c, g, or t
  modified_base (989)..(989): a, c, g, or t
  modified_base (990)..(990): a, c, g, or t
  modified_base (991)..(991): a, c, g, or t
  modified_base (992)..(992): a, c, g, or t
  modified_base (993)..(993): a, c, g, or t
  modified_base (994)..(994): a, c, g, or t
  modified_base (995)..(995): a, c, g, or t
  modified_base (996)..(996): a, c, g, or t
  modified_base (997)..(997): a, c, g, or t
catgttagtaagaagcccgacgcatattccgagcaccacgtacaactatacatttaggaatcacatggtgcaggacttacaactatgcatgttgcagtgcatcgcttgtcccaacgatgtggcgtttttggtaatgcatgtaatacactccttaaagaatattgttttttttaacttttagataggcaccctgtttgactatttttatttaaaaatttattatctacaaaaactatacaaggtagataactaaacacgtgatatgtaaatttaaatcaaatgtgtcgtgtgtttttggatggagcgagcaccggggtgtgctcggctctgtcatcactgcaggatcaaaagtcagaggagaagattacaaggcggtaaaaacaaaaccagtgtcaggctcttcagccccatgttggccttttcctatttgaccgacctgtgccttgtgtcctgcttgttgcttcgagctccaactccgaggcagaggcatacacacacattttttttgaacgtaaggcatgcacacacatgacccgagcccgaggttaatgcatcgtcggtctgaacgcttagcttttttgaaacggaacaggggcgccatgtcgtcatgtcgaggaacgggttggtgagacgtgctaccgtccaagcccttttgagctcctgttcttgagtcaacaatggcattgggtcactgacattattatctacatctattcaccatttaacatcatttttcctctactaataaataatacatgtgcacaaactttaagaaagtgggctggcggctctcaatctggcgcttccctgattcatccaccccttcactgttgtgcgtagggggagttgaagagcacggcattacggtcgaagggacacgctatattgctacaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgaccattacactcatttcactcagtaatgaaatgatccaggcacaacttagtaagtggccggcggctgtcagtcagccgttgcactgatcgttacgacccttcctgtgtgtgttaggggggatctgaagagcccggcattacagttgaagggacaccgctatatgctactatgtagcagagggtgataggcgcaggtagcgtagacactgttgcgactatgagaggcagtttgttgatcgatgggacactgtttgcatgatgcgagggcacacatcatagccaacttcggagtttttagcctatgcgcaattgtt

SEQ ID NO: 5027 - DNA, 1166 bp, Zea mays
  misc_feature (1)..(100): optimal_loci_83243_G1, chr2:188813881..188815046, Cluster 30
tagatactaggttgatgaatgattatttgcttgtgaaatggatttgaaaaatcacccaagggtcggaaaacatctggtataaacttgttaatgctaaatatatgctaggacacaattttttcattccaaatgcaaaggggtatcacatttttgtcaaggtttacataaagttgaacatttgtttcaatggggtgcaatgaacagagtcagaagtggggaagagaccttgttttggaaagatatttggttggaaaggtacaattgagaataaagtacccaagattttttgaaatatgcaaggacaaggaggccctagtataatgttttgatgagaagggttgaagtttggatttgaggaggcctctcactgattcatcaaatgggaggaactccattgtgagcttcaggggcacgatatttctcaagagagggatgttgtgatctggagtttagacaaatcacataggttcactacgaaatctctctatagatttaaaactgatgcaggtatcaggaataaaacctataaaatcatctggaggagtagggtgcttttgaaaataaaggtgttttgtggcttctatacaatagaaaaattcaagctgctatggtttaaaaaaaggtggaaaggaagtgttgtatgcagtctgcgttgtgggcaggagtctattgaccacattttctttcattgtactttgtccaaatatatgtggatttgtatgaaacaaaatatcggacgagagtggtttcctaactccgttgaagaattatttgaaaacagggatggtattaaacctcacatatctcaatcccttcatctatttctgatcgcatgtgtatgggctttatggcgtaatcgaaacaagatgacgattaaaaagaatttccctagcagttcatatgtgatcctatatgatgctatatcatttatgcagaattggaggttgctgctaaaagtggaggagttaaaggagttggagaagatttcggagaagatgaagatctagttgattaacttccagccattggttggggaggtctatgacattgcggtgatatgagctttggaaagagaaggcaatttgagttgttttctggtatctatgagtgtggtgttcagtcctggtgtgggatcagaatcatttgatgggctgtgcttttgttgt

SEQ ID NO: 5028 - DNA, 1365 bp, Zea mays
  misc_feature (1)..(100): optimal_loci_84502_G1, chr2:196145025..196146389, Cluster 30
aacattgagaggcaactcataacttcacaagggctacaatttgtatggcattatctattttgcacatctctctattctggatgttggactactaaactggtctttgtgttgtttttaaatcataactcataagtgtgtgtctgtggtagtgtggtgtgtggactgtgaatctgtgatgaaaacaacttgtgtgatggctgatggtagatcaaaacaatttgtgtggcggctgtacttattctgttattcagttgttctgtaatgaaaacagctaatctatgtgattgtctctgtgtctgtgtctgctaatctgctctctgctgtagacttagtgctgtgtataggttgaagtggtgaaccgtgaacaataggtcaacagctaagtgaatttatattcagtactcgctactcatttacttatctgccatttgtgttagtgtctcggtttgtaactttgtatattgcacatttgcatttacagagttgtagtcttgcactgtgatctgtgaagcgggctgtgaacagctcgataggcctagcgggcagctaggtcgtcgtgctaaacaggacagcatggcccgtctaatggtaattgtgacgggctatgggccaaacgtgccaacccgataggttaggcgtgccgggcctggaagtgagcccacggttagcttggcacgacctattgtacacctatatatggaggctagcttctatttctatgtccttttttaggtggggctttaattgagttttttcttaatataatattatactttgatttttctcctaccaacctagttttttgtgcactcgtctgttttggatctcaatctgattccgtaatccagccttttatcttttcctccccatgcaggtcaggtcctctcttgttcacagcagcagatggtcctgcagcaggaactagacgagaatcagtgcgtgcagcgtggctggaactcttcgttctttgcagtatcgatatctgggctgttcttcctgctttcctttgtacccgtcactgccaacatgttcagattggtatgggtggtccatcattgatccctggattagatatggttgtgttcttgaagtcttgttcggcactttggaatgttttcccgggctggtttttctccccatatggattgagctaatccgctcaatccaaatatttcacccaatctcttgtggggttaaattcctaaaccaatcaaccaatgtttgttattccacatgaattataacccaaacaactatgcttattcgtttattccatgtggatcaaacccaaacttatataccaacaaaagccaataaatccaacaaatttaagtatataaaatgtcatctttccaaaaatttaaa

SEQ ID NO: 5029 - DNA, 1249 bp, Zea mays
  misc_feature (1)..(100): optimal_loci_84852_G1, chr2:197956701..197957949, Cluster 30
aatgtccaggcatacacaaatcaaaggaaatgagtcaccactttggatctccttctagatattatgtattacatgagtcacaagtttggctgcatcatagtgggttaatcacagatctttgttggattcgtatttatttagtacattagtagtggcatgtaatgatttggagataaatatcatggaaaatatgtgacttcaacatggaatgctaaggcatctaaacccataatttattggatgaagccgaccataagttgtgtaaacgatgttcaaagttcaaaaggaggtgcatacatgcaactactataaccaaacaaataagaaagaaagaacaatgatacatatgctctaagaaacttagaacttcagactcaacatgtggctcaaaacaattcaataactagtgttccaactctagagaaataacttgatgtcgttgcccctattcactagtaccatgaactaagatattcaatgtctataataaactccattgtcctacaaaataaggtgatgaatagtgtatctatagcacctaacatgtatttgaagtccacattggtccctccgctcaatcaaccagcaacacataaccaagaaccaaaaaatgatgactaatactagtagcgtgatgatgacatcactattgagcaattgtgagattcttctttacgaaataatccatgctgaactggagcatactcatatccttttggatgtatcatgatgcataattcaaaggcaatgagtcatcactttggatctcttggctagatattacgtaatagatgagttactagtttggttggatcataatgggtgagtcattgatcttagctggattcctaatttgtacatttgtagtagcacgcaatgcactattgatatatgtcaaggaaaatcatgatcctgtcacagaatgctaagccatttaaacccacagctaacaacaggatgtggaaccgatgataatattcaaaaataagcacatacatgcaacaaataataaagaaataacgacgatacatgtactccaagcaattaagaatttcaaattcaacatataactcaaaactatatgtcaaccaatggtccaactctagagatatagcttgatgttgtttcccctattcactaggacatgaagtatgatattcaaagtccataaactccacatatcaatgataaccaaacttgataaagacaaataataaaataacatccattcatatgcaatgtgatacat

SEQ ID NO: 5030 - DNA, 1014 bp, Zea mays
  misc_feature (1)..(100): optimal_loci_85008_G1, chr2:199168550..199169563, Cluster 30
aggtccgtgtgcccttggacgcagggaagcatacaaaggttgcaatcacggcggacggacgaatcatccgtgaacacatgcgtcgccgtcatgtcggcgatcccatcttgccttcctctgctgcaggtgcagggctcctgcctcctgcggggctgctgctggccctactacctgtgctccgcagtccgcaccaatcaaaattaaccttgcaattatttaaataattgatggtagaagagatcactccaatcaacacttgatcgaagtgtagtacactactgtacactgctgctactccaacgcaactagacagtcacatgcgttcatgtgttgttgtgtgcacgcatgggcgtctctattctactgttgttagccactctcgtgatctttgtcgtggagccacaattaagttctgcatcagaaccaaacaaaatcgaccacctaattacctgattcgatcctgctgctaattagctagccagagtgagctagcgaatctagcgatacacttaattaatctgtcacatgcatggacgagagagtctggagtgcaccaaggaagtcagatacagataatgagtagtgggggtaggagagctagcatagcaaagcacttttctgaccattcagcatgattatgtatcactcgatatccatccattttaagtgaattctatattatttaagttatcgtatactattttaactcatcacatattacttaagtcaatccatctgatttttagctattgtatcttatccaatcctttaattagttttcaaccgtttttcaagtcatttcatgtttttttagtgatttcatttttaaaaaaaatagttttttcaacgcattttaagtcatttcgtatattgtttgtagaaatttcatcttactcgttttttgttagttgtcctctaattttccaactaattttaggccattctatgtgttttcagacattttatcttacttagtgcttagctgatatttaggaggtgtttgaatgcgttaga

SEQ ID NO: 5031 - DNA, 1029 bp, Zea mays
  misc_feature (1)..(100): optimal_loci_85014_G1, chr2:199177989..199179017, Cluster 30
  modified_base (37)..(37): a, c, g, or t
  modified_base (38)..(38): a, c, g, or t
  modified_base (39)..(39): a, c, g, or t
  modified_base (40)..(40): a, c, g, or t
  modified_base (41)..(41): a, c, g, or t
  modified_base (42)..(42): a, c, g, or t
  modified_base (43)..(43): a, c, g, or t
  modified_base (44)..(44): a, c, g, or t
  modified_base (45)..(45): a, c, g, or t
  modified_base (46)..(46): a, c, g, or t
  modified_base (47)..(47): a, c, g, or t
  modified_base (48)..(48): a, c, g, or t
  modified_base (49)..(49): a, c, g, or t
  modified_base (50)..(50): a, c, g, or t
  modified_base (51)..(51): a, c, g, or t
  modified_base (52)..(52): a, c, g, or t
  modified_base (53)..(53): a, c, g, or t
  modified_base (54)..(54): a, c, g, or t
  modified_base (55)..(55): a, c, g, or t
  modified_base (56)..(56): a, c, g, or t
  modified_base (57)..(57): a, c, g, or t
  modified_base (58)..(58): a, c, g, or t
  modified_base (59)..(59): a, c, g, or t
  modified_base (60)..(60): a, c, g, or t
  modified_base (61)..(61): a, c, g, or t
  modified_base (62)..(62): a, c, g, or t
  modified_base (63)..(63): a, c, g, or t
  modified_base (64)..(64): a, c, g, or t
  modified_base (65)..(65): a, c, g, or t
  modified_base (66)..(66): a, c, g, or t
  modified_base (67)..(67): a, c, g, or t
  modified_base (68)..(68): a, c, g, or t
  modified_base (69)..(69): a, c, g, or t
  modified_base (70)..(70): a, c, g, or t
  modified_base (71)..(71): a, c, g, or t
  modified_base (72)..(72): a, c, g, or t
  modified_base (73)..(73): a, c, g, or t
  modified_base (74)..(74): a, c, g, or t
  modified_base (75)..(75): a, c, g, or t
  modified_base (76)..(76): a, c, g, or t
  modified_base (77)..(77): a, c, g, or t
  modified_base (78)..(78): a, c, g, or t
  modified_base (79)..(79): a, c, g, or t
  modified_base (80)..(80): a, c, g, or t
  modified_base (81)..(81): a, c, g, or t
  modified_base (82)..(82): a, c, g, or t
  modified_base (83)..(83): a, c, g, or t
  modified_base (84)..(84): a, c, g, or t
  modified_base (85)..(85): a, c, g, or t
  modified_base (86)..(86): a, c, g, or t
  modified_base (87)..(87): a, c, g, or t
  modified_base (88)..(88): a, c, g, or t
  modified_base (89)..(89): a, c, g, or t
  modified_base (90)..(90): a, c, g, or t
  modified_base (91)..(91): a, c, g, or t
  modified_base (92)..(92): a, c, g, or t
  modified_base (93)..(93): a, c, g, or t
  modified_base (94)..(94): a, c, g, or t
  modified_base (95)..(95): a, c, g, or t
  modified_base (96)..(96): a, c, g, or t
  modified_base (97)..(97): a, c, g, or t
  modified_base (98)..(98): a, c, g, or t
  modified_base (99)..(99): a, c, g, or t
  modified_base (100)..(100): a, c, g, or t
  modified_base (101)..(101): a, c, g, or t
  misc_feature (101)..(136): n is a, c, g, or t
  modified_base (102)..(102): a, c, g, or t
  modified_base (103)..(103): a, c, g, or t
  modified_base (104)..(104): a, c, g, or t
  modified_base (105)..(105): a, c, g, or t
  modified_base (106)..(106): a, c, g, or t
  modified_base (107)..(107): a, c, g, or t
  modified_base (108)..(108): a, c, g, or t
  modified_base (109)..(109): a, c, g, or t
  modified_base (110)..(110): a, c, g, or t
  modified_base (111)..(111): a, c, g, or t
  modified_base (112)..(112): a, c, g, or t
  modified_base (113)..(113): a, c, g, or t
  modified_base (114)..(114): a, c, g, or t
  modified_base (115)..(115): a, c, g, or t
  modified_base (116)..(116): a, c, g, or t
  modified_base (117)..(117): a, c, g, or t
  modified_base (118)..(118): a, c, g, or t
  modified_base (119)..(119): a, c, g, or t
  modified_base (120)..(120): a, c, g, or t
  modified_base (121)..(121): a, c, g, or t
  modified_base (122)..(122): a, c, g, or t
  modified_base (123)..(123): a, c, g, or t
  modified_base (124)..(124): a, c, g, or t
  modified_base (125)..(125): a, c, g, or t
  modified_base (126)..(126): a, c, g, or t
  modified_base (127)..(127): a, c, g, or t
  modified_base (128)..(128): a, c, g, or t
  modified_base (129)..(129): a, c, g, or t
  modified_base (130)..(130): a, c, g, or t
  modified_base (131)..(131): a, c, g, or t
  modified_base (132)..(132): a, c, g, or t
  modified_base (133)..(133): a, c, g, or t
  modified_base (134)..(134): a, c, g, or t
  modified_base (135)..(135): a, c, g, or t
  modified_base (136)..(136): a, c, g, or t
gcgcgcgccttttgtggcgggtcctctgctcacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatgaattaactagttgaatggagccgtgagataagacacatggaagaagagcgcgcgccttttgtggcgggtcttctgctagcaataaggcagtaagctgatacacactcacttgttgcttgcagaaagagccaaatggacaaagaaaaacagatgccgttagctagtacaataaaatagcatatccctcgctgtttattacttttttttctctcaaaaaaaaaagaatacgtactactactagtattaaactgacctcacagattgcaagccagactaataaaataacaaatgggctaagacgtctctgaacattcagatttcagagggggggaggtaacatccagcaaccaggcccaaaacttcctgttactcttttgaggcccagtccaaagactcccccagcggttttggttggtgcggcagaaaataaaaccgcgcaagcgcactggggataataaaactgatatccagatcgttggaaccagtgcttttggttccgtctggcaggaaataaggaacatgaaccctaaactgtctctcttgcgttaccagatggcaaattagtggtctttgtctcttctcttgcgtgcactatcttttgagggcgttcggttcggcccttttggcgcgttgtttttctgcttgctgttttggtcggtccgcaacagcagatcacggtcaccaggcgctgtttggttctagaaaagcaacgttaacagcaaatggaattgttcgctaattaccaattttacctggttcggtcgctcagtgtgagcgtgaacaccttttgatcactgtcgggcgctatttttcatacgtatcccgccacttatttcaaacgtcactgtgtctacaccagtataccttgatcactggtcat

SEQ ID NO: 5032 - DNA, 1402 bp, Zea mays
  misc_feature (1)..(100): optimal_loci_85384_G1, chr2:202149229..202150630, Cluster 30
ggtgcttttgcccgtctcttttcaatcagttcaatggcttatatcatcaaaagactggagagcctagagatctcttatttctttcatgtcgttgatttatattttatttttatttccgactccatccatcccgaaataataaacgtattttagtcggacaaaaatggctcttaatttctcatgcagtttaatgtgctgtttgctaaaaaaaatcaatatcatcttagagacactttgaatacaaatatactgatacaggtattatgtttctgaccttgacgatcataacttgagcaatgcggagagtagtaagtaacaagttggctgaaagaaattgctgtgttgctcaatctaacatcggaaattgatagtgagagacacgatcgacacacagtcaaggtaatctaaatatacctcacatattagactattgatgatctttaatttgctgtgctagtcctaactaaacaaccgtacgtgggccctccatttaagtagatgttgatggatacatacacgacacatgccgagaagattttagggcaggctaaggctagcacagatatctctgggccatcggccatgtacacgtgtccactcgagcggcatgagctttgaaacgaccacaacgatctacattttaaacctccaaaattctgaagaggctgccagtcgatggttggcaggcaatacacgtcaaggcctcaagggaccttgtcatggataagctaagctagctaggatgatcggaaggaagaccataaacaaagatgggtcgattcaaacccgtacatctctgattgtctccttacttattacaaaagaaaagatttccggaaaaggacacgtcggattgtgaccttacactttttgaccccaccgtctatctacctcccctttcccaaaaattaaattcctcctcctgcaaggcgctctcgtagtctcgtaggcccccaccacgagatgcatgccaacccgacgactccgacgtcagcgttcgtcggttttctatgtcatatgtattggtcacactaattattgtttttttcttaaggtcacactaaaattccgcacaagtatctttcttgtgttattaccattggggtgtccgtgtcctgctgcgaaaacaatatgcggatttatgtcgctgcccgtgcggtgcgtagattggttgcgctctgcaggacagtgactacacgtcgacactaggtcactaatcaccttgcttgtagaagacagcggggacggagatcgattcatgtggtggctagctgtgcaacgcgaggcggcgtgtcgccctcgctggacagccgggctagacagcagcgtgtccgaagttgagagcctgattaattactactcatgtgacatttgttgtaactagctacctagcaacagcaac

SEQ ID NO: 5033 - DNA, 1149 bp, Zea mays
  misc_feature (1)..(100): optimal_loci_85488_G1, chr2:202913228..202914376, Cluster 30
agactcctcgttcaacaatcatctcgttcagtttgttatcttctaaactctggctacgatggcacaccttccacgtgatatttgtggtatgttttgtaaatagaaaaggaagtttcgacatatttaagcaaatccaaaccttgaaatttacatgttatttcaatctattgttccaattatagtgtcacatcaaagacaatcagcctttgctcagttgccatcttagagaggcatggagctccaacttccaacacttcatcatcaaatccatttagtaagtaccaataaacacacaacaatatcatcggatgatggagtggagtggctttgatcaaggacaccttggattccacatgctctgatggccaaagaagcaagaatttatggagacatgtgcatcagtcccggtccatgatctaggaccatggaatttccccttgtacaacttacgagatttgattttaagatcgattcatgagttcaagctctcaacaaactttaaaattgtcacatgaataacacaagatcattaatttggatatcgcatagaatcacactaatccagtagcagtagaattcatagaactatatcaaagctagcacaacatcaccgaaaaacctaaaacttttccaaaaaatcagagattaaataaattcgctcagtttcccttgacaccaccacaatctaaaatgcgagagtaaatctacaatgccaaagtagggcatggctatacatgtataaaacaagctatgctgggatgggatacaccaaaaagaggatcatagtgagacctatgtatttattacctacttggtggaggatgttgtcgacactcttcttgtgctacaacaacttctccaccagcagctgattcagcgaagggattagatgcttcgccatcgacacgagcaaggtcttgcgctagattcaatttccctgacactggtcaaatcgagattctctatgtctccatcgccgctaaaaagaatgtgcgttcaaaaccagagcagaatgtgatttttttatgtttttgtcatcgctaagttcctaggtacctaacaaaggaattgtaccgagaacctattcccacacgaaaccgatggtctgtgggggatacctaaaccatcatctagaaggcacgaacccta

SEQ ID NO: 5034 - DNA, 1385 bp, Zea mays
  misc_feature (1)..(100): optimal_loci_8561_G1, chr1:44952618..44954002, Cluster 30
aaagagatttgtttccttagaaccctccatttttagagatgcacgatgtgtgacaaagagaagtggtgaaaacagcttcatcccagagatttatatctagacacatcttgcaaggatgcactaatcgcatcttgtgctactagtgcctaattttgactatggggagctagctcatggaggtatccagacacaactgttcgttgcttctgcacgtgtggtggtttcaatagaagtaattttaagtaaatatttcgtttgttgctccttgatatgtgttactaaattactgataagttggtgtcatcaacctgtttagcaccataagagatgtttttaatggattgatggccctgataagtttcttgcaagatagcaacttttcaatgactcgtggagagagagatgaccgcatgagcgctttgagctatggatttcacctcccttcaatccttcgaaatgactgacaaggacaagaccaaatccaccaataaatgatttgagaaccctcctatgtatgacatcatagatccaactgtccttgcacctataggttcacttgagtctgagtgtggaaacaagaataaagtaagggcatcttcgtttctcttggtcactgtatttttctacatggaattaataatatgtcctcatttgtaacatggatagtggaagtgccatttcagtgagtgggagtactgacctaaatcctattggttggagccaaagctaaaggaggagaaggagaaggagcatattgtagccccttagtcctatgaaaatgtggcattgaagcctactaagccctaattccttggaagcttggaataagctattgatgcgggtaatgaaatgtaatgcaatgtgaatttgaggatacaatcagatagaagcaggtaatgcaatgtaagttaaagtatggatctgagctcggcgataatttcattaacctccacaaagagaagttacattatcatgaacaagaatgggatttacttcatttgatacatctaagtacaaaatggttgatatatttgcgagatgcaaaggaagtactactaactagaaggttgaggagtatagggtaagggaggtggaaaaagttgaaatgcacctcataaaagatcttattgctagactacttagtgagtgcttggacaatctaattgttttgttaccctattttaattttaatgtatgtagctaacttattatatttttctcaacctctcccatgaaccgtacttaatggagtacgaacagacatacatgtgactaatatatcctccattggtcctggtaatggtcatgtccctcttctaaggtaccttgtccataatcaatatcctactctttggagtcatctgaatcattgctattatcattag

SEQ ID NO: 5035 - DNA, 1044 bp, Zea mays
  misc_feature (1)..(100): optimal_loci_8699_G1, chr1:45744843..45745886, Cluster 30
gactcacgggtcatctatgagctacgcatgatataagtgagctatacaatacaatcaacttggacaaaaccttcttccctcatcccccaaaaggtgatatgaacgaatattttgttgtttagtcacttttttgacatgatagcaaataataacttgtattgtttatacaatataaaggaaaatattatgttgtcgatgttggatattctaactggccaagctatttgcattgttacataggttaaaggtatcatatgcgagtgtggcataggggtagagatctaaaaacacaaaaggaaaatgtcactcacatttaccatcaattcgaaatgttattggttgatattatggagtttcaaagtgaagtggcaaattatatacaaggtgcccaattaccctgtgtggaatcaaaaaatggttatggtttcttgtatggtcttgccaatttcattcatgagcataatacactgaagattcagactttgctcattttgatcatcatccacattttatttcaacaataccaaaaaggtacaaccgctaagcagtaacacggatggttgtactacgaaagccaatgccaccagcccaccactatgaatgtatatcgtgataaatgggtcatcattcttgctcttgcatagaactagcatataatgaaatgctagtgtaacttgaacatatttcaaacaaacatatttatgtagagatattgcaacgaatatgggttcattatctatctcatgcgccaattttataataatcaaagctaattttgagatattgcatttggactataaaaactacaccaattcttatacattacaacgtgtttgttacaaaaaaaataatcaaactgatttccaagtgcacaagtggaaaacccccatcgaattcttggttgtgaatttagagttgctttgtttgtcctgctctagaatagcatcgcggatctaagctaaacatgttctataataaatctatagatctagattttaattttagttaagacttaggagtgtttgttttttttgctgattaaag

SEQ ID NO: 5036 - DNA, 1001 bp, Zea mays
  misc_feature (1)..(100): optimal_loci_89120_G1, chr2:222671921..222672921, Cluster 30
ctctctcttatgttatgcaaacaagatcaatttttagagttacatgacatgaaccaatcatcatgacatcacatagcttacttagcttacaaccaatttaattgaagaacatttacatcatagttgatatactaaaaatacaaatagaaggtgaaacttaacccaacttaacaatttgaaccatcattgtaatttcttaacatctcttgatttataaacattgaagtaactttagctttggggtacattcatcttgtcacctgctaaacctttggttctcccaagcttggctcgggttgccaccaagtctaaactttcgtgagtacaattatacttagagaacttaatctaacatagaagatatatgttggatgcaatgaaattaatagatgtttataatttgaaaaaacatggcccatgttatgtaactgatatgctcatgagattaatctaaactatcaattcataagtattaagtaatactttatcaagtattccttatttcgctttaagctaagttccattccctcactacattaagtctataagaacgaccaaccaaaaggattcctcctaaaaatatttggtattaaaaaaagatttctataaagttatacaactgtatccatatggaaaccgggggtgaactccgaaacccgattaacaaaaaccaaccaatttatatgattaatttatacaagttaaagtattcctgtcactaacggtgacacacccacactcaaactcatataaactcaatagtctatcaagtcacatgaagaaactcaataaaaccacattacaaccaagatcatactatattaagataatatatgtcacatacacaaagttttcaactgaaataatattactaatttagttcataaataattaatacaaggaccaatttcaaatttaacaaattgaaacaaaatagctttgatgggattacacctataaattggacacattcctatcttagatgatatcctccaacaaaa

SEQ ID NO: 5037 - DNA, 1016 bp, Zea mays
  misc_feature (1)..(100): optimal_loci_89505_G1, chr2:224123716..224124731, Cluster 30
atgcacctggactcctcatctaataattaataatagttcaactattttggcatttggtatcacagaacctggtccctaaatagtaggtatattttcaacaaaattgtagctttttggtaacaagtgcctaagttgttctatgtgtacatgccaattattactcgttaggccaaagtagttatgtgacttgatgtattggttctgtacaacaaagctgagagtaacagtataagatttgtgctttaacatttgaagcttagcatagtttagcggaaggcaaaaaaaagtaatcatctctcaggaaagcactctgaactgttagaagaaacatcctgctcggtaaattcacgaatatgtgaaatgacaatagcacccgaatcaaaatgtcgagccttggtcttatccattgtaagtcgagttttttatttatttaagaaacacttctatccaaatgtgcaaaatggaaatgaaattcattacacagcatgcctaaggatctgcttggaccaatgcacttaaatttaatcatctacagtttaatcataggccatctaaacgggtaaaatagaaggtggactactatttggtttaatccaattcagtccttcactcttccagtttaagctgctgggtatatcaaaagtatttgataataatagcatatctcttctatatattcctataaaacattagttttcatcgtttctatagtttgtaccatcgtcgtgcgtcacacacaaagcgcgtaaatccatttctctcacatttgtctcacgaaccagttttcagcatggtagcataaatctaattttctcccgtgttagatctgttcctgtctccctcgccaacatttttgggaaaaatcattataaaatctcaactaacctatgcacttcggaactagatcctcttctgtgcgtgaacagggcccacgcacagtggtccaactgccttccaaatctcatttgatccctacgcacctcattatattccccacggtagagcagtcacacctc

SEQ ID NO: 5038 - DNA, 1083 bp, Zea mays
  misc_feature (1)..(100): optimal_loci_9017_G1, chr1:47824757..47825839, Cluster 30
attttcacaaacaataaactgtcaggttttgatggaatttgagctaaattgtggcccagcatactctgcgattcgcgagactggcattcttccttgagtaacaaagctaatgttttagaaacttgcttgtaaaccttgaatgttttgtcattctccttatacataaatgttttagttttaaagcattctcttagtttctagactgttcacgacctgtagtgataaaaaatgttgatagagcttgtttgaatctaattctgtgccaaacaaagcaccataggaatatatattgtaatataaccatgctcacgctaagcgaaggatcaatacaggcatgtcatatatataacttatatacgccaaaacacccttgtgacatggacatataactgcaactatgatttagtcttaaatatgagtgcatgaaaaacaaccatttatgtgtctgaattttagcttgtgacttctgttgagttttaactctagactatctcaacttacttgggtctaaaagactttattgttgttatatcaaaacagcttgtctggctccttgtttcttgttttctgtcctaatttgtttggacaaacttgaatattggcttttggctttctatgaaattcaacggctcttggaccgtactatggtaagttgacaatgttttatcttaaaaagatctataaataagagacaacattactacattggatatattattgttattggaagtaatgttaagcacagctaaaaaaactatgaattaccatggtctatgtttagggacggagttttatataaactgttgctctccatattgtatccctaatccctatagttttagctaaatgtgaagatcagctatccacatatagtttatatatgtttaaaagttattcttttttcatcagctatatgatgtattggttgcatttatctcttgtaacaaaagataccttcatacctattccaagcagtcataataaagtaaaactgaaataaatacagaagacttgggctacaaaataacctacaaattattatgcatgttattaggggctaaaacacaaatttagtgaggatat

SEQ ID NO: 5039 - DNA, 1320 bp, Zea mays
  misc_feature (1)..(100): optimal_loci_93308_G1, chr3:5978831..5980150, Cluster 30
acctctcctggacgttattattccttacgagtggtataagatgtgcacaaacaaagggaatgaagaacgacttatttgtgtgggttgtatagatgaaaccgtatcttaaacttgctaaatacgttctttcggcaagatacacatctcttatatcttttttaatactccttagtatttatttgagaagagtaatggaggggattaaaaagatcaaaatctcttacactaatcaattttgaataccaagagattttagctttgtcgatcccctgcattacatttagtctcaaaataagcccttacgatacgaataatttgcgtgggttgtacttgtacataacaacggcaaggatgtgcacgcggctactaagaaaagcaaggagctacaagattcaattccatggcaatagcacaatcgccagccggtcaaaggtggtccagcactccgtctggcacactactagattagtgccagcccggcgtgcccatactcaacgcaaggttgctctgacgcggacgtacgtatcttgtagctccctgccttgtttcgagcaaacaaagacgcagagggtatgtagtaggggcttaggggggcacgcaaagcacgtacggggccccgacagtcacgaatcgcaaaccacgattgcatttgtgagtcctttccagccgtccccgtccaggaactccatctctacccatcgacgttgttatcacgtggaagggcaaccagctgctttagtatcttcttccaccagaactaaagtctacgtaccgtttacatataaggactactagtggacaacttcattcttttccaaaaaaatagcaatagaacaacttcattcttttccatgtctcaaccacacgcactaaagtaatttgcttttaatccacgtgtttggatatctagtttgatgttttttgacaactaaagatttgttcgttagaactcagctttgacttctcacatggaagcatcttctatagtagacttagagttattttttttaaaaaaaacgtttgccaaattatggatgtttgactcctttcgaagatcctgctagaagaatttgtcagcttgcgcaccagacatatttacaattacaccaaggcatgctcaacactatttgctacatatgactccatggctacaacaatgtggaggttatgctaggcagtaggcatgtattattctctctctccttctatgagctataaaatagagggggtagagtaacacgaaaataggctcagccgattcggattcaaggcttcacaatcatctatcacataaatttaatgggtcaatataggttggtg

SEQ ID NO: 5040 - DNA, 1324 bp, Zea mays
  misc_feature (1)..(100): optimal_loci_93934_G1, chr3:9108482..9109805, Cluster 30
tatatagctcgttgtaacgctacaattttaaaagatggaaggaaatgatagacgtcaactgcggcacaagtgagaaagggagaagtgtcattgggcagtgaggttaggctgggccagcggggtcgcgaagataggagtaggaatcaaggatgattcaaatgatattcttcattgtaaaaaaatatgaattatgtaacttctagttttagatattacgtgattttgtatgtgttacaaattatgcctactttatttacgatttataaactatgtaatttaaataagagtatgtgaaaaaactgaagtgatgttgagatggctatgagctgacgataaatattacgcactttagtattgcagtaaataaggactaacaatggccagtacacctagcgcaaaaagggctggaatgaatcagcccaaaccaagtggaccaatggtgtagctctgacgttgtagccacgtcagatgcatgtcaagcgacggcgagttttagaacttctttcgacagctaatcaatggattattaggtaagaagaggcacggtgttgttttttgttttcctcgtggtttaaactttactgggtgtcactatctgatgtcaaatttctcggggggttatttacaaaaaacaatgcggtgggtgatttcgtcaaatgggcaatttaacaacgtgtttagggctgtgtcgttgcccgcaagtagggccattagcattatgcaatgctgtcacgggaaacggcggttttggcagcaagtgcaacaaacacatacccccccacccaaaaaaaaaaaaacaagtttgctgtgcaactaacggaggagggcctacagactaaacttgattctctgcatcatgcatgactgagagtcatagattgaggttgttagcaactgaacaaacgcagtgtgtagagcagacagacaaaattatgagagcaagtcaaacacggaggcttagaggaaaaaatgagcagcaaaaaaaaaagtcctgagggggctgcacaggtgtctgtcaacacaacacaaagggtattaaaaaattgtgatcgcgttgtcgtcggttgttcaggctagcacaatcagagcgcgccgatcagagcgcgagtgtgtctcctgcacataattcggcgaatgctactacccaccaatccaccacatgggtagactagaataaccacgtgtcacagtcacagctcaagacaaactgctgttaaagttgtttagatacgacacgatgcgtctgcctgcctttgaagtctgcgatgatccagacgtggcgctcgtgccgatcttgggatatccggaagcgcgggagcgcagc

SEQ ID NO: 5041 - DNA, 1002 bp, Zea mays
  misc_feature (1)..(100): optimal_loci_93986_G1, chr3:9332720..9333721, Cluster 30
agctaatgaaatcaatagtagtctaccaggtaatatttagaagatttattagcaggtttatttgaatccgctgatattgatttttggtcgctaacttttagtgttagcagactcattggattcttctacgtacgttacaacctcgaatttgttggtgtgctttggaggcttggacagtgtacacgtcatgaactctgtatagtttccaaattgtcgatccgggcccggcatatatgtgagagatcgatcttgtaaattatagccacagtgtctttggtgatttgtacgtagctggaattaagtagaagaattgttaaaatggtaagtactagttattaacttgccttgaaatgaactagctgacattgatttgtcctgggatcggaggagagacacagaaacctaaaagagttagcaaagacagaagttgctaggaagcttagtgatatacatacatacatgtacaccagtggcttgcgcgcgcggctggccttggcaattgccgtcatggattatttgcagtagtacctgtgtgccacattggtttgcatgtgacatacatgtaccccatgagaagacgacgatccgtgattaattagttgagcgcaggtggtcatcatcaagcagctgcgtcctgcgtgtcacatgcatgcatgggcccaccaggagtgtccgccgctgttgaacgttggttgcgtgcatcagcaattagcgtggcgccattatccatgattacctaggaaagatccaggccatttccagctttaatttcctttccccgccgcccaccccctttcgctttatttttcatcgccagctgcttgtgacccataaaacaattaatggagtctgatcctattttaagaccaggctaacatcgatcgatccttggtggccttttacaccaatccagggaacgtaccttcatacattctataagttataaaacattttagcttttatatatagtcattttacgtatcttttataaactactttgat

SEQ ID NO: 5042 - DNA, 1196 bp, Zea mays
  misc_feature (1)..(100): optimal_loci_94358_G1, chr3:11449779..11450974, Cluster 30
atatatatacggatccttggtcttggttggtacgtaccaacgacatggatgcgtatcgggcgacaatgatgaggagctacacacatgccatgcatgcccggccggccatcgtgcgcgcagagatagatctttgtcagctcatcttgtttttctacgcgcgcactcatcagttggtagcacagcaatagtagtaccgcgcgcgcggatgatgtgcacgcatcatcagaccgcctcttgcgagatgcatatatatcgaggaggtacggtgcgtgaggggcgaatgacgagggcggccatgggagtcatgtcatgatgaggcattgaggcgcgcgctcgctacaagctgcttgggcggcgggccggctggcctgcatctgcatgatagccagagccctgcctgaggcagaagcggaggtggaaggcacaggcactgttggctcagggtagtcgggggcgaaaacaggactatggacacctaggttgcccaaggcccatggcccatttttaactcttttaaaatattaaaaagatatataatttatctgtctcgttctaatattatttatatagagagtattctaaatcttgatctacgttatttatattactccattttaagtattcgtttttttgcgtgtgtgttagctatcctatctctagatttaaaataatcgatgaagaaaaataaaggtattgctttataatgttttttttatgttatctatctttacgtttcatcgccatgtaaattttgaactatatttttccagtgttgctttgtgttgtgacaagtcaaccctagttccaccattcatgttagcacgggcgagtccaggattttcatcttgggtattccagaaatctaaatagattgaaatttttttggacagcctaaatatattatttatcatctataatatatgataactttgcgatccttaatctggtaaaaaaatcatagccattttgtcacgtcacaattaaacaaaaacaaaaaatcatttagcatacctaggcgtgcccgttgtggattgacaacagtttgccagaagcaatatcggaaagaggttcgcgggaaatcgtggagaatagcgttgggtgcagccaggtatcgaactatcgatgtggacagagtgtggcccgaacgatgaaggaagaaagacctgtaaaataagaaatcagtctgttttctcttt

SEQ ID NO: 5043 - DNA, 1271 bp, Zea mays
  misc_feature (1)..(100): optimal_loci_96196_G1, chr3:21677509..21678779, Cluster 30
attaatggcttgatatctgatagagtgaccattgagttttttgtgtatagagagtcacctatggctataggcccctcttcccaagattgatcgacttgagctcaatgacgagtgggtccaagatctatgtgtttaactttataatggagcataacatgttggagtgctatctcttgctggtgatggtgctgatgaatctagatgttggtttgatttttttcttgaacttttaatatgtacatatatgtagtataatacctaggtgtttcgattttgatttggactcttcattgataaaatatcgggtgatgaagaccaatatgttagtctcaggtggttaggtttccttgttttcaattttcatttaatttgggtcttgaaatcttgattcctcgatgggggaggcaacatatggaatatggacttgagttgaatctttgttttttgacatattccatatgataacctgatagttgtgtttctgtaagacagtttggttgagacccttgtaaggacaaagagtgcaatacgagcaacgggcgataacaaaatccgcgagcaaaacatggacgaatatggtaggccaaacacaaactggcatattttttgcctatttaatattaagttgtataaggagaaaaagacaatatattcttagcataaggagaacaacaaaagaggaccctatcgtcagtcaaaccatagataaagaatacgttgtccacataaagcatttttctttgcaacaattgagtgttttgagataaaaaaactactcattttcccacttacatctaaaatagaatggtctcatcaaatctctcgctctctagcttattttcttgccttcattctccgctcgcacagattgaatggtgacaagctgcacgccctcatcacctccccttctcgcacaactttagtgactccccgaccatcatcaaccatagcttgacattaaaatccatcatatgtgccttctccatctttagccgagctccccatttgccaccgcctctctctctctctctcggctttgacgatagcccactaccttcgatattacctaaggacgtcatcacactaaccctgtggagcttgctatgctatcgccatgatcctcgtcccttgcccgtgtccaattgtttccccctactacccaattggcaatgccactattgccttgcaccatgtcttaggtgaccctagagtatagatgcacatatgggtcacctggtagggcacatgcccactaaagtacgacacagatt

SEQ ID NO: 5044 - DNA, 1180 bp, Zea mays
  misc_feature (1)..(100): optimal_loci_96614_G1, chr3:23686416..23687595, Cluster 30
tatccagaggcttcataaactcccgttcttttcatatagagctactctacggtgaagtttatagaaaagagtttgtggaccagtactaaacatccttttaatctaaagatatttatttgacatcgtaaatattgatatttttatgtataattagccgaacttaaaaactaaatcatgagatgtactagaattacattctttttaggacgatggagggagcatgcactatatcccatcaaaatgatgggagagagcgaataattttagcattgatgtctacgaattaatttccttatatttcaatatcatacttttatggatggggaaagacagaagggaaaaaaaattccggcatatagttgattccaacttgaagaatagcttgacaagactcatggtgctttcaagctcactgtgctagtagacttcctcttaaaggttgtgggacatggcttctgaaagaggatgaagggaaataaaagtgtgaatgtgtgatcagccgatgaaaaagagagaacctgattggagagtatgataagttgaggtggactccgagcctttaaattaccctctttattttttttaatctaaaatttgtgggtgaatagtaacgtacctctataggtacttcaagcaatttgtttatagctaggtaaggactagctagtttgtaaacttaaatcattttggtgattagaggggattgaaatggaaatgagaggatttgagtttccaaactggctctaaagatgttgccctatgttggattattcatgacatcatcaaattaacatataggttgtaatgagaaccaccttgacttaaggtataatatttctcaactaaatgcatgttgaagacacaaatgctatttagagggtgggaactacgaatatgaatggaaaattatagagcaagtagtagtaactgtatcacaatcaaatatagattattatagggtacgtacgtatatatctttgtgttgtgtgctagaaaataaaaaagtacatgttattaattttaggtattacataaaagccctgttagaataatacatctctgattataataattagaaccaaattttgatatttttttattgcagcagagccagagccagcgggtgagtgggctccgatccgtggtcgctgttgcgttcggaggcagtcaataatcggcg

SEQ ID NO: 5045 - DNA, 1087 bp, Zea mays
  misc_feature (1)..(100): optimal_loci_99888_G1, chr3:43362827..43363913, Cluster 30
tgccgatcgtctttttcagagggcatggacgcatacgagggcgtacgtacaatggggaataaatcccctcctcctggctcgatctctgccttcatcacgccctgctgcctgtgcctgctttaccgagctagcaagcaagccgcctctttcacgtcgacacttggacggtgacggtcaactctaatgacatcaaccagttcctgcatgcactagctgcttgctgcttccctttattattggttagttccctgtcaccgttcaccagcagccaaagccaaagcatgcacctctccggacggttggtgctggttaccaaaaataaacgcccggaccccggaccaaaaaaggtcccgtgcatgcataattgcatatacatatgacatatccatgagggcaatgtactacgtactcactccattttaatggtgggttaattattattctagctcttttggagacaacaacaaatggtctcaaatctaaccaaaactataaacagagcaagaaaggtttataccacccagatacgtatactcgctccgtcttaaagtagttgtcgttgtggtgtatacgccacgatcgaagtttatcgaatttgacttgagttttagaaatgttagaaatatgtttatctttaaataatactagttatatatatattacaaatactaatattttttttctatataattggtcagagttgaaaaaatagttggctcctcaaaaacagtcgaatggttcagtatttaaacataatgtttttttagagtcactttgtcttatatgaaaccaatccaaacaacaataacttcgtcctaccatactcgagaaaacaaacgtcacctagtattgtgttcccttccgcctagtagttgtagtgtttatgtactcctagttatataacgttacagtaccccagaccggcggatttcagttttcatcctcgatgtaatctccttctacacaattaggaaaaaaaaactctcaggacacgcgtttggaagcaaggaggtaattagaaagtgattttagccccctctctaaatacacttgctctaagctagctgcaccctactcaacccaggcg

SEQ ID NO: 5046 - DNA, 1459 bp, Zea mays
  misc_feature (1)..(100): optimal_loci_137489_G1, chr4:29898267..29899725, Cluster 31
acagaaggatctatttagcagcaataattgacagtatctggagacctgcaggtctccttgatgccatctctttgctcgcatcctcctccacggccctctctcgaagatctggccgctgtcagtactcagtagtgctgcccaagatcacctccttggtcgatcgatgctgcggcaccaaaaccagacggtcaacgatgaatgaatggatgaatggagagggaccaccgctgctgggccgtgggccacatacggcctccatgtttcatctgacctgacctgacctgacctgacctgacctgatacgctctgagcccagatataacgcatggcttggcttctattgcaaggtaggagtagcttctccagtcacctacctgtctgacctttggcaacagaagcagcttgcaatacaagcctcttggcactactctcgctcggcacgcgcgctccccctgcatcatcaccatcaccagatggccggatcttcccggccggcgacggacgccagcgccacgatgtgagtgcaagccctcgctctcgatctgcttgctgcattgcattgatcatctgccaggcagaccgccggccttggcgcacgttgctgattgattttgcatactgatgtatagatctcggcctacatcagcatatttagaaccttgacacaacatcttctggtttaaccgtacctctcttttaattttcccccctcgctccgtttcgtttttttaggttctatatataatatctgtttagccactatatatatgcaactttctacctattattaatttcgccacttctaatatttagttttcgaacaaatgtgcattttataatctttcggaatataataccaaaggccggccgtatatgtatatgtatatgcatgcatgtgtgtagcaacagtgcacacggtgctccttttaattcatgttaattaataaaagcaagttgcctctgatgcatgttaaataaagcaagttgctacacacagtgtggtcttagtctgttagagtaggtcataactttatgaggggtcatatttaccaccagaaggtgattgtggatattgcaattattgtcatttcaagcacatggtatatatgctatgcatgtgttcacctccaattaaatatggtaaatgtttcatcaggttgtccgtacacaactagatgccaaattcttattgatgatctccataattagttaattgacattcatacatggtttgaggttattcaaaatatatatactttcctatgttctataataaataagttcatgaaaactttcggatagactaaggacgttgccccccaaaaaaacatggatcagtgtactttttactttacatgaggatatctcttcaacttggtatttaattaagccctctttggtagggctcctttaacgacttctttaaaaaaatctactaaaatggacgctctttgatggg

SEQ ID NO: 5047 - DNA, 1402 bp, Zea mays
  misc_feature (1)..(100): optimal_loci_107176_G1, chr3:91450971..91452372, Cluster 31
gggaagaaaacacctgagaaggaagcatcaataaactctacaacgttagtgttgatttcatagtaatgcagtgtcttactctcactatgagtttaatataatgaaatttattattaatattttttttggcaaatcacagtttatgaagatgaagtaagaactgatcaatttgaaaaaaaagatcgaagcaattcaaaaacaactaatagtgttcatatataagctaaggtgtgccctccagagcccctcttcagcaacagttcgatcgaacaacgaactaaagaccataataggccatgcaactagaactaaatattgatgtttttagttgtggttgtccaaaatcaattgaggatctggtgctgttactagttctcaacaagcactaaggctctttctacagcagtacaaatctgagtctatagcatcgaaggacccttggtttttgaaaaggtagtctgccatacatgttttttttctttgagcttttgaaagctcagttacatgcatgtacatctcgtgcatctctatctcttgtgtgcaaatcaaattgttggttaaagattgtatagtttaaaaatctcttgatatatgtgtgtgatgtacagttgatcattaaaggaaaaaaatcactacaccagctgcgctcatgggttggattttggggtgggcagctagctataggagaacaaaatgatggaaactgaaaaatgtgcacagagatcgctacaaatcgcagcgacggcgacacacaactctctgctggcgaggcggcagggcattatgatattataattataattacagcaagtggctggctggcgcctgagactgacagcaacgtgtgccgacccttgcgatatcgatagatgcagcctctgctgcttccttctagaagctaatgaaaccctgcagcatgcaatcatgcacgtgtatatattgtattgtatacgtatacactaggagtgtacagaccggccaagacatacacttgtctagtacgtctgtacgtgtacgtaccaccgatcgcgatggtgacaagtgtgtgtgtgtgactgacaggtgtagagtctccgagttggggaagaaactgcctaggaagcagcatgcgttgtccgtgacaaaaaagatgctgtcatcgagtcgcggtcaaccggccgggcctattaacgaagcagctactcctgggagcgcagagatgaaagggagaggtagaggcgccgtgctcagtcaatccctgtcactgtaccgtgtaccccacgtgtggcatagaagtgggttggcagcgaaatctaggacccaagggtttagctctaaactccctatatatttctctatcttaaatatagagaatattttttctatatacctttcaacggtattctttaaagtctcttttaaa

SEQ ID NO: 5048 - DNA, 2597 bp, Zea mays
  misc_feature (1)..(100): optimal_loci_1197_G1, chr1:6066921..6069517, Cluster 31
gtataaaatgtctatcatcccatgggatttcattttatacctacactaaacatatgggcatggcaaagcatacatatactatgtcaaatattaaaaaaataaattgtgaaaagtaaccacgactaagaaaaatataagttttgtccaaaagaggttgcaaaaacagtataactggggaacatcaagacactttaccagatcaatgcaaagtttacacaccttgtccaagatttagtatagcagaagtgataaagatactcaaaaccttcttgaaaacagcataatcaaaaatactggctagtgaacctccgtcccaagcgagaattatcataacctacatgaaacaatcaaaattaaattaaaaacctcaaataacagattagctatacaacatccagctaagatgttaagtaccttcctgtagagtgtttattaaaaaatgcactgaacccttcaaacgtccaaaataatgcagcaaatgcttattgcagaagaaggtaaatataaataaatacctgaagagctaaaataaagaagctccagagtctgtcaaaacttctgaatatgtgccaaaatgagcgtagctcaacgaagttgacctttcccttctgtttgctgatccttgtgctctgaacagctcattacattagatgttgctagcccaacaaaaacacgaagataccatgatgatatatggtaaaatcctaagctaaaaaacataatccaactcacttcatttctttcatcaggctgacaaaagaagtcagcatcagctcgcataggccaaccaagccgaaagcagtcagcagacctgcaatttaacaatataaaatctaaagagcaaacaaataaactaagaaaaaactagtaccagaagtactcattaagatcatcatagtttctccactcagaatgattccctttctctcttttgctcctttcagcttcctgaaaagttgtagtgaaaaactgaagttcagcaccagaagaagaataaagctcaaccgacacaactgaataacagtcaagagctgagagcaaaccacctttgctatggtatggtaaatcggtgtaacaactttcttcagaaaggcttctttctcaccaccataggccggcttcacatattcacccgtcaaggcactgacatttccagctaacataccatacatttcaaatgccatctatgacaataaccagaactgtcaggaccatcttcgttacgcttttaacatccaagacaagtacttgcaaaacaaatgtatgactcatgcatttttcttaagaacaaatctgtagccttcttaattcacctattgaactctgagagcattccatggatacaatattaatttttcgcataaaacttgatagggtccattatatatgtccgtaatagagcgtatagtcacagtagattgtgctaaaattttaatattagctacctttaaaatgtcgtatttaccaaattagttacatgaatgaactcatccagttgatgccgctcgagtgttcaaaatttaactattcatccttaagaacatttcttaagtattgatcttaatatgcttatttatttaagaaagaaaaaatgaattaatgtaagggagttcatgtgttgtttagatcgtacatgatgatatatgtagcaaatgcactctggcataaaacgcaagtttgcagcttcaccccaaatgagaaggtacaagcccatatacagtaattttcgttgttgcatctcctgctgaattgttggcaacctattatcaagacagaacaaagaataaacaatgagaagggataaagcaatctactagaacaggtttcacttccttttttaaagatggtactactttggttttaaacttcagtattgggtatcagtgcttaattttcctacttgttacagtaagaaaatgagagacgaaaacaactaatggctataccccctgggttcaactgatttggaatactcactacagatggggacggattcctcataactcaagtgaaaaggttccttctggtggaaggacaccagcaggctggtcaatgattatagagggattgccatgccaattgcaggggacgaaagaaccttcctccttttgtcagatgtttggaataatacccacctggcaactgagtttccaaggcttttctcttatgccagaaatcgaaactgcactcttcagcagtatctggcaagcactgatgttcaggaaatgttccacacaccgctttcggttgaagcagttgaagaatataatttgtttcagagcaaaattcactctcttgtaagcgggatgcacggaaatgattcatggctggttgggggtggctcttttgaaactgagaaagtctacagacggaattttcaatgcatttgcccccacccacccacccacccccccctcctttcaaatggatatggaaatccaagatgtgcaagaatgatcaaaattttcatttggttatttttcatggatagacttaattctagaaatatgcttaaaagaagaaatttcccggtggagggaggtgactactgctgtgtcatgtgccgcttgtggtgtgaagagacaacttagcactcg

SEQ ID NO: 5049 - DNA, 1478 bp, Zea mays
  misc_feature (1)..(100): optimal_loci_120131_G1, chr3:174701574..174703051, Cluster 31
tatgtaagaaatagatggacaatctactaatcttataccatagaggcagtacgaacataaatgagtgaaataatgttttcgttatcagaatgcaaagtgagtatgtgtttagtgattgatcattgtttaatgagttggttactacaactagagagaagatatattatgatgtaaatgaggatggtatcttagttaaggggatactttacgtgggtttgaaagacttgattataagccaggtgacctcaattacctctaaggatcaacggaagaattaagtgaaatcggcaatgaggactcatttctaatgtttgaacatggttgtacgtaatgtgttcaatgatcccactcctcataggtattcaccaaaacaaggtaatcaaggaccctatgacccttcattacctgaccataaaatataccacatgcaaaaaatcaattagaatatgttatgctacttgtcaccatcgtcgtccttgttcaaatcctttactacaatctggttcatgttgctagacacatcttcctccatctcattttatttcaattctaggattcaaccttaaaatgatcaatagcctcacatatctagacatcattctctgcttgttgtagtttttgtgtgtagtactctgctcaactagatcaacaagctcacgaagtctataattgcccatctcatcctcgccaccacatgggtttccacaatccgagacaagtagtgtgagtagcattctctttctttcacttatacctttcatcttttaaacttgacatgttctaccttagcggcacactcatcgtgttgttctttccatgctaggagaaatacaataaattagacacatacatgaaaataaaaataggataacataataattatatagtccaagcactcactaggtaatccaataacaaggtcctttatgaactgcatttgaacttttttcaccttgtcctcttctcctccgccttttgcttggcagcccacttccttttcatctcctgaacataccacccatttgtattttagccaaagagatttagattcatatacccactcatcaaaattacacttccaatatccatgttgcaaacaacaacaaattattaattttaatcaaacaaatacaaggtttaagagaaacaaagatgtagttacttcattcttgtcacgacactcaaactcaagcaaacccctaagtggaaagacaaataaatatctacaatcacatgaaggagggttctcaagtcatttattgacaactttctcctcatttatcattagtagaggattgtggggggaggtggaacctaccactagaagtgctcatatggttctctctctctctctccattggtggttgaaaggaggtaccttaggataaacttataagatcattgatccaactaaagaaaacacatcttatggtccaaaacaaattgaccccaccaacttatatatactaataatctat

SEQ ID NO: 5050 - DNA, 1553 bp, Zea mays
  misc_feature (1)..(100): optimal_loci_127733_G1, chr3:214192517..214194069, Cluster 31
tgttggccgagttacatggatatggaatcagttgtcctttaagggacgctatagaatacacaacctatgatcaagactttagtcatctgtcacccatgaatgggacttcaattgagtgaccgagtctggggactaagtgatctggtgcccatggattggtctttctatcagagaactgagttttaggaactcataaattcgatgcccatggatgggtctttcattgtgcatgcgacaacagagccatagaggtgatattgcatccacccttaagggaccttaatccatccagactcggtatctaggtaccattttaacaaggatgatcaaatcccctcaatatccttggagtgacaatcgagtgggataaagtaagggctgagaaattcctttgatacttgttatgcacgagcaatagtagagccatggaggtgatactacaccagggactcggtgatctagttcccacgaatgagtctttctgttagagaaccaagttttgggaactcaaaaaattgatgcccatagatgggtctttcaatgtgtagatgaccgctgagtcatagaggtaatattgcatcctcctctgaggggccttaatctgtctagactcagtgtccaagtaccattttagtgggatcaaatcccctcaatacccttggagtgacgaccgagtgggatgaaatgagggctgagaaattccatcgagacttattatgcatgagcgacaacaaagtcgtagaggtgatattgcatccttcatctgagggaccctaactctaccatagaaaataagtgatattttctgtgatgaactttcgacggaggtctaccaccgaaaatctgttattttcagcgggagacatttactttcaatagttttgagctactgaaagtttgcaaatttcctatagcgattgtatttgtgtttctaatgtctcaaagaacacatctatcaaaaggtacattgtttataataagcctaggttgatattgatttattgaaagtgttatgtgtgagtaactaggtaaaccttggtctatatgattcaaaagaaggatgtgtttgggatccaacctaccaagttatggagaagatgttgatatgtatcttgagtacttgggttttccttttcgaacttgtactcagcctcctcatttctcattcttgaaggctcctcatgcacaggggggtgaacctctccttatgtaacccctagcaagggccagttaggaatgatcttgattgtctcctcggccttccttgatactccccttgcttgtaacccgctcctccttcctcatccttgcttgatagatgatcaaagtgtcagggtagtggaagcaagaaatagagaggagagagtgagtgaaaaagagaaaggagaataagagagagaggggagatatagcctcatggcagcctttgggtcatggagagttactagatatgacttacaagtaggggcaatggtgattacagtttgacatctcaaaatccatgtatggttgtgtatcaacgaattgtcgatcgtgcggtgatggagtatctg

SEQ ID NO: 5051 - DNA, 2532 bp, Zea mays
  misc_feature (1)..(100): optimal_loci_127734_G1, chr3:214194103..214196634, Cluster 31
tatatcctagaacatacaattttgccatacaagtttcaaaatgtaaattttatgcaaactatgatcatgtgcatgctaaaccatgatcatgttgtgtaggctaaactttaaaccgctaacacattaacaccacattagtgcaaaatcatcttcagatagtgcagttgggcaggggtgttactttgcatggttttatagtgcaaattgcaatgactttgctctttcttctttctttttctcgataaaacaataaaggctttgtttggctaagttctagctcggtctatgaagtaaaggacgaactctgccaagccaggctccctgccattgaaattatacaatttgggaaaagttcaaattattgtgaaaaaaattacgatccttgcacataggatggaatcttgtacctgagggtccacatgacattgaggattctgctcaatgtcgtcctagaacatgcatttggatagtaacatgtgcaaccttgtgactcttgtcaaacaatatttcgagtgtagctgctaaaaatctgtaacttctagtattatcttatggctccaattaatcgtgcatgttcctcaatcatttgctcgttgtattacatttttatcaactgacttgcaagcgtgtcatggttatcccattatgtttagtgttaaggataaagcgaattaaaaaatgtgctaaactaaactagggatagaactaatcgtttatagttcagataaaacttccaaaatattatttcctttgggttgaaggtcctcatctttaatgctggattgcagggatcatatggtcatgcaatactagtgatcaggtaggatatatatatatattatatgtttattaccaaactcagattaatgagcaaagcatcatgtaatacttgacttgagccgtttatgtttctttattatgcatggaagttggaaggttgaattgttttcttcaaatgtttgatgtctcaggaaagcacttgcaagtttctctatatggatttgagaagcactaatgaagtgacatttcaatttatttgtgctatgatgattaattcatatcacaatagttggaacttacataaaaacttaaaaggaaaacaatagttgttattttgaaatgcatggtggttcctttatcttttaggtgtatttaatggaatttattgatttgacgtactaaattatgtgtgtttggtcaattcttgatatttgatactgatataccaacaaaacataccccctctgcccaaaaaaatatagtgttctaggattgtcctaagtctaacatctaaagtttgtcaaaaatttatacataaaagtatcaacacttaggacaccaattggacaccaattgatggtacaagttttttaatatcaattggtcaaacttacaatggtttattttagaaaaatactagaacatcaagtttgagggagcgagtacttttgaagtgataggtagattaatgaggtgtatctatgttattatcaacccctgtttccaaatacttgatacttttcaccactttttgattacaaatatttcacactagcccactataaaagtactatgtaggtattctagataattttatgagggcatttcagtcattggtcaaagtatcaagtatttggaaactaaggctggtattttttttacgtttgtacaataatcctctctagaaaggaaactactaaaatcaaaaaccttctaaccaacaaggccttctttaacccataaagggcaaaatctttgttgggatggagtgaaaacatatctaatcatgctactcctttgtatcgtgattagtactttagggcaacattcctttgtgtgtagtatgtattgtatgtatgctatatataaaagagactcctgagttggttgcatccattctttgcatatggaattgttagtttttatttgttcgctatctgtaattttcttctagtgatgacatatgtattattgtacgatatactcaaaaacatgattagtaaggatttgactgctagacactttagctttctccatgatttgatggatgcatatagtttggatgatggtccagaggtcgcaaactctattttactacactaggcttgttggctagagagtgttaaagatagaaggttatatgaaatgtgaaagaatcatgcacccttattttgttggtcttagggttacgcccgctaatcttagaagttacctaacatttaaaaggcttgggccacgttctctaatatcggcaatgttgttagccgacatataaatcattttcatgtacatctctatatatttgtgtatggtcataagagatcctcgtcttgcaccactttgacatggtatatgaaagtaccttttaaggtactaagaaccttggatgtcacctagacgggttaggtgaatatgtgttaataaaaactttaactcgattgaattttcttacttaacttagagagtcaattgcagcaaaataatgtccttattcaaatgatacctgcacttcacaaacacttttaacaaata

SEQ ID NO: 5052 - DNA, 1452 bp, Zea mays
  misc_feature (1)..(100): optimal_loci_127989_G1, chr3:215044614..215046065, Cluster 31
agaagtccaagactataaaatatacatttcatgataataataaacggaagggaattgttcacccaagcagcatgtgcttctcatctcctcgacgcatcgccaccatttttcaaggggtttttaaggtaagcatcatactgtcctgatgtgatctcttaaggtagtatggtgttatcaccttacaagatcttcaatctatttttgttgagctttatgtcattagattgattttacatgaccaaatgtgtatctctcagtcggttgcgagactccatgacatatggctacaacatgtgtatgcggcaactcagaagtatgatacacatctagcactctacgttacatactttagtcgcttatttattctagatggatttctttggaaagtttggtgcaaacctagtcacctcaagagcgtactggaaaatatttagtgcaccaaaatttaagattcaaagcaaaatgataggagatggcattagaccagactaaacagatctcactgatttgtcagttccactgcctcaaacatgctttagtcgcttatttattctagatggactccattaaaaaatttggtgcaaccctagtcagcttaagagcacactagaaaatatttagtgcaacaaaaattaagatgcaaagaaaaaatatagaaggatatgacattagcccggactaaattggtctcgccggtttgtcagttccactgcctcaaatcggctaggtcggtttcactgctgttacccgtcgacaactatgctagacctaaggaaaccagtcagcctgattttcctatcttttttaactaacttggtttccaaattgatttcggatctattttgaacgtgcaaatttttgaaaaatgtgttttggacttgtttttttttggataagaccaccttcctctatataaatgagaagattgttgccgattgagtattccaactttcaatcctaaaaaaacacaatacatatctcttttgccggcctaactctctctatattattgtttgtcatgtcttctagcaagatttgatggtgttcttcatggctttatcgatcttagaacaacctagatgtgctccttcccaatgggttttctcaccagttattcgatagtctactaagtgaagaacatgttcaaaatcagtctaaccaacttcttgttggttttgtcgattcaccgagattgtttacaaccgtaggtgtgctcgcttttattgacttgtgacctaaatccgtatgcaaggaaataaaagagcatataaaagataggatgaacccagttaaagcctgttattgtacaacttagctacagattgtttacatatcttatctaatagccaagaccatggctcaaccattaataatatgggttaattagaatatgtcactccaattttaagaagttagaaactagtttcatttccataccgcttcatgatggca

SEQ ID NO: 5053 - DNA, 1544 bp, Zea mays
  misc_feature (1)..(100): optimal_loci_131632_G1, chr4:2065875..2067418, Cluster 31
tgctatgaatggaaaaatatctaacatatcttttcgtagagctattgtcggggtgaaactggttgtgtggaataatttattatatccaatggcaactgctcatttaggttaatcgagagacaaatttatttaggggcacatagagatggactcttctcagatcgctcaatataaattggtcaacttgtcccaaactattcaaaaccggatatcaatctagcatgccaatacatcacaaatagcatgcgaagatgttacgctttacaatggtcgaacctatataaattgtcgtcttgtgtttactattgagtttagattaatgtcgatgctcaccaatctctacgtactccccttaagcctgcaatatatagacgacgttgacagtcatcagacaccaccaatagtatggttctgacaatagtatttacgcgcatcacgtgatcctcatcgtcagaaatgctgaatcttgcttcaatataatggcagaggcatctattttaaattaaatacaaaacacaatcttcagcactgaacaaacgacgacgcgggaatgtgtttttttcttctttgtttgctccgcatttattaacgttaacgttgtgggttccagaatcgatggtgttaatgcagccacagttctcgtacatactgcgacactgcaaggtttgtccgtggttcgtagttcatcctgtcaaatcaaaatcacatctcatgactgagcctgtcgaatctggagaaaaccgcatttctcgcagcaagcaacaattaatcatgatacctactgttgtatagcatgcacctcgattcatatcaaggttactattagcttggaatatatgattaatgcaaagcaatgcaagcggatcggagagcatataggagagaccacaccacagccccatatgatggatgtctatcgttgttaactagaggcgtgtccaaatcaaatcaccgtggcatcttcattaatttgcaagggacagagacctgctgttgcaaatatattgacacgcaatcagatgcgacagtcgtctgaatatatagctatccttatatatgtggatattctcccaagttggtgccatgtcatttttgtatcatgcatgtccctggctggctgcatcgcctctcatgtgctgccaggaaaatgacctgataatcatgtatttaatctggacgcgttattatacagctagcgtgtagtacttatgatggaccatgtaagtgtaagcacagcagccatacagaaatcgctgcacatttcaactaaagcccaattaaaccctggccgccaacaattttgtcagtgtatttgtttgaagttgtgtgtgttagtgtattttttttataaatttcataaaaactagacaagtttaacacaagacagctaaaaactcgcaatttttatgtagttagcaaggttgtctgatcaaacaactaggctggatgggctgatgtagtgggctgctgctgtcactcgctgcatgggccttttctgaatttggccaccgtccacagaaacggccaaaaaaagcttacctttt

SEQ ID NO: 5054 - DNA, 1505 bp, Zea mays
  misc_feature (1)..(100): optimal_loci_133658_G1, chr4:10641655..10643159, Cluster 31
agaaccatttcctttctcttttagcagcagcaaaggtgccatatggcaaggacacttggtcgcacaccaccaccacaaagctgccggccagaccaagctccatgctcttgtctccgtccatgcatgtgcgtagcagcagcatctgccgcagcagaagaccaaggcttattcaaattgttaatcactttcacccatgaattaagcgatagtgcggttggatactctcggcactgcctttttgcttacttgatcaccactctggttcttaatccagttgtcggatgttgggtgttaagagtcatcgaccctaggccaacatatgcatgtagtatgctcatacactaatactctagctacgtactatagctgtcttctcttcttggggtttattagccaggttgttaggggtcattacagccttacaggtaggcgttgccttcgtcacaagctacagatcatcatactatagtagatttcctgaaagattctggcgttgaaatcgggactcgtcatctcactagctcttgagtcttgactgagtcgaggatgctgatgtgagcggttagcaaatgtttgaactttggtactgacaacgctgcagctgtgttagcttatctcaggacagctatatatgatgtgaaggatttcttttgattgtcacttctttttctatcttatttcttgtttaaatggccaataatttcggctcaaggcaacattgaatggtgcaacgtctattatatttgatatgatgttcatttgatatcaaagcaaggtatggccatatgggcatacaagcacttgcaagaacatctgatcgaccatgtccactaatctccttatcaaccattcagcttattttttattaaaaaaaatattagcctgatccatgtttctataatagaattctcttggttatttcttttttccttttttttaaaaaaataataataatggagctgcatgctgtcttcgactgaaaagccttggcagagtctattttaatatccacgaacggctagtgtaactaacttgacagagcagccagtcatccacttgcaagtactacttgaagccacacatcaacgccagcgggcagatcatgagatggccacagctgcgcacccgtcaggacaatctgctgcagttctcccacatccgtgctgttcaaattgagttcttctgatgactgacgaacaaacaacaaaataaaaaacaccagtttctaaatgctgcaattatgtgggggcatacgtacgtgttcacctcgtcgtccactagaagcgctgggatcgtatcgacaacttgatcacgagttcacaactatttcagtgcatacatacatagatatccttgctgctgcaatctggagcaggatgggacctaaacagaggtgcctggggttcatcgtggccctgtaccaggagaccaaggagcaccaagaataaaagtggtcgctgtcctggcctaacactgcatccccctcatcatgcacatgatatgag

SEQ ID NO: 5055 - DNA, 2160 bp, Zea mays
  misc_feature (1)..(100): optimal_loci_134374_G1, chr4:14027375..14029534, Cluster 31
aaagagtatttaaatggatctattggagctatttttatcacctaaaccccttacataagaatatagagaaaacttgaccttcagggggtaagacagccaacagactatagtccttccatgaggagtcaaactcaatacctcgggtgtgctattcagacaacataactaactcagcagagcccctttcgctgttctacattcttatagaaacataatatttgtttgatgaattaaaatcacttcatgaaaccctttcactatctcactagattcttaaaactaaataaaaaccaaggataaatcatattttgtttgtttctttggactagtgaaaaaaattggttttaagttgttcttcgtcaaatgtttcccaatgaagtgtttggcagtaattctactgattctactaatagtctaaaacatcgtttgttgccaaatacacccttaaaataacatatatgcattcatttgaacacattatatatatcaacttcaatggtgtctttcccagggaatttagaggcctagactaaaactaattctaaatggggtagtcctaactaagtaccaaactaaagcaacaataacgtaaactataatgtgttacatagaaaaaacattatagactaacaaaacacaaataattgattagaactagacatcaattacatgtcgtcttgatgtacccaccgttcacggaagccaacaagtatcaagcagaaaccattgatcatgatgttagattatgtattagttagacttagctttggtcatttagacttgatacttgacacatgttgagaacctattgtagttttaaaagaacaacaagatggcaacaataacgaactctatggtgctagactaaaaactatgtagcttgggtgagcctgcctcatgtctggtgcacacatctagttaatgaacttgctcctatgcagactgatggcaaaaatctaaatcaaagctttggtcacattgtggtgattccttatccaaaacaatatatttaccggtcaaacacctcaaccttgatgagggtaagatgtctagaacaatttgtgtgacaacaagatgtgagaaatcaggggaaaaggatgttagatttaattcactagttagtggttcctttgccaacgtctataacccttctgattgtgtgcaacttgatatagctaacaactctataagtagggagatatttcaaaattttattcctaatgacgattcattggtataggatgttgatgctccagtggttgtatgatctgatgagcagcacccaaaatacactcgactgtctaaaaccaatgaagtagaagggaatgagtctgataggttgggcttggggatgaggaaactaccatacatcgatgtcactatagagagacagaatttgatgccaacacatatgttggaaaatagctctgaatctaatagcattgcgcatcaaacttgtgctttggagaccctagccaacaaagtaaaattgccttcatctatgagggctgagagacctgcaacaccaatatgtctggatgtaggatagaactcatagatttgttgttctggttttgacatctataatcattttccttgtttacaaatagatacatcttgttgtaacaaggatgagaaatttgtggtgcagggtgagcaagtgggtaagataggaacgagtgaggaactaaagctagatatgtctcctcattctgcccagaacaaaagtaatcctaaaggtgtgcttaaatatgctcctcttcatgtatataattcattagatgcacttcgtcgtagcctacggtgcaatgtaccaatgactaatggatcctccatagcatatatggattcacttgagaaggcaatgaatcttgctactgctcgcaatttttatgtgaatggaggatctagttttgttgttgggcacaagcagtattatacatctccatgcctaagacctcaagcaacaggtaatgctcaatctctaggccattttacaatagataggttatcaagtcataacatcattacgatcctatctaagatagggattaaaataggtggaaataggctaggggttgaagaggtatttgaaacattaagacaagcggaaaaagatagggaaagggaaatatataatccaaacgataattcccttct

SEQ ID NO: 5056 - DNA, 1769 bp, Zea mays
  misc_feature (1)..(100): optimal_loci_134885_G1, chr4:16309854..16311622, Cluster 31
ctagggtttcatgaacaacttgtattgttcacatatccaatgcggtgtctagtgattgcccacgcatgtcagatgcttagataaattgtgttttgtcctatattgtgtggttttggtttgtcatgctttctattcaatctcccacttgctcaaccatatgccaccatttctctctgatgtgctcaccctcactccatcattcctatatctcatctctggccaccatgcactagtccccaagtttgtgcgctcgctttttgctgcttgtccacacccttttgtagcacctctatgccactgccagtgcctaagctcatagtgcctactcactattacatccacacttatgctctaccattcatcattggccacttgaccacccgtttatgcatctatgccacaccgtgcaccatcgcttcttcgtcgtcctgtgctggcacaaccaatacccacatgcccacactgccctacaactccctgttgtccaacaaccatatccttgttctgtgcaaaaaccctaaaccttttactacatagagtttttccctccaagctcctatgcatctacactatgcaaatctcacattccactaagttcctcaaggtagatcctaacttcactctttcatactttttcataggttcctaattctgctagggtttgtgtctatccagacctcactacacatttcctacctcattttgagccttaattccaccaagttcatatttttacttcatctctctatatttgatcatagtgtccccctatcgaggtgatttctagtgtttgactattattaatcttaattcctcatttttgatgctcactctcatttgtcactacttctagttggtgatttagtctgcatgacatgcatcctttgcttttgcattttgctagttgtgttaaaggtaggaaattcactcatgtctcctttattatctcatattgctttgctccaaataggaatttcttttcactagaatatattgcttatgtatacccttttgccactctcatcaagcgtgttaaggattgttgaacttggggccaatcccgcaagtatggaccaaggccaagcctcgagtggttttgtatgatagggggaatttagtatcattagatagtttagagtgtcaattgttagtgcaatgggtctatgtggtttgttagcttagtcattacaattagtcagtcatattggtagtatgactaggaccaagagattcaaactatcttatttaggtgaggacaacaataaggagctatcatgacctccttgcctcgataagagcaaggctatattttgcgaacaacaacacaagaagaacaatgactcattcgtgattagtagaaggcaatcactataacagccaccataaagcaagctgatatgcatgggagtggtggtcccatatgaatagattcagatgcacctcccacctaagcaccaccaatagttgctataccacttcaaccattgacatgctcccatgttcccgtttacccttcatagggataacctcaggcacaacagaggactatttcaccaccgccaccacaacctatccatgggagaaactagtttgagggtagagcaggtctaggacaacccatgattattggaccttcatagagccacaaccagttgagtttgtcactttaggcatgtttccatttcctagtggcttctatagtagagagaccatagttagagttcttttttactactactatgtaggagtcatcttatagagcttaatta

SEQ ID NO: 5057 - DNA, 1426 bp, Zea mays
  misc_feature (1)..(100): optimal_loci_135845_G1, chr4:21325508..21326933, Cluster 31
tcgatgaacaagaatgtgagacggttacagttgcagggaccgctctgcttgtatcaaccacaaaaggaagccgaagaaaaaaaatacagcaattacggacattcctcagccacacttccagcgtgacagaaggggaaaaaggagaaaatgcgaaagatgttgtaaatacgacatagggcacaatgcggcaacatgtgaaaaatcacagcagaacattgtcattgtcaaaagaccaagagggaggccaaaaggcactgacagtgccaaaaatgttgagaatgaaaatgcacataaccaaacagaagattgcacatcggctgatgacgacaagcttacatttttagaattaaatagatagagaaatgaaaaatatttaacctgtaacagttaataaattctcacttcttatgactgaatctaagtaatgctgcttgggtgaatcagctgaggtggtaaacatgtatgactgaatgcctgaatctaagtaatgttgcttgatttagatcattgtattcatgattgaatggctgggttatgaattactggacgattgaatgtttgaatgtctgaaacacaaaaacaaggtatttcgaaaacacataccttaattaacttactgatcaacacttgttataaatagaaaaaagacaaaaaaatgtaatgactgtgcagaaaaaatatcgtaaaaagcatataaaaaactaactatatgttaggtgataatgaagacatatataacctttctagatgattgggaaatatctacatttgcaacatccttcagaatggtagagtccctttcaacatcagacctttctctctggtctggttgatcataatctttaaagtgttgcttaatatgtcattaatcttagctgaagtatcctgggaaaatgaaaaaaaagcattagatacgaattaacaaaaaataactccaataatatatgtgacttataaagttcacatgtaatgaagaaaagactttctctgcctggttatcatcttgaacatcaccctcgtcgacattaatacccatctgagtgtcagactatgatcacataacaaaaaactataaaaaactgaacattgaataaagattgaatggcttaataataaatttagcgtaatgttattcagtagcttacaaaataatgacctagatatcgaagtacttagtaacatcgaatgaattaaaaaagtatgcaaagacctgaactgagggtgttggggcatatcagcatctggccattgatgtccaacactccctccgcgagggtctaggctcctatttacatcatgaacattaacgtcggcaccatcaaccccccccctctcgatgtcatatggtgggcctgcacttgtgcatcctccacatcgtcattaacattgacactatcaaacatcctgtccatgtcatcatggtagt

SEQ ID NO: 5058 - DNA, 1932 bp, Zea mays
  misc_feature (1)..(100): optimal_loci_136219_G1, chr4:23157143..23159074, Cluster 31
tagggatgagatatggttcctagtattgccactaacagaagactaggacacgaaaccctagaaacccttagaaccatgttatttgtactcctgttgcccttcggtatataagtctagcatgtgtttctatataagaggatcaatctatcaagcaataaaactcgacaaccccttgatcagtggcatggaactccccatacatctctctcttttcctattgtgaaccctttgatggagcattctaacacgaataacattattgttgaatataggtcttagacgctccaaccaggataaaaccttttttatgtttttagtgcttaagctaccaaagatctatgcatcgacccatgtctaatcactcatcactatcgtagaatcgagcccatgtggtcctttctgagcactattgtgaatgcttccttctcacatcccttcgcacagatatccctcgttaaactaatgttcactagtcgattctctatttggccttatctccaaactagaaagaactattaaggagcaatcaactttgaatccaccatatctccttggatcaagaataactttacagtgaaggtggttgtggagatagtggtctacaacccatggtttctaggtggcgtcggtgagttaatggtcgatggctggccaaaaaactcaaccaccacctattcctagttgacgaactcctatcacgattctggtccacactcccttcaaactgaatgcaacctagcctcgtccctacttgatggattggaggatgagttctttctctatcgtgcagacaagcgcagctttgaggccgagtagtcttccatggagggtgtggccctggcgacgggtcgagatcaccctaccacatgtctgcatcatgtcgttcctttctcctcaattttaaggtaaaatgtcaaggttttgttttgtatttttctatagctataggtaattattatacatatttagatagtttctttatattacttggaatgtcattaattataacgaaaaataataatataactgttattgttgtccattgcttagacagtatggagtcgatgaatatgtgttgtagtgttttagttgttgtttcttttcacaaggtcttataagaattaaaaatgatggtccaattactagtacaagagaaaacttatctgtagttattattaaaattaaaaatgtcttccatttctcaacttgcttatctatcttactagtactagagtaaaattactcttattctatcctttggttcttcacttctcgttgttacctttctcattttgagtttgaagctaaaaaaattgttggcttcacacagctcgcaacttcattgtcattgtatcattcatgttatacctagtcaattgagttgtgtgtgccagtgtatgactggccttatacctttcttaagctcacaacatgtagaaaaagacaccatgcaatttaagttaggaacatatcaggtataaatcatacacattgatgcaactatacaaccaatacacagacttggaggtgagagaaccttttaaaaatattttgaggagatggaagagttgttttgaaacaaaatagtttttaaaaggttctcttacctcccagttttatgtattggttgcatggttacatgttcccatttaacttgtgttaatttccttcgtattagcataacactaccatttattatgtctcttgaattttatttgataaggttggtcaaatccaattaaatccattaaaaatagttagatcattatttagtttagtaaacacgtcgcaatgcatttgcatgtttcattatcgtaattttgatgatggaacccatggaattgccccaatagccatgataatccctgcagaggaaatgcaagcactattatggctaatctctgtttgtttggctttaatttgtaccagctt

SEQ ID NO: 5059 - DNA, 1437 bp, Zea mays
  misc_feature (1)..(100): optimal_loci_136909_G1, chr4:26808685..26810121, Cluster 31
ctaaggacctaccaagtggtcttagggtttagagtcccctacaatggcacgattatataaatatataaaaacaagagaggttgtacaaagagtggtggaggaaaaaagggaaggggatcaaaaaaccaaacctcaaaaacctagactagccataaccaaaggagagaagaaagatgaggaagaagagggcagggaaaaccacaagcaggacgcaagctaagagggctaaatagcaaactataaggcaggtagccataaattcactgaagtcttcaaattagtgacctgtatgttgctctgtaggtgaactcttttgcatcacctcactagcatgtcaattgactagagatgtaagaaatggtttctgtagagctttggattgttgaatactcagcttgttttatgatttcaggattattaatagtagtgtctatttggtttaggtcccatgaaactcaagcttttgagttgcatatcattatattaagatttaagaagaaaaagaaaggggattggccttgtacaaaaatccattaataaaatgccttttaattcattaataaaatgccttttaataccttaaccttttaattcttctctagcaagtgtgctcacctcatcaaggttaaataaaatgccatctaagataggactagaactgttgtggtgctctgatcttcatttccatttggcacgtgacattctctggtatgagtctgcatcacttgtatgcctagtatagattgtttggtggacttgagaaactgattgtgcctactgcagtgtcattgatttttaggataatataaatggtttctttgtgatgtttctctagcattaacattgtgctgatgtcctttgttctaggcaatacctatactacatgagattgtgcgaattgcaccaaatttgtcagattcatattatctacttggtagcatttatagtgagattggtgaactagataaagccataaacttcttgatgctagctgcatatgtttccccaaaggatgcatctctgtggaagaaacttattcccttggcaaagtgagtttacttcattgaccttattttttttgaaggagtgtattgatgagtttgcttgatagatttttgaaagaaatcttgcatacaaagttaaacgagatgaaattgtcatacattgcttgaatgtggatgcacttgtcatcaaaactgtgatttcatacaaaattgcacatatttagattatttattgcaatataacctttccatatcagtgcaatgcttgttaggtgagttacaacaatttaatagatttaattgtgtgggctaaagcccttgtacttagtcgtcctaataggcccaatgttaggcgtggcaggttggcctcattggcggcaaccccctatacatgagatcaagactggagtcccctagggttgggactcttctc

SEQ ID NO: 5060 - DNA, 1747 bp, Zea mays
  misc_feature (1)..(100): optimal_loci_155031_G1, chr4:146991391..146993137, Cluster 31
attgggacctctcgcctcccagagcatctaacaatatacgccctcgaggcccctcgtgtcccgagacacctaacgatataagcttctacggcctctcgtatttcaaggcacctgacgatataagcccctagggcccatcacaccccggggcatctattggtataagccaccgaagacactcatgccctaggtataagcccctagggcacctgatgatatatacccctagggctagtggaccccctagaggaaacaaggaatttgagtgatggcctaggcctatcttgtggctaaaagatgtgataagcccaccaatggtagtacaacactgagacgtgggcctcacacctaaatgtcctgaagactatctcgtggtgatagcttgatggataagtctcgagtacaacacattaaaagcatgatgggtgatgttacatgattgaatcagtttgtatacatgcaacatagattgcagggcacttgaggtcactacatagtgcatgcacaagtcctataaccacacaagcacacgtatggtgtgccaaaaaaattaaatgaactacaagagactatattggcatataattacctgagtccagcaagcttgggcctcagaagtagaatccattttcataggttataatacctaccatgatagtcgatatggtgatcgtcttgcaaagagataactatgacatccctcgcacttaatatgagcatgacattatgggcacgtcttcaccctaacaatgcacataggcgagaaatgtacccaaagccactgaggaaacatactttagtatttatcatcctatccatgtagaagatcttgcctgatagaggattcgtagaatccttatagctggtgctaggcagtatgagggccccgcatatgataaagggtacaaggaatcataataggatccattaagaccttgtccttactatggacataaccacaagtcaacacctcaataggaatggttatggtgatgcatgcctattgtaggtcccaagaagatcacaagaccaagatatgatcggggttattggcatgatgatagatagggaccacatgaggtgtatacatgtaaaacaatcgcccatttagactataaaagggatggtagagcatcttttaattcaggtttagaagatctaacttcccacaacaatccagagcaagatctaccaaatccagactaatagggttgaagacaatccaaccaaggaaacaatagcaagagttagtctagcttctctcattctactcctttctttgtggctctatgggtttgggcttgtaatcctgtatgccatctacatacaataatctgtggtcaacaagagaatgtaggatattatacacactacagtctaaacctttataaaaatccttgtgttaggctcttgatgtaatagatatactctatggtgttaggactcatttcgtgctccctagcaatcctagtacctttggtaccctgatgtctttgctacgatatttggtgttgtcatctgggaccttggcacccgtagcagggttctgcctacatgacatcttctacctttccatcacccgaggtggagtttttagccaccaactagagctactcaaatagagtttcaacatcgatgtcataggggagctggctagaggcaaataaccaacataacatggcaccgggaaatactgctcgatacataggatgaatctccatggcttggttgaatgtaaacagtaggg

SEQ ID NO: 5061 - DNA, 1647 bp, Zea mays
  misc_feature (1)..(100): optimal_loci_155162_G1, chr4:147743673..147745319, Cluster 31
tgtttatcatagccgataaaaattaacgagactaatttcatcggctagccatagttgacaacacttaaaataatatatttgattagcttgaccacaaaaactgatggaaattagtcaattcctgttggctagggaagtcgatgcaaattcctaattttcatcgggtgttgataaaaattagctagttttcgtgcattaatctgcaagaactagaggctgatggttaatcgttataggggaatttgtatgcccttagctagagatggtacaaccttttctctttggaatgatgttcggaacaactttctgccaaaagttgaattttcccacctattttcttttgctaagaagatggattgtctctggctgagttcttagaaaatacgaaggttgaagaaaatttgcatacgcctttatgtttggaagctagtgatgactatgtcatgttctatgagacactcaccgagattcaagaaacaattaatgcagggtaaagacagatggatatacccctggagtactagcaatatgagttcaagccaaatttataagcttaactatcaatgcatcaatcctcaaagtggagttggtagtcaaaagtttacagaaatattaaagtattcacatggcttgcattaaaagatagattcaattccaggaacattctaaggaaaaggtgtattgtggtgaatggagattataattgtgtcctctatgatcttcactgtgaggagaccacctatcatggattttcaattgccctttcaataatgcttcctggaaccatatgggtatttactaggatcacttgttgaatttcttcccgatcagtgtttcaagagaacactttaggtacaagttcttcatggaaataattacactctcgacatggaaaatttggaaacaaaggaatgcgaccatatttagaatctgttccctcctcttcttggaggcactgcttcaacaacacgttgaaactttagcttcgtaaagttgttctggagtttagatcaaagatttccctatggcttgattctttatatataacttcttatttcttattctctttctccctttctcttgcttccttttgtttattgttgttttctgttgtttctattctgatttaataaaggtctttgctgtgtaggggtttcctctacagttttatcatcaaaaagcactagaggctgacgaaaataagtctatacggtttgtttttatgggtctctgattgacaaaaaaaattatctagagctaccttatatcattatctacgttttggaaacaaaaagacagaagttttgtttaatcatgcaaggtagacaagtaattttgtacaatcaacctcagcggtatggaaccagtgccttcggctatcaaggaaaatagaaaatgaaggagaaaccttaaagctaaaaagcttaaagacactttatgtcactatatctgcgtttttctagggacatgaaaatccttgtactccctccatcttttttgaacgtaatggctctgcattttaattaagaagaagaatgaaattcacccagttttaaaaaaatttgggctcgaaacctgcacaaagagtacaagcaacccaaacaacgacagcccccacacaaaacccatctagagccatcgatgctg

SEQ ID NO: 5062 - DNA, 1408 bp, Zea mays
  misc_feature (1)..(100): optimal_loci_156199_G1, chr4:153326460..153327867, Cluster 31
gctcttgagttgcaatggttctctagtgccattgagtgtgactaactttccacatgaattatacttagcgatgtgttgataatgcaatagaaaagatttagaaagtgtttgaaaatgctaactcatctgcactagaataatagttagtacaaaagctcccataatagaattgttcacagatgttcggactagggctcttgttgcctgatgattggatcgccaattggtctgagagcatgggagcttaacattttttaaatggacatgagtgcataatcagatgtcacgtgtatacatatggaggggaggggagtatgcatggggattattccacccctaggcatgttttggaggtcccagtggttgtgaaagccctatgtttgcttttattaattagtataactagcggcctaactttttactaagtgtgttatgaagataggttaggtcaacaccaaaatgatgagcaagagtttgagtaggatgaagggtgatccatccaaatggagtaatctcacactcggaaaataagaaagaggaaaacaaaaccctacagagtgaaggcaaagttataaactaaagaaattgttttgcttaccaagacacaatagattatgtgatcgagtttaggatagatagttgtactatcaagaggacatctcaaaatagcaaacacgattatctagtttcactaggtgttgatttatatgcattttaattagtacatgattagtaagcaagcaaaaatgtctttgaaaacactttggaaaatattaactcagtgcctacatgtttggcaaaacatttgggggtggcatgcttacaaagtgagagatgaaaggtgatgcttatgcatttctgcactcaccaaaggtctttggtgtggcactagagtacttagtggatatctaagcagtaccctaacatgagtgaagttgtagtcgagcataatgccttcaggtatgcactagacatgccccaccaaacagttccaatgtggccctagccgagcatgattttcaaatccattccttggacatgtttgatgtcgcatcaaaggccacactacatgattcaactagacagaatgtaaaatagagacttcggagctaacacacgccaaagtgtctagtgtgcaccaaatgtgcacaaaaacctctaatagggaaatggctagttttcttgttgttggaaactaatggttggaagcatttagtggcaactggagaggtttcatgtgcctataggcactatgacaagtgggtaactgttggatttttggcaggcttatagatagcccttatgtttatccttgaccactctgtcagaccttctaacacttgtgcgccctttttgagagctcagcaacaactccactaaatttcatccattcaatttatatttggtt

SEQ ID NO: 5063 - DNA, 1405 bp, Zea mays
  misc_feature (1)..(100): optimal_loci_16922_G1, chr1:93921072..93922476, Cluster 31
tgcttatgggttgattacaagatcggtaccgagtcaattacttaatacgagttgtgattgagttggtctcaaaccatgtacaagttgtaccctatccttttacatatttcttccttatctaataggcatttaccatatctacatggatgtaaatcctatctcatgatctagtaggatctttacgtaccatctatatcttcctagaactttcttgctaatggaatatttccctgactgtgtgggttgagtccctagacacttggccaagctcatgaaccaacctattatggttttcttaacagatccatgtgtaggtacccctagtctatgtccttagtagacccaaggcttatttggctgagttatcaacttaggtagataagactcttctcttgaatcttctcgtgtagctaaatcttgttgtttctgagttgttgtctcttctagccgagttcttaactctgtcatgtagctcgcatgtcgatagactcatccttttactatttagaactcaattacacactagaccaatgcttcaaattctaaaatttgtgtagctttgacttttttgttagctctaaaaaagaaattccgtaacactttaactcctacagttccatggtgcttcatcttttaccattagttatacataatatcataccatgacttttgggcttctctagcccatctgttagtagcctttgctttcttgcactcatctgcaaccaccgctttgtgttctaggctcttgcatttgatgctcaagcctcatgaattcgacactctagtgcttgaacctttagtaattgatcgagccttagggacttaacatccaaatgaatgtctgagccacatgaacttggcgtccggtgctcatggggggcttttgagttgttctcaaaatgacttttaggagatcaaagcgtattagggactcaacttctatatgtctgttaaaggtctcttgatgcccatgtggggacttttagtacacagacgacaacaaggccacatagctagtactaccacgttcacataggaattgataactaagtcttatggacttgatattctgttgcccatagaggcactataaatgtgcatacgatagtagagctatataagtagtattgtcaacctccctagagggaccttaaatcaccccagtgatgtgtataggtaattagagtgatgcatgtagcacctagtacccttatagtgatgatggagcatagagtgggagaagtaagggctgaccaactctattgacgacaaatcagatcacagttgtgtgatgctacatcatcaagccttgatcaatttttttctgacagatatgcacctaaaagagttctagtcaagtgacttatgaccttctgcaaactcaggcttccacattaattgg

SEQ ID NO: 5064 - DNA, 1688 bp, Zea mays
  misc_feature (1)..(100): optimal_loci_170476_G1, chr4:230364812..230366499, Cluster 31
gtggctcgttgaccaccaatccttcaactgcttaggggtacagtggcgacaagcttctatttgtagagttgtaggtgctagctatttggcccctggaggtcgatcccttcctgttgttgccatcaatgagatctaaaacatgtggacctataaatttaggaactcaaaaaactattgtgtacttaccagccttttttccctctttgtccaatccctttgatgttggtgttgaggagcacatgtaagtagattagatcaaagtgacatcaatgtcgttgattgggggcactattgttcatttaaaaggacaaaatggactagcagatcaccaatcgggagagagtatggaggatgagcaccatatgaaggagcacaatatggatacccatacaagtttggaggagggtatggatatttgaaaggtgaagatctagaggagtgtgtattaacgatatgagcttcaatggtaggaggagctgtgatggtaggatttatatagggaggaggttaagcacccatggatggttggtagggatatgtaggaggatcatatgaatatagagatcggaggttgttgatttagggaacacagatggacaaaaacatcctcctaacgacgatttatgggagaaaggtcatcaagaatacatgttccacattagtaggggtgtcacgatgttgtggagattggtcattgaacaagttggtgaaagtttcaaagttcgaactccgcctatgatttatattcaaatagagtgagaggctacaatataaagaaagataacgaattgaagaattgaagagttggggatggaaataaactcaatcactttccttctgtttattggacagcattttttttatttaataatttttttacttcaaacgatcaaacaaaccaatcaaaaaacgacatgtgcaaacaaattaaacgaacatatcgattggttctacaacacggtagtcagaaccgatcagttcgacactaaccagcggttcggccacgccaaagagacaaagatcaacgtcgaccagcgttagaaccagctttaggtgtcgaacggtggttgcagaccccccaagctcatgtatcgtcaattccggcgaagttttttttttcccctggtaccgttgattatgcacagttggtaaggacgaagtaacagaacatacattggtggcccgtggccaagttgattggctctatctctgaggctaacctctcgaaggattcaggaagctgcagttcttacctcttgttgctttgatcagtttgctttcgggtagagttttaatcgcagagccgtgtctcagtgtctatgaccggtgatattgctgtcttcttctaggtatcgttgttttcttgtgatgcttgttcagtttcttgcccaccagcggtaagcctagtctttatgctagggctagcagatcgtgtataaggctatacaaaacaatgttttgcttgtagactatagtatttaagattagagtttgaaatgagaaagacgagtaagctgttgaagatagcttaaataataaatatttgagcaatattatgttttataagatagttcacaaaacaacatttcaatagaaatgaagttatatccggcctctacacgcaaccttgattgggtttttatgaattatgacgaagttaattcagctagacaaccgatcaaaatcta

SEQ ID NO: 5065 - DNA, 1629 bp, Zea mays
  misc_feature (1)..(100): optimal_loci_191534_G1, chr5:124224112..124225740, Cluster 31
tttcgatgaacaaaaaatatttcaatgttagtcagaagttccaacaatcaatgaaaagtcaaacccaaaccctctccttttgtggctgttaattctataccttgtgaaacttccctacacctctctttgtaggattttgtgcttagtggaaaatccaacgggtgtgtttagtaagatttagaatcatgagcaaaatatagcaagccaaaacatctacacttgtagcattcaaagatattttgaaaagcatttggtactcttggagaccaattccaatctttagcactagatgagacgaattgtgtactacttgatgttggcatgcaagtagatacaacaatataatggtatataatggtgaaccacactaaacaagaaatggtttgccacagaggacaatcttaaaatgttgcaaatatatggctaaatcaacatggatagatttagcaacaagaagaatcataattattagcccatgcacaagacaagagaaagtaattagttttatgtaatggcttacctttctgatcactttgttatatctcactgctagacaagttaaaacatctaatatgtgtcgcaccgctgatgccactttcttttctcttaatatgatacaataaccatatgtttgcttcctaaaaagactagcaccaaaatctcaagacacgatttggatgtatggacacatgaacaatcaaactcgacaaagtcaatggcatgtgtgaatgtgttgtccatgtatcatatctgaaccatgtacacattccaagtttcgaggttaattcatggatgtgtgaatggcatggcccatgggtactgtttgcaaagcattatgtaaatagtgcattgggtcataacgctgtgggatgacgacgaccaagtgacccattgcctgtagatcttggcattgatctcattgcttttacctacagtgttgtcctctacaggcaactggcttgctagatgatgctgatttggttcccagcctcagaaacttggatgtgaaggatgagtctttgtcaacatctgattcaggatgtgaaggatgagtctttgtcaacatctgattcagtctcatctctagagctccagttgtttgtatcgacaacgaatgacacactgaaatcaagccggtcctctattgcttttgtttgataacgatggtggaaaaatagataaacggatgaaataaaacagcatacatgcatgagtataatatatatcagtgtatgacattggaagttacatataatatatatctcgctagcatacatgagtactcgtcatgcataagcttcattagaaagttgggaaagctagcttatagatcatctatatttactttaattagtggtgtgggaaaaatttagtagaagaccattacagattgccatggtgttccctgctggactcatcaaccacaatttcatttctatatttaacatggatgttaaattgaaaaattgaaatctagtaagaactacgcttgcataaaaatcttacagcatgatttgagtctcgtctcgcacccgagtgagcagaaacgacaggactcatcgtggacgtggagtccccttcggcactggtcacagtgagacgcgccacgctttccgtgactcgacacta

SEQ ID NO: 5066 - DNA, 1555 bp, Zea mays
  misc_feature (1)..(100): optimal_loci_195117_G1, chr5:146423865..146425419, Cluster 31
cgagatcctcgggcgcttttaatttgtgctgcttgcgacttttgattttgtgaggaagtgtagtcgtaactacatgtagtctagcgtttttttaaattacatgtagtctagcatattgcatgagattctacaagtaaaatatatgtactatgttaattatggcatgagagctttatttcaacatctaggtcatcaagttattgttgtattttttttaaataatagatgcccaaatttgaaatggattgttgttcatggtgttcttcaatttttttagcagattctgagtatggatagatgagaatttttccaccaaacatgagctaatatgatggcttccacagtatggttgttagattttgttgttctatgaccatgctatttctagttaaatcaacagaccccaaacattcacattaatgctaggagtaatactttcacctagagaataataagaggtttcctcaacctaatatgttgtaattgtgtacaaatattgtgaggtcaatgagggtggaaagtgaggtatatgtgtatcaagtggactcgagacatgtgtgagcacaagtgtgtaggtgtgacattgctgaatatgatgagtagcaactggatgcagtttacttttgttattaatgacctcatgcaaacattcaattaatcataattgatgctacttgattattatgtctattagcatgtaattgttgttgattgattatgactaccatcatgtaatttatattgatcgattaaaacaatcaacatgaaaaccgacatggctttactatctataatttcaaagttgatgctctcatgtgtatcgagtgctgacacatgagagatatgcaaatcttcctatcttggtagtatacaactcttgagacaccaagacactgccattgttctatctattgtagtagcattcttgattcgttgccattgaccttctacatgcacaaaacaaggaattagacctttgaaccatttatgttcttatggtcttactcatgataagtgacaacacatgtttttagggagcgcacagtaccactatttctatttaactatgtttacttcttatataaggtgaatgtgatgcaacaaaactattcctagattaattgatattgactacatcaacaaggtcccatcaaattatagattgatgtgggtaacaatgcctacaggactacctacatgtgtactactgttgactttgctttcatcctgttacatttacattttttgcattttgtggctttaccaattttagtgttgttaagctagcatggtaggtgactataggttgtaaaacattcaagatggtaagttaaaaacacttaaaattagatatattctttgaggttgttctatattatgttaattgagtagagatcagtatgattagactattaatttttagcatgttccactacaccctctctctatgaacagtaataatttttcaccttcacatccattggtctacctaacaactatggtaggggtaatacctccactatcaagcaaggtgttgtcaaggcattgtgccaac

SEQ ID NO: 5067 - DNA, 2011 bp, Zea mays
  misc_feature (1)..(100): optimal_loci_196784_G1, chr5:155024413..155026423, Cluster 31
tctatcaattcaatatataactaaaatatttcatattacattcaattcatcaaatacccattgggtgtgcccctgactaacaatactcataaagggataaaatgtgaagtaaagaaatggggttgcaaagggacaatgtctaatatttattcacttttttaagatacaattaaaaataaaattaagagaaaatacaaatataaaaattgcaaacaacaatttatacccctgtcattttatagagtagcatagtactctgccacaaatgtcatgttttccattcttgaaggttgatacatctaaagtttattattttttctcatggtcttacttataatatatatctaaatttggtctctcatttttcaacttcttttattttctatttttgtcgttcgtatccccttccaattgcttcttcgatggcttcttaaaaataattctctaatttacatttatagcgaaaaggaaaacctaacccttcaatagttttttaatccaaacaccctaattgaaaaatggctgagatgttgttacattaattttgttgtacaaaatgattgcgataaacgaggaaatggatggaatacatgtcttcttgttgtatatgtgtaaacatttttatagataaccaagcgatttgcttcgaattgtatggtatttctacctaaatcaaacattcaaacctaaggtttgacacctttcatgttttgtccataaaattattgtttatagtggaaggatctttatatcttttatactctaactatgagcatgtacttatggttggtgggtgccctccactctttgaggagattgtttgggaggacctcttccaccaccatattcattagatctccatttgttgtcttcagtgcatcccaatgtgaggtagggcttcgcgacatcttctgcacctgtttgattaccaccttgacatacttgagctttttttggtctggcatcttcattgctccataagagcccgttattgcatcatcctttttgtttggcttagcagttgacctcttatttcccattgtgtagatgtatgcaggaatcttccctcgcatttagtaatgggggcatgagttagggcttagtggtataggaaggtggtgagcaaaggattgtaatggtatgggtgaacatactctacctcgaattacctattcataattgaaaattaaggagatgccttttcttataagaaactattggaatctgaatatgcatattatttacatctacgcatgccaatagaccgtgacaaaagataaagggtggattttactacgtatttaattgaggtgtccattaccatctgaccatcaattttgtggggccaaagtgaaagagacaacattcagacatacccggatcaattacgtatcagttatattaatggatcttagttgttagagccaagattacaagtcaaaattaaataaatagtacatgacatagccaaccacatacaacaaaggtacatgacctagtcggccatcagaaagtgcaaacacttttaattgttaccataatggaaacactaacctcaatgacattgaatcaaggtctatcaaagaggttggtctaataaagacaatatttcatgctaaatacccttagcacaatagagtgagtaggcctcctcttgggcatagaattggaagaaccaataggagattctagctgagatgtcaccttcgatagcttactaagatatattctagtcttgttaataataattctagatcagaccatgggttagcctttgatacaaatcaaagtaccctataagaacaagtgtagcagactaaaactctatatccagacatcacaagagtaactatagctagaaactactcagttttggattaaaccctatcacaacattttttttcttctagttagaagacaagattttactcttctaactataccctaggggctcatacatctctgaggcctcctttggaatgcaaggttggtaaaatatagggataaaatt

SEQ ID NO: 5068 - DNA, 1577 bp, Zea mays
  misc_feature (1)..(100): optimal_loci_202145_G1, chr5:186260686..186262262, Cluster 31
ggcttaaaattctgataccatcttccttattaagtccttatgtcgatctatgtacatactgccatgtcactacgatgataggaaagagcatattaacaaacttgaaaatatttttatttgatgagaaaaaaagaatgaactatacaattgtacatactaacctagggaattgttttaatagttctttatcttatagtcgttagtgttaaaaaaagaacatgtggcttcaatgtacatagtaagatgagaaacaatattatctttcattgttatatcatcattggacattcgagctgcacattctacaatagcttccatcagaaccttgtcctccatttatttcttattttcatagaagaaacctaaatttaagaaatacccaacttttatgcaacatagtcttaagcttgttatcccaccttgcatctatgattctccaaataggaccatatcttttctcattcctatttagacatgttgcaatatcttacattgctttgagaagatcaccataaatgtaccacattgcaggaatatcactatctactttttggagtacatatgcaagtggctcaaaataatttataacctctaccatttgtgtctaatacgtgttgttcggtaccaagtcatgtgcattctattctgtaatctttttaaaccaagaacttttatctcattcttgtgatgcaaataattgattcagttcattttgtttatcatggagactttacaagtttaagtaactagagataaatcgaataatatcagctattcggctctaagacacgcctttggtgtattgacccatgaaggctagaaatctagtacgtgcataaattcaatttgtgatagccttgccaccttgaataatgttatgcactaatattctctagcattagatcgatacaatatgcattcatgtggtccaaatatgtgagaatattttagtttgagcaactttgatgcaataatattatttgaagcattgttagtgaccactagcacaatgttttcaaaaaccgttgttaggatctagatggttagagagtgaatagactataaaaatttattctataaaactcaatattatcactagagctaagatgatgggtgtggatgtgtatacttgctctagctctaatttactcaatactagcttctaatcaatctagcaatttggtaaaatgattctattcaatgcaacaagctacttactagcaagagataaagatcaataaaaatatacataaggctaaatataaaaagatgatacaagtagatatagttataagaatataatagatatggactacaaaccatatgggacaagagatgacacatgttatatctttgaggtttggttgcatgcccgcaacctaggctctcgtagtggtgagtccaagttaaatgattcacatgctaattggcatcatacaccaaatccataataaggtcactgtaataatcactctagagaggcacttcaataagctataatttcactatattttctttttgaaaaactcccacatgccaccttataatttcactatattttctttttaaaataagca

SEQ ID NO: 5069 - DNA, 1418 bp, Zea mays
  misc_feature (1)..(100): optimal_loci_203332_G1, chr5:192879863..192881280, Cluster 31
gaaaaaatttaataaaaggaaactccagaatatgactgaacactgagaatgagtgggttgtgatgtatacagaagtatcagcactagcactgaagctcaggagcgagggcaggaatagatcaggccccaggctgatccagtgttgatacgtgttcgagtgatcaagtcatttttaaccattgatttttgcatatttttttgtggattcgattgagtttttggccttggaccagcactgcagccagtgtagcccactatccctggcccaggttccaccacttccgaaactcgtttttcctaaatattcataaacatcatgcaacatagaaaaatggcattggagagaggtccccatggaccacttgtcagcttcacactggactctgtttttcaatttatatgaggtgttactgaactctcttaattgtttttttttcaggagtaccctgtgaagtagggacttcgataatttgaacagcagaaaattacgatatctgcatatcccttttcatgtattgattattgtggctacaagacagcgaataggttgtacctccacaaaagtgcagctggacgttttctcatagatgcactggagttaccaccaagtcccagcatgcttccagtttgacagcctaatacttctgaaatcacattcttcatgctaatgttcctcatgaaaatgtcatcctccccactgtcatcctccctcattgaaacaaggatcaaccggagcatgcaaaaaaatggctgatcactatctaacaactgattaaaggcacccataacacccatgccaggcccaaatccaactccactatcgaggcaaccaccaagtccagaatctaaaagaagtgcctgcagcatcgctactgacttctttaccaatggaagttcaatccagtttccatcggagtccttctcaagaacggacttccatgacacccaaccactccccccaccaccaaacacattagatttgggagggatgcatacaccataccacaatcgggttctgtacttccacccttctgaaagatccgaaatacagctcccataagatacaaatgcatgtctgacagatccataaggctcagctgctgctgctgctgttacacgttccatcacttcagcagaaagttgcccatttgtatctaccgtagaagcaagaacctagatattttttgaaaaaagacaatagaatatcgtaagataaccttcaaaagagaatacgaagagtaaccagaagtaagtgaatggctaccatcaatgaagtaaagtcattgctgcagtaaacacagtattcttttggattacatttatgcttgttgagttccaaaactcagtgaaacagagtagtcaatgggcaacacagaaaaaagatataaacaacaaaaaaaccagtgatgctgttagaa

SEQ ID NO: 5070 - DNA, 1549 bp, Zea mays
  misc_feature (1)..(100): optimal_loci_203339_G1, chr5:192887359..192888907, Cluster 31
gaggaaaagcttgcccggtttatcccttccctagccccactgacaggttcgaagcagcctttccgtcccactcatgtgggagccttcggcactaggtttgtcacctttttttgaagagcatgttgtagtcaaaatcaggcaaaagttcagttaaggcaccataaattcctccttagaacttcatagttcatgcactatttactaaggtagcacatttgagtgtgatgtaatccaaatgtctaagccatgaaatgtgttatgaaactatgaagatccaaaacttgggtgcgggagaaccaattattgccatatgtaaacatcaagatgaacatgaaaaggtgttgggaaaacttttgcatgagtagtttctgctttttttgcttggataagggtattttctaccttacatgtggcaaataataatgtaatattgtgctagactgccagttccaagtgcagttacctggttaggttgtgggcagtctacaataaatccaaccaaacaacgaacatcatcagaagccaatgtagaaggtgctgctcctatcaacagttcaataacaaccaaaagctcatcgaccagagcattcacatttcccaaaggtctctcgtttccagtaagtgtgaaggtatcaattgaatctgcttcatgaactacccagtaacaccttctgcacccatcaagaagcatttgcagtgcatttgcatcacgcatgcaagtagattctgcaaaaaccatgtctgcaagtgaagaaagaagctttttctgcaaaatatagttgcatgaactccacatcttcaggtccaacagcaaagtgctaaagagctgcaccttttgactatgatcgtttctttgagactgacacaaagatacaattgcagtaacaagctcttcatcactcagtatctctttctttccactttcaagtctggatagtgtgtccaatacataatgtaaaacttgagatagaagctctggtccatgagtacggcataactcttctttattcccaggatgttgaacagccacagaaatgatcctgaaaataggaacagaaagagatgcagtagcaagagacgatgacaaatcgccaagtataggttccaggttatccatctcgacattgctcacaatcagtggtaataatgccataggaccaccataagccaatgcccataaagattcagctggacggacacgattagagatatgaaccatgccaagaacttctgcaggtcttcggtgagtacctaagattcaacgtaaggtatcatcagcagtaatacttccaaaccagcccaagcatttgtttgttatcattgcacaacatatgttttagcacccattgaataccctggtcataagggctaacagtctaacaccatattattaaaacaccctttcttttaattaacaaaggcatgattgatgcagggctgtggaagagaattttaatacagtgtgataggtaatagcccaagaaaaatatcacggtatgctcagaattccagaaacattgcatcaggatgaccagtaataataaagctc

SEQ ID NO: 5071 - DNA, 1471 bp, Zea mays
  misc_feature (1)..(100): optimal_loci_203476_G1, chr5:193646716..193648186, Cluster 31
atggcgcgacctgctgtggtcgtatggagtggaccacttaaactagctaatgaagaagaataaatggttatgggcgtgtgttacactaattactctcgtaacttaggtcattagctccactcagagcctctaacgtgaatagacaatgtaaccatctctcatcattcttctcaattgagcagcgacgtagcttcgtgtctggatcctatgcacacaggagagttgtgagaatgggcctccagaatcattatctgcatcagagaaatctgctgtcaaagttttggaaagtgtcgccataattgctcggtaattcctagtgttgctacagatcgccatgatggttggtcaagtaaggtgttggtggagtcaagacacatccatgacaatttgcttgtcgagtaagattctatacttatagtctcgtacccacccacgagttagttatcaaacaatagatataatcatttttgtgtgcttttagcactagcaaaaataaagtgaaactcgcgtgtagtattaagtaactatacccatatatatggttggaattttgtacccacaccaatcgagtattaataccctaaatttaattgccattcctactcatattgtttgaatggtcatgggcatggaacttcacctatgacttctagctcatatgccaccccttgatgtatgccctcaagacgacttaaatgtaccatcaactcctccccaagcacagttagatgccatcaccttcgatgatgttgggaccatcaacagttggatacatatccacgtagcacaacttatacaactcaaagagaggttcatcccatgtaaagtgtgaccaagaataaacgatggcaatatgtaatatgacatttagattcatatgctgcaactcaagggagattgtattacagaagtaaccctcaagaaacatggtgaatgggaatgagaatccacacttgaataacagtgcgaataccacaatctttgtggcatcgacaccatctcgttcgtccaagtctaggatgctatctaatcaaaccatttcactataattatcccatcaactccaaaaccttatcggtgatagttatgtccactctaccactataatcattagatgttcgactacaatctcattgatgggttcctttacaatgaatatcatccaaccataatagatctagggctaagggtgtgcatctggatctagagcaatggaagagataagtgtgggctaggaattgagtttaatttctatgtattggaatgtcattggtggagcactcagggacgatggaggcgtaagtaacaagccgaagtttgattccttaagaaacaagatgtgcattaattttggaatagatgaggtatactttgtgtcaattagaattgtgttttttcatgcacaattttagcattattaaataacactttgcctttatgtttctgttcatcacgatttcaccaaatatta

SEQ ID NO: 5072 - DNA, 1845 bp, Zea mays
  misc_feature (1)..(100): optimal_loci_204555_G1, chr5:199708581..199710425, Cluster 31
atcgtgtgttggtaaaccaaaccgctaatctcttcatcgtgttcattactcatacgacctcttccgtagcacgtgtgattattcgttgccgatcgaatgccgatcgatgcacatatatggatatgggactgtcgtttcctgtggaaatacatatatagggccaagcatgacgaccaagtagagcgatgatttgtcaatggtttggcgtgtacaggcgagatcagtcactgccttgaccacgtgtgtgtgtggttttgtagtctctttctctcttgtatctgatgaagaacagacgccgtgtaaacagctcaccaacctgcaaagttccaaattacgacgtatcactgtatcaggtaacgggctagcccccccattcctaagttacatcaacataatcaagctctccctcacacaaataagaatttaaagttccacgttttctttgaaactttgaataacacatattttctgtgactcgttgcagccttgcgggtcaaatggtttctatgactgcttatattattatctaagtttcatgccaacgaaacaatgttctatacccaaccatcaaaaatatataataagctctcgctccttgcaacggcgggcaatgcaaggcggccagcggcctcaccgcgcgccgctccttctccgcgcccgccgcaacaccctatccgcctgtcttatccccgtcgttgtagtcaaaaccgccgcccacgctggggctgccgctccgaatcggtaccgctggtgatgtttctgtcatgtcactcgccaccgttcatatgcagaggcatacaatttgtaggtgccgttttcggacgtgccatggtgtagcgtacttacctgttgtaatgtaggcttctgcgaatttggtcttctagctcccggttgactccttaaaaggaaccacggtccttttcgttttacactgttccagttactagaattatgtaatttaactctagcataattacgtttagggttcaggcttgtatgaggcaacttctgtgttctgctgcttctgcaaggctgtagctactgaacaagctacagcttgaagctaatctggttaagtggttttagaagagtagataaagtgcatgatgctaatttatctttgtatatttgcattgtaccagatacaacggttatttttttttcttgaaaagtcaaatatcttctggtcattctactcatgcttaaaaggaagtggagcgattgttgattgtgatgttttcaggctttgactactcgtaagaagccgcttttgagatatatagcaagttatctatatccacttgtcctacatggcaacgatgcttgaaatgaggcagctatcagcacttcatttgggagttccggagttgggataatttttttttatgatcatgttaggtgcagttttagctgactcttaccggggaaggtacatgacgacgacaactaacacttgtcatcagcgttatactggcagccattctctacccgccaatagtggagacgtaacctgctattctcctgctgcggtaatagtgagaaggcgggcagctctatggtgcaactatatgtgtactatttaaaacactgcttctcaatattataagctgtcttcgcatggttgtgtcacagaattcatttgtcgagcaagctcagcaggtcctctgtcattgtaggagatcacgaagtatttacagatgaaatcccaaactagggagaagaaaattaactgaaatagatttactgtttgaatggaggaaaagtctcaggctggacagattggggctccagccattgatgctgtccggcaacagcaggtatcacgtgtggtttagatgggctctg

SEQ ID NO: 5073 - DNA, 1631 bp, Zea mays
  misc_feature (1)..(100): optimal_loci_205145_G1, chr5:203114345..203115975, Cluster 31
ctgacgagaaagacacgggagggagtgctgtagcagcaccttttgcaccagcacataataaataaagttcaagaaggttagctcatcttgtccatgcgtgcgtattgccatcattttgttggcctgacggcttgtgttgatcggcgccaacgtgtgttgtcacagcaacagctgcgaggagtgcgagcgcaggcgagaagatgtgctgctagcggtgcacgagcacggcccggcgagcaaacatgcggccagtggtgcatgggcgcggcgggccgtgggcggtgcgcggcacgatgtcaaacggtagtgcgcacggcaacagagatggagggcgcgggataggtcgatagaaatgatgttggtgtctttcggtgtctccactccaacacgttcgtggatcgtttcttgagttttgatatctctgatttctcatttctcttcaataaatccattgcaaaatgcttacttgacagaataactaatactacatagaaatagaaacaactctaaattcggtattaggatgcccttagataaaaataagaattatgttttcgagaaaaccaatattaggataaaatgtgataaggccattcacagaggtaggtttcattttgtgtttccaatataccacgtaatcaataaagaaatgtaatcttggttgaagtagtctttcacattggagagttttatttagcacggtttcatagataacatgagacaatatgtctatgttaattgtgtagatatggtttcatgcccatgacagccatttcatctcttcattaattacttatcacatcatccaaattgctgatatggtataccatttaataaaaataaaactccaataaaaactatcattgagaacgacctaaatagatgatgaaaagagaagacatataattggtcaaaaaataaacgtgaaaactattaaaatatagtacctgaataaattaatacacatagaaactacatgtagtttctttctaacactaggagtagcaaggttacccaaatatacctcttccctcctaaaatagacaacttatatctagtgtaaaaagaattacagtgctagcatgctaacatggaattttatccatcggatccacatgcttcattgcttgataaattatcatctaagtctcatacaaactaatcagttctttagctatattataatttcataattgtttttttaccttaaatcatcattggattatcgtgttacttgtgactcctagagccacttctatctaaaggaagcattagccatctttgtcaacgtaccaacaccaatctccaacctttttcaattataccatagaaccaccaccataatgtcaatgagttgctaatttcaaacaggctacccatgtcactctaccacgatatcagtcaagatgtaattttctacttgcgactagtttctcaaagaaaaacaatttgtaccgcttgtcaaactcccatgcacaagcatggagaatcaatggatcacttgcacgtaagatatcaaaagctagtgtttttgtgatttgttgtaatatcttgaccagaggcatgtttattcgctagaacaccataataaaaatccatcaaaagtaagcaatggtcgttggagtcggcac

SEQ ID NO: 5074 - DNA, 1653 bp, Zea mays
  misc_feature (1)..(100): optimal_loci_205998_G1, chr5:207671400..207673052, Cluster 31
ctattacttttagcctacgggagggcagggttgcaggcctgacagccccgacaacggcataaagtccacaataagctttgctattagccttgttttaatgtataaagtagtcgacgatgtagtataattaatatactttgtcatgaatatttttttatgaatttgctagtagtaattgaatgttgttccttgttttcaaggttcaaactgcacatcgtccaccacgtgagaaaccttcgcagaaaaaacaattgtaggccatgcatatttgcaaataaccaccgagaaagacgaataatctctcaaagggctagaagcttatggaggaggagatatttgtagtttagatatagatttgacggtcttttatttttaacactagcataggtgagcgatttacatgcagataagctatattatagtaaaaagataagctattggttgaccgttgacagtcccgtctcatgcaaatttggtaaaagacaccgtggctattaggatataggttgatttctagctcaggaaaagaaagaaataatttgaagtactgtactattttttgcctctggccctacactccacgtgagtgattctctgtaaactagtactatttgtttggtggtatttttagttagattcactccaggtaaactggatctggatgacggtccaacgtttgaagaagctagctcgatggaggaaaatcacatcttgtccaaaagtgaaataacagtaccgaggttacgacgcgtgttccgcacactgattgggcgtggtcaaattgccgtgtagaacgggcatcagcatcacggtagtgtgtcgtcggcagtcggcttcaaaactttcgccgttgcttcctccattgttcccaccccctattattgcacacggcggacacacacatacatgcatggcggtgcgctgttgctgcattatttgcttccatagctgccagagtttggcgccgcgggatgtttggtaccggcaggatcttctcgtctttgtgtttgtgtttgtgtttgggtcgagtgtttttattggaaaaacttgaagggataggatcgatgaagtgtaacaccattagctacacctggttcccagtagtcattctctctccatgccacgtattcttttcctttcgccggccaaggacagctgccacgctcctcctcccggccgtaggtccttatatatatactctcaaaatgcaaaatctaagtctctaaacttgttaatccatcttatataggtctagattttcatatgccctttcaactattcacttgtgtctacctttctaccataaagactgcacttctactagttaaacgccgattttgcttactatataatgcatggttggtaatatctgtgtagaaccggaagaaatcggctgaactatcagctgagccgtccatgatagagggggtaggttagggaacacacgacctctaaaattaaatttacttgtcgaaagattgccactcagatagagtagttggaacaaattaacgtgggcactagaaatcccttcgttccgggctggcgcgccatcttttttggtcggaatgcacaccgggcagctggagaatgcacatatatgcgcagccaagcagcacgggcagggcccaggtttctctttcattcatgaat

SEQ ID NO: 5075 - DNA, 2042 bp, Zea mays
  misc_feature (1)..(100): optimal_loci_208867_G1, chr6:6612407..6614448, Cluster 31
tggctagaaaacacctaaaatatttatgtttttttattttcatggaagcatattgaaaaacaacattattgaaatgaatatgacacaagtattataggaatgtataatagggtccctattggtcaatagtagatactttgtagccaaaaatggttatgaagcaccatatcgccatatgtaggaatggacatgattcaccagtagttcatggaacatctgaaccatacataggtgataggtttaagttaaacatagctcatgtcaaagttgacataaatttaaagtacacttaggttcaatatggtggagggctttgtggtagagcggcacttaaaggggtggcaagatgtgattgttgtctatggagtacaatagtggggaattggaatggtgcagcaaagtttgtaggcgtcaaggcatgcatttcggtgagttggctaaagcatggagttggtgtattttgcatagaaaacaactttttccaaaaaacatcaattccttaaacagctagagatgtcaaattgtttattatttctactagtatttttgtttttctcaaaaatgtaatagagtcacataaatgagccatgataaataatatcggccatttccacttccagcccccaaataactaaccattacatcatttctatttctttacaaaccagctagtgaatcacaacattctagtaggctccctatatccatgaatactatagaaggaaacatatacacagtgatgaggaacaaagatcaatgttatttttttttgtttaggtaaagtgaaattgttttgcagtttgcaagaagttgcctttcatgtttggagagagatgtggaatataattgtattaattagcttgtacatatttgagaacgcattggacaatcaatgatgtggtaagtgtagattccctgttatatggacaagttcaccctaaaaacacatcaatgtctctacatgaccaataaaattctctttatacttggaaagtatatataatgaaaaaacatattaatcatctatgaaacattgggcaacgacacaaatctatgaggttgaacccactagtaaataaatgaattttactaatggtagaaattaatctttagtcatttcgttagtcaatgtatggccaatatatagaaatggtgcatttccacttgcaactatgctaataggggcatttggactaatagttgcattatactaatcacatgtgtaaagcattttatactcaagacatctatgttttgtccatgatattattgtgataatgaaaagaaatacttattgcaagtccacgaccacttgaccatccaatgattcatgagtgatcttagaaatacatagaggacaatgtattgtttggcacttgcaaggtagttccatggatcaaggattctctagtagtcatatcagttaggatggtgaggaatggttctatggaaattttgcaagtttaaacaacaaggatagatcctttggtagtcaagatctcagtaatgatgacctagataacattggtgccaacaatgtagtccatatggttgagaaatctagatgagatggtgcatgatgtcttaaggtttaattttatgagtacattgatctaagttcaaagagttgaatatgttaatggtagatgtgaggaccaactctatttgagctacaaggaaaagtacacaatgttctgcacttctcacaagctattctagttgaaggaaacacataattggattgattgaagcctccatgagttgccacattttctgaggatacatgattctaaagaggaatgtgataatcaagaccacatatttggccaagaaaattgttttccctatgggattagatgttaagaaaatgcatgcttgttggaatggctatgtcttgcttagtgatgatacaaacaaaacaacgattgagtgatgagaataggaggtatttaatgggcacaaagaaggacacaagattgatgttgatctatagcatccatttgatgttgatcataagtgtggtgccattgaagtatgttttt

SEQ ID NO: 5076 - DNA, 1840 bp, Zea mays
  misc_feature (1)..(100): optimal_loci_210085_G1, chr6:14332995..14334834, Cluster 31
ataccactttagtggatacacatgtggtcaaatcctttgttgtgagatgagttttgtgtaactaaggatctaaccccttatataatccataaatcttctcaggaattccaaagttaggccaaatcttttccaaaagatatttacccatttcttgttctaagtagctcgcactaataacaacattatctttggatgttgatcccttaagtagtaactgcctatcttttaatccttgcctccttggtaacaacacctcccttaggatgagaatcctggtttgactccaatgatcatgttgatagctcaatcccaacttagttaagttctcctttaggttctcataatccatgtagatgttactcttataatccatgctaatgtctcacttatatctaatagaatcatatttccaagttctgacaatacgaactggtcattccaaatccttgtacttactaggtaaacccaacttgctttggttaatctgatgctagaccatcacctccgtcttcatgcaaagacacattccaaaccaagacaatgtgcataacactagataatcaactcttgcattccactaagctgaacacgtaggttttacttcaacctttcattaactcctttaaacttatccaaaaactatttgttgcaacatacttgataccttctccaataatcccacaacacatcttagtatccatggaactccaagtttactttatccaagagagaacttccttcaaccaaagtccaattatcaagctaggtatagtatggatgcttctaattcttcataaaacaaacttagagatatcaagtatctacttgcatcaaaatatctccttgtccaaagtatgtggaaaattgaactctcttatgataatatcttgaattgaagaccaatcttgatgaaaccataacttccttgtggttgatcccactagctaacaaactttgaataaacattcctaaccttgatagtagattctaagccatagggatttccatcatctccaatagaaaccatacataactttcttagctgtatatgtgataaacttattcccatggttcaaacctgctggtgtagtcttattttgctaacttccttggatctgttcctttatgaacactctgttctcactccagttattgttgactcaggctttgattctcctccgcaatcttacagtaccactattagtgtaatgttccaatatcaccaatatcataacacccttcacttagtaagggtattatgagtcttcttccatataaggaccatatttaattcctatagtggtgaggcttgattctcatattgctactcttgttgctgaagctatagctgagatgaatttagatcttcttggcaattggtttcatgtaccggtgcttgctccaaagcttataaaatttggtcaaggtggatcagaattggtattactccttagacaccaagtaagtcacttctccaaatagcaaccatcttgtttccaatatgttggacttaaggtgtaactattcttatcactcttaatggtagactagtaagaaatagcagagaactcatctaggtagacaagcttgggcttggctaccccccttgaaagaaaagagggaaactagggaaccaaagggtagcagactctttcttctaatgttgattagctatccgcatgaccttcttagattccaacaaactcacttggtatggtcttgtcattttcatactcttaatccaacgtaactatcaaggtgactcttatttccaaaatattttcttccataaattcttcatcttccattgactaaggtaagattaggaattgcttcaatg

SEQ ID NO: 5077 - DNA, 1743 bp, Zea mays
  misc_feature (1)..(100): optimal_loci_221034_G1, chr6:86566443..86568185, Cluster 31
ggttagttcttcaattcggacgagttaaccaaacaggccctcgtgaattctgcaccggattcttccagctcgacgaagctgaaaatgtatcccacttctacgcattataaatgttgtcattttgttgttgagttcgagctgttcttctccaaactgtgagcggcagttctcatttttctgagacacctcgaccgctctccgagccgttttgccttacgtgtatcctactgtactaaggcgagtgcagcaggcgccaaaaacaaactgccgacgaggcaggatgagtaaaattaaacaacggccgggtgggagccaacgcgaaagccaacaacaggcttgcattgcagcagctcgatctcgatcgaccaggggattcctagttcaccaggtggcctgcactgcacaaacgcaaacagaatcttgagcgcccccaaacttttggcagcaggatgcatccacatgcagatgggtgtatgtatattcatgtacttttgctctctgactgcatcttttaccagctttctcatctggttcaagaatctctcgatctctcctgtgtttcagtccgtgtgcatattaacacacggatggcaggactgaaaactaggggatggaaccgggagtactcagctgctcttgatgtggggcgtggggaggctccacttcacgtgcatggcgatgatatcgatcggcatcaagctttacactagttctgatcctggtatggtacgtacggttcattttttaaaaaatgtcgaaaaaagaagctaaagcagtgcgttgaataacagagggaaaatgaatgggttgatgaagtggccaaacaacaactaatgcaagattattgtattcgcatacgtacgtatatgtactagatatctgttttctctcgatatatattcttccagttcagtctatgtgaacaactcacctgaagcttgcaacaagcacagtccaagtggagtagattatattagcaggcgatgatgcaagattccttccctgcatcatgtgcatgcatgctaattaatcaagagcagcagatgcagatggacccaaattaacaggcggcaattggcagcacccaaagctagctatagcccaatcaggcaattagtttatcctgaatatgaaccaccacgcacatggtccgattagttagaatgtcaacacggctaatcgagctagcaaacgtgaaatctgcttgcaggtagctgcattccgctaatggtccgatggaatcgatgtatcgatgcatgaatggatgcattaattccatcggactattggcggaatatgcagctgcaattctaactaattttcctgtttttctgcctctcttatgctctgtgttcacatggtagagcagctagctaggaggttagatgacgagtacacagtttgtcagtgttgacattattatatttctaatgaaagcttggcactttggctcctaaattaataagagtttttccttccatatcaaaaagtgcaattcatgttttttttggagaaatgatacaaaacaaataccatcagattgatcatgagatgtattttcatactaagcttagttggtgacataaatatcagcaccatttgttattgacttgatcaaagtgaaaaataattctctcacgcaaattgtgtagttgcatttttaaggggacagagagagaggagtatactcctagtaactaagtttatgtatgtatgtatgttgtataatgatcctgatatcca

SEQ ID NO: 5078 - DNA, 1560 bp, Zea mays
  misc_feature (1)..(100): optimal_loci_222830_G1, chr6:97879578..97881137, Cluster 31
tatgtacgcctaaataacgacggagccagcttttatgttcgatggtgtgtcggtgtcattgtattataaacagtgtttaaacattacttttacactatattttcgaaaatcatcgatgtcaccaatgccaaaggtagctttgcccctgcgcctaaagccgactctagcagtttatccaaagtttatttataaacactgttttgtaatgttctgtattgtagaatgtactgtttgtaaagtaaagattgaatatggatacgtgtatgagtaagctgttgaaccagtgcgtgtaatgcagtgcacgctgtaagcacgatgcatgctttaagatggcgacttttgggcggaatcctgtgatcgtgatctctctttgatcagaggtctatagtgttaggcgacagctatatatgcgtgtagatggacataatagatatagatatttatttatttatttatttgtacgcaagcctagcggccttgggctgacagcacgcactgaaggaaagaatttgaaaggagtggtcgtctttctcatcaactagatttgtacatggaaaaaaatctttctttctcatcaactagatttgtacatggaaaatctttaattgcctgtgctagtgtgctagtttagtttagtttagtttaccacaactaaaacgctatgtgtcaccatgttcgttttttgtaacacaacaaaaggtgtataaatactctataatctttgcgtgtgatatataataaacttatcaataaaaatatgtttgtttcctccatccatgtatccaaagtaattaatggtggctcttattgaataacatgcatatcagcatatgtcccgtaatatcgtgatctagatttggactttcaagaaatgagcccttcttctagtcgtcgtataatcactaaggtccgtgagtctgtgacgattttgagacaagtccgatcgggagttgtctagtctcatacatttctttaattaaaggtaaagttttagccgctaaaatgatgctacatagctgagcgtccaccacaaatctaagccataaggctcaagtacttacaaccactagcataattatctgtgttaacgctacggccggcgacgcgaggggaggagggagcggcgacggcacgagtgagagggaggacgatggtcgcagagtatgaggggtgtcgaacttggagaggaccacgagcagggaagccggtgcgtgtgaagcccagcgacgccagcgtctgcgtggtcttccgcacgatgcatgacgcttgtggagaagacgatgctcgacgtgtcgagcagcgtctgtgcgtatgccgctgcatgcgagacgtccaggtggttgaagaagtggtctaggtctgatgccgacaccgtggcacgcccttgcggggcgcattccaccgtggccgacaccgggagggagcgtatggtcgtgtgtgtgggacgttcaaggaaaagtcgcggcgagtgaggagaggaaggatgatccaaataatattggctattgaaattgagtgatgaggagaggggaggagcagtctgaactcttggttttgaag

SEQ ID NO: 5079 - DNA, 1495 bp, Zea mays
  misc_feature (1)..(100): optimal_loci_224918_G1, chr6:108334737..108336231, Cluster 31
agccaacatgcgcttttggtccctgctccgcgcttggtgacatgaacgcacgtgaacttttggtggtatgtgcctaatgctcacttcctagtggtcatggttccatcccttgccctttcattttttttgctcgccgcgggaggaattattcacatagggcacgcgggacgaatgagagaattagattttattttttttctcgttgtgtaaggaattattcgcaagggcacgtgggaatgaatggaagaattcaaattcgcacaaggcgtgcgggagtggaacaagcacgggacacattccaaggggaggggaggggaagggcgacgcacgaagaaactcatgttcatttatttaaagatgattattttttttattttcaaagtattggtgtgtgtgtatataatataatatctatcttttctgtaacacgaacacatgtgagctctggtggtagttgtcatgcgcttgctttccagcaaccacggtttgatccctcgccctcccattttttgctcgtcgtgggaagaattatttgcacagtcacgcacgcacgagggagaattcaaatttgcacaaggacgcacagggcatgcacgcatgcggggagaattcagattcgcgtagggcacacgggtgcgggagaagcaaagaacgacgcacgaagaaactcaaggtgtagtgaagtgaagcgggagaagcgaagaacgacacataaagaaactcaaggtgtagtgaagtgaagcgggaaaagcgaaggacgacacacgaagaaatccgtagtgaagtgatataagggtttttgcaaaggtgttgatgcacgacgatgtagggctttatagtaatagagatatagttgtcactaatttttctaatagctcaattctaaatcttttattatatatttgataattttaagtgattttaaataaaaaaatactactatttgaaaatttacagatcttgttaaatattacaactttcatattaaacttatctttattcaacattattaatcatctcaaatatgattcaatatttagacttataaatcatcacaaatttaaaagccctcactataatgtttatatctttttaaactctatagttttgatataaaatttatctcgattcgatcccttaaggaaaaaatatgattattttcgcaaaaaaaatctataactgtcgattgatgtaatgaactaatagttataggccactgccgattaaattcatgaaccgactttatcgctgtcaattttctaaaatagtcgtagggatagctcggtggcgaagatcttttctggcatagttaaagattcacaactaaattaatggacaaaaactaatgcactattttgatgtagaaatagatggagagatgagcacgagggtgagcagggatccaaaacgcgcttctaattaatgcaaattcagtgcaattttgatgaacgaaccacgacggagggaaacaaaattcatactgacgttagcatgc

SEQ ID NO: 5080 - DNA, 1996 bp, Zea mays
  misc_feature (1)..(100): optimal_loci_227700_G1, chr6:123454350..123456345, Cluster 31
aatgttaccctcatttgactgtggatcatatatatgtgtgtttggtggtataaatattattgcatacaaagttgtatgtcgcactatccctttaaatagcggtacaatgcccacacatttggtgaggtttttcacgatctacaagcatgtttttcattggatcgctcaacatccgaagatgtcagagcaagaacattcttaaactgccttcaaacatccgaatgtatctttgtaatctcatgtgaataaagaaaagatgggacatgaataacattatttgtgcattcttatacttttgtgttttcccataaaacgcccttatttgtctagaccttctcatcttgatttacgcctgttatttatgagttaatcaagagagaaggcaccatattactttaattgtgttgccctattttggttttctttagggatctttacatgtgaccaccagtaatactaattggatttggtagcctccacaaaccattcttgtgggttataacaccaaaccattaatgtgggatgtaacaaccttcgtaaactttcttggagagcaacttgagatcaagtcaagctggaaatgcaactaaaaagtgatggaaaacataaatattcttagattttttgtggataaactttagaaaacttgcactaaactttggattggagaactcaaattcaaaatgcttctaatgagagtgtttgtgcaattgagctctgttgaggctttttatagcaaaggaaggtggtgagctggaggagtcataagggtcaacaaatccatatcttcctcatttacaacacttctttgatggcatacacattggattctagatagctcaaaatgggagaaaatgagatgggatgtgtagggttagggttgtagttgaccccctttcaacaccattctcttcatttctgaagtgttcaaagcattggattcttggtcaagttgaaaggagggagtgtggttggttggagtggcattgtaggggtggttcaatgtctcatcgtgttccacttattacctcatcttccatgcttcgtgactcggctctaaacacaataaaatgcaaatgtggtagttgttggatgagacacggggttggctaacacccactactaccactttgctccaaaattttgtgaaaccattttttcaagtttttatacaaaacaggaaaatagtttcccaaaaaaataatcatgacaatttaaaatgaaagtgtgattagaaattaaataagagatacatatcgatttactttttggtgagggctccacgttttaagttcttagagtagaacttatccttgtagttcattgttctggtgcatcgattggtcctatagatgggaacgagatggttgcaccttatttttagccaaatcctagtaggtttgggttgtggttgtggtttggcgagtttgaccttctttagaggttggttggttcctccttcgtagtgtggatcatggcttcttcttggaccaattttctttgaccttctagttacagtgattcataggattgaaagaggcaaaaggaaacttcttctttgcacaagaagtggctttgtctagaccccacataaatgccggtaatcatggttttgaggaaatgcctccaaaggatgacatgtgtgtctttgtcatttcacatattaagcatggcaaatcctaaagaggcttcaccgcttcactaggatgtatagtcactcaagcaagcaaatggttcgaccggttagctacatatgaatatgagttgtaaacaataaaccataaaaaaatctcatacatgttgatgtgaaaatgtcttactttcacatactcaatacatcatcaataaccttagaataaaaggaagataagatatcatgagcatattttatcaaataacaagtttcgcatgtaccttgattatttatatgcaacctatagcaaaatggatagaaatgagctagtgggtccaccataggggattcttggaccacccc

SEQ ID NO: 5081 - DNA, 2437 bp, Zea mays
  misc_feature (1)..(100): optimal_loci_228913_G1, chr6:129533015..129535451, Cluster 31
aaacccaaaacatgaaatagagaaacaaactatattgtataacttttttcatgtccatgaatggtacaatgggggttcataggggaccccatctttgtaattcatatacaaatacttaaataacgtcaaactatgacattatagtttcaagttcgctaaaggacaatttggttaatatccatatttattagtcattgagtccttattgatgtccagtctatgcaagcccgtatatacttccaacaaggaatctttatcatctttgcttgattgcttaagtacaaaactcttttttattgaggcttcataggtcatgtaacttcatgtgaagtcatagtagccgaagcttcacgtatcttggggttacatagatgaagcttcatgtattttgccttcggtgacgaggtctttaagcgaagggcagaatcttttcatttaagtgaattgattcatttctttcttatcactttgttgctttatctaatgcaaagttgaatatagaagacaatgttaacaacaaaggccgttagttagctccaaagtatcaagggacacatttacctatagtgaaatccctaatagtatccccttatgagtgaagacctattccaaaggtctaaataccataaagtctttatttttttttgcaaaggttataacaccatacttgatctttggagttggatgttaaagagagtaataataaattttgaatttgtaatgttgaagtttaactatcgtggttaaaaaggattgtgaataataatttgattgaaactgcttataaatatcgttctcacgggttatgtattttactagttttccttgtgctcgagtgatcttgctattcttgtcacgagcattgcaaaaaaaaattgtgaagtctttcttcttggttgcgctcatgatatctagagaagaacttgccttcacggtctcttctagttctaagaaatacctgactgacattgaagtttccgaaagagaaactggttgatgaagcaaagtctcttaagtttggagcatttctaatggatgaattagaaataccttcacagtctctctatgtcgcgtaattttgttcggtaccttatttgccatcgtaaatatcctaattccttctataccattcggatacaattttttatccttctataccatcgccgccaatggcatagaaggggcaagtcacttatattccattggcgatagcatggaagaataagaaattatatcgagtggcatataagcgattaagatatttgcggtgacaaattaggaactgagcaaaattgcagtaccatacaaggaatcatctcaatttactattgatataatcttgagacgtgtaagcgtataatagttctcatgaaccaatctatgagatcacagcatcaaaaatgcagcagaagagaggcttaaagctggcacaaactgaaagggtagcgatttactaactgaggaagttatgcttgctgaatactaacagtggagttaatatttagaaagtacaatcattggcacgatgcacaattttcaaggctttcaccacatcctgatctggatctaccgacccagacttgttcacctgctccagtttgttccttgatgcatatggcatcggcagctaggtttgttggcgaaatgtcaatgtatctgttctttgcgtggtgctaagcttgtgcatgctacgcgtagatcaggtaattaaaatctaccagtcgttgaaaggcatctcgatccatatggcatatttttctttgaattttgttaagcaaaagcgatcacgtgagaggcagtggacagcgaagatacttgccgcgtgactgcatccacccaacaatattccattttttaggctcttgtagccgtggcgtggctattggcaatcatgtgctccatctttggctcggggagtagctagctagattttcttaatcctacaaaccaaaagctaaagcgagtttttacgcaaggagaagcaaagcaggtcggcaaaattcaaaatgaaatgggggaaagagagaatatgaataaaaaactgaaatattcaaaagctagcttgcaagtaacagtaagaatgtacatatgaaatattgagaaggagagaatctacgcatgatgggcgaggggaggtggtagggtcggagtggtgtagaacacatggagaggttaaagacacggagaatgatacagcacccaagaggaaaagggcaagttatgatgtgagaaggtgaacgtggaacagatagacacgtactctcttgggttatacaaattagttctcttaatcgtaaaataaatattattatgagatccatgtatagttaggttgctccaaaaacggtggggttgagatgttttcttttaaatcttgttatggtgtttggtgtacaggggcggatccaggagagggggggggggggggggggctgcc

SEQ ID NO: 5082 - DNA, 2505 bp, Zea mays
  misc_feature (1)..(100): optimal_loci_229557_G1, chr6:132194295..132196799, Cluster 31
gaaacacggagcagcgcgacggcacgtcaagattaaacgtccgagaaatggcaaacaatagaatatgggccggccggctttaactccagcggcacagtaaacggttggaaaaagaatcgtgttccgttcggcactgatttttatatttgtcacgtttagatttatattttttagataaatataaaaaccgtacaaaataggatgagaaaaatgaaaacggaactaaaacggcttcatcatatcatgatcatcttcgtacatcccatattaatacaagattataccgtattcaaatacggtatatctcgtttttttatgttgttatcgatccactactgtcgtgcccacacggtgtatcctatatctccgtatacaaaagtatgtcctgcgattctgtatgcaagagtaaaggatgacaaggtcacagagaaggaggggcatatataaccaggataatgaggaaaacaaatatattgaccgtgacaatgctgatctttttgagccgtagtcgtagggtattattttcagctcgagttactgtgtcatgtgtgattgacttgtataaactatcggtgtgcttgtgttgtgtctacctaattaattatacgttgatattgacttgttacacgtatttatagatctattatcaatctatcgttatataattatgttactcacattaaaacattattatcatatagttgttgtttactggtgagattatgtatgatatagacggtgttttcattttaactttcctattttcgatcattaccgatgcatttttttccattaggatcccgcgcatcttgtgtccaaacctgtttccgacaatttagattctgaatcaatttttgattaaaatgtgagagtgaaaactgattcatctcgattgatttcatcatatccctgcccccgggcgcccttccggactctggagtcaacgcgttaacgggcagagtccagcagcaggacgaggagaggacaagtgccgcgtcgcgtgacggcgtgagatgtgtcggtgtcggtgcgcggcgacaccaaccgcttgcggcagctgccgcagcaccgaggaagcaagcgcgtggcgcccttgcccttccgtgtccgcgctcgcatggtcgcaacggcgataacgcggcttcgtccaccggtctgaacccaaccgtgtcggtcgcaggccccagccacacgaaccgctcgatctgctctttattttacttgggtgtggtagaggtgctttcaaacgtccacggcagttcgggtgccccgtcatttttaggcttatatccttttgtgatgtatttggcacaaattggatttactagtagaaccaattttttaaaaaaatgcaaacagctttgatagtaaaataaaccattttcgttattctgtatggcaaaacaaactttacctgaaacaccaaacgaataaaataattatactacccttttaatttagttctactgttcttttactttttcgaggcacgacctacgcctttttggcagtttgattgtccgccctaactcatccctatataaaacgaggaaaaaaaacttcgcccgtgatgatgtttcaaaacagtacgtttggttaaggaaatagctcacgacaactcatgaagctgccggtaaaactatgccaaacattaccctacttactattgaacaaaccagaatatgatgctccgatcctcgtcatttacaattaaattattacttcctctccacccccaaaatgatttgtcactgtgataattcatgtcaatcaaagtttcttaagtttggctagaaaaatatatttgttatgaaaataaagtcaaaaatctatctaatggaacaaattatatactatgaatatcaatattgtattattattattattattatgtatttttaaagttaaaatacatcaagttggttagcttcttggcagtcaaccaagatagttagcgtcttggctggcagtcagtcaataaccatacgtgacacgtgagatatataactagctcccggctaaacaatgtgctgcctatctgcaattagataggcaccccgcaccaaccattagttgttgcatagttttatcttgcaatgagtattccacgccatgatattcctgtgggcattgggcaagttgaatcgtgcttagctatggccacctatggcacgttttggagtgcttatatatatgaatgcatgtgtttgtttggtctgctctgcactagttgcctgttttcttttttcttttcctctctatctatcttattataagcaaaggtatatataaacaaaacatgggcgcttaatcgattcatcgtttgcgcgtcatcaccctcatgtgtgatgtgtcggtgcaagtaggtgtcagttggagatccaaatttaatcgtgcgcgcatgtataaatgtggaggtgtggggggtagcagtacaagttatgttcggggtatttctctacactggggatgtcagacactttttattttaagtcaacgcgttaa

SEQ ID NO: 5083 - DNA, 1919 bp, Zea mays
  misc_feature (1)..(100): optimal_loci_233896_G1, chr6:152500935..152502853, Cluster 31
ggtagcgatcctcaacccgaaaacatcgtccccaacccggatatatagggtcattttcgttcccaccgtttaaaaacatctgataagtagcgtaccatgttcctcgattctgttcctcgaccctatcgacttgggaactttgtgactatggttgtacattcccttagaaaattctttggtgatgataaataagagagccgttagcatttagcagctgactgtaccagttgagattagcaatcaccggttgttcaacacgatcattttattacacggtgttgtttccttattgttgtttatgagctactaggtcttttgtctaatgttgttctgagctattgaacgtgtgctgtaagatccacattttcatagttttgatcaagtggtgcactgctttgttcagaaatctgtatatagggttatcttgctgcaacatttggagcaactcacgcgtcttgttaagctgtgcgtagcagaccgtttaaaataaaagatttacattgtagattacactgtttgtagagttaaatttaaaatagaagatatgattgggggatgcgataagataactgctggagacaatggtttcgagttgagtgttcagtttactaaatcccattaattcgaagtttgttttgctttatgaagctttaccagacgtttttaggatatactatttggttttacaagcgatttgatgttttttacatttatgatggttgctaatgcaacctaggatgttccgttggttgattggatgcataattgaattacatggtatcacttctgtagtatgaatctactccggcggatggattgcctgttccccggattcacctttgccagaaccaaacattactttattgtggtaccggtagaagtttagttggctttattactcggtatatgatgatggtggacatgtctccccgcatcttagctccggtgagtgtcctagctggtgtacacctggtggctttgagggatcttctggtcgccgctctagtagtctagtctttcggctgtttgccacagcatgcatgcattcgtatgcctcacctgttccaacttgcaagagtatagaggactggcgaattggagccgtatagctagtcagattgtggttagaaaattttatggggccacggggatttattataaaatagaccgtacccattgcgattaatgaccacccaggttgttcaccacggtcacttcattcctttacatggtgtatattgccctatttcgttgggcattggagtcaagacacgataaatatgatcgcgctccgagggcatcctctacccagtctgtcagcttgtttgctaagcgtcacaacgtatctatttttttattatttttttatgactaagtttagttttttaattcgaacaactaaagctagatatattgtgacgccttagttaggaaactaaatatgtcctaatccgactgcggctgcgatttttatagtattttatctctatgtattacagcttgcagtaatctgaacagctgtagcaattcgaacaggttgcgtaaccagttgaggttcaaataagccgctgtctcatttagatgtcctgagttcatacgagcgcaacaaattaatctcagctcacggggccgtcttggtttgtcatgccggcaagaccataagcatggatgccaagtgtatataatctatctatttccatgaaactgcgtaggcctttcggctttagaagtccgtacacttgttcgctgtccaatttccgtagaagtgtagatcaacgcaacgtggctatatagtctagaagtcgtgtatatatgtgtatgttcactagtcactgtcaacagcgacctcgacaagtatacagttacacacaagggaagcagcagattccgagaaggcacggtgctcactgcaagtacta

SEQ ID NO: 5084 - DNA, 2499 bp, Zea mays
  misc_feature (1)..(100): optimal_loci_234323_G1, chr6:154083849..154086347, Cluster 31
tctgaacccctgcctcaccatataaaacggcaccgtagcaagcaagagtgaccacaaccgggccagaccttagatctgtgctttagatgcccctttgcacagttgcatatataggtaaggaaaaagatgatctagggttggtttatggaagtataaccaccctaagatatcaatttttagaaaacgataacgggctcaaggccttgactgtataccagaggcaccccagggtctagcctaccagttgtttaaaaaaaggaccccaatgagtgctaagcccatgagggcatgcccaccatggggttgtagaagcctggaggaggtgccacacactggctcttggcaccggcggcctgtggcaggcaatgtcgccagaggtgattggttctcgggccacatgtggatggatctggttcacaggtttgaagcaggcggaccggaccctgggacaacttctgcagcctggcagagccattggcagattggttcggagttgtgcttcccgcttgcttgcactacatatctgcacctctgaacagtttaggttctgtgctaggcaaggaatacctctgatgatgttgatagttacacttgttatatttcttctctctggcagaagtttgtatgtctggttaattggaggttatcttcagagaatgtactggctactggaccaattttgtaatgcgatctgtttgtgcttgaaatgtgatggagaactggtgggcttaaccttgtgtgcttttttgcaggttgtatttcgtcctcgacaatctaagcataagagtctcattgctgcatgccttgagtttgaggaccgcctgtctgagtgcaaggacttgttagctagcttaacttgcgaaggacttgggcaactagaggttgaccgagtgtgcaattggcaggtgtgatttgttggtactgattttgtgtcttcttgctgggagcctattggcctatgatcatttattctttttttactgctggtaactgcagctgtattgattagctttgcaatcatcctgtggcagataatatccatgaactttatcaagaggctgacagaagattatagggaatatgttgatttgatccagccaattcaagttgctgtatatgaaatgaaacttggcttagcaattgctctatctggttctcttcagagggagtatttgaagaagattaaagaagatgatattaatagagttcttgtatgtctagttttgcagccatatttgaaatataaattattcttctactaattatcatcaataatacttttaaatatatgcttatttagctatagactctggtattggtctaggttaaatttgataaattgccatagttatgtgttggtttcgatgttatccgttttaccacatttgtttgtagatgttgcaaggaagcaatacaatgcccttggctagtgacgatctctcattgactttataatgctaatatttctttcattgtcatttcctttgtgtagggagcaatttatgcttttatgcagtttccctctggatcttttactgaaagggttgtaactgacgtgactgatgatcttacaaattatacaatcactggccaactaggaaccctaaacagttgttctggagatgtagatatgttgaagaagcttgctgctatgtcaagtcagttgaatgtttgtaaagttgctggcaaagtggtagttcatctatttctacttgcttattcaatgtcgttagcttctttaattatatggatttatttctctggaggtggctttcagcaatattttgtgtactatttgcagaagtccctgtccgagatgcttgcttcagtgcatcatatttttttagtaagaacagctgattgtgtcagctgttcccttgtcatggataagtcatcttatgcggtatgcattttcatatacatatcattttgctttgtactgataagataaaccaaatgggatttcttaccagtttttctttccagtcattgaaggatacctttgatcattttacaagcatgtggatcaacatgaaataccgtttgaaggctaaagaaagcgatgattctcagtacttcaagttcaaatcgcgaatgatcagtatagacgacatctttaaagatgtgccgttgctttctgatatggaatcagaagacagcattttagataatgaagaaaaactagagcatgaatttttcaaaattacggtattgccctcatgctagttctttgtggatgatggtgttgcatattgatctatcaattttgcatattgatctatcaattttatttatttcaggaaagtattgatgacgataatggtgttgttgaagacaactgggatttgataccagagtctgctcttaaatgtattgtgaccatacatgaccaattgtttggttcgcccgatctttttgagaaggtataataaagttacaatgaaatgccaccttttaggttgtaatgaaagaaatcatctggtatactcgttttgcatc
